United States Patent 10,888,096 (BIOPESTICIDES FOR POTATO LATE BLIGHT DISEASE) - sequence listing, part 11

SEQ ID NO: 37 - DNA, 839795 bp, Arthrobacter sp. OY3WO11
tgctatacgaagttattacgcaaaatcatgaaatgcccggcagcgggcagctcgatgttggtggcgccgggaaggacactgccctccgggatgtgcggatcgaacgggccgtagatggaggtgatgcggctgttgatggcctcttcgcgcgcgagctccagcgtcagggcgttgcgcggcgagaagatcctcagggtgggcagcagcatgtacctggcataacgcgatcccgaaaacggcgtgcacacggtgaccatccggtcgatccgctgctcggggtcgagcatcagcatggtgtacttgccgatcaggcctcccttgctgtgcgccacgatcgcagcgtcctgcagccccgcttcctcgatgtgctgggccaccatccgcgccgcaacgggcacctccagcttgttccgctgcagcaccgtgaccacatggacgggatggccggcgtcgtggatgcactggataagcggcatcatgaactgccagttttcatagacgccagggatgatcaccacgggccgccggtggccctggtggaaggatcctggctggacccgcgacaacacgccgcggacctgccatcccgcggcataaaggtagtcctgaacccaccacatggctttccgcaacggacttatccgagtgctcacgccccgttcactcatctgtcgaggatatccctagtagttccggcggtgcttcaggcggggaataacgacgccgaacacggccgccgccgcaaagcctagtatgcccgtggctgagacccccgcgcccagggtggcaagggcggtcaccccggagaggagcacgggaccgccggtggacccggcatcggccatgaaccgccacagccccaggaactgcccgcggccacggtccggcgaaaagtccgccccgagggtcatcaccagcccggaactgatcccgttgccaaacccaatcagcagcgcagccagcagcagccccgcaaaggatcccgtgaggggaatcagcagcagcgctatccccatgatcagcgtggacggcactgccacaaactgccggcctttccggtccatgagcttgcccgcgggatagaacaccagcatgtcgatcgccccggaaagcccgtaaatcagggaagccgaggtcgcgtccatgcccaggtggtccgcccacagcgggatgaccacctgccgggacgagcgcagcgcgctgagcagcaggatccccacgcccagcgaaaggaacacgcccgcgtgggacaccgcgacgccccgcagcgtgggctccggacccttgtgtccgccgtcgggcgctggcgcaacggcaaggtccggaatggtgagtgacagcagcgcggcacccgccatggccaccacccccacccagtaggcgccgctgatgccggcgaactgcatcaccgcggcgcccaggaacggcccgatgaacacgccgatccggtttacgccgcccagggtggacagcgcgcgcgcccggaactccacgggcacggcctcggtgaggtacttctgccgggccaggccaaacacggcgccggacattccgacgacggccatcgccgcagcgagcagccacagtccgtcgggcaccagcggcgtcagcccggcggccgcgagcgcgaggccgcctgcgacggcggctcccacgatggaccagcgctcaccgaatttgagcgtcaccagggaggcgggcaggttgaagaaccaggagcccagcccgatcagggtgacgatcagggcagcaacagccaccgaggctcccagatcccttgcggtcagggccaccaccggcaggatggcacccgtgccgattccgtagagcagcgtgggcccgaacgctgccaccgcgatgccgcgcaggctgaagggctgggggtcgtccggggaagtcatcagatttatcctatggccggcgggccgccagccttggggacgcacgggcagcagtccgccgcgggaacgccgcccggcctgcgcaccgaggggaggcgtcagcgcgcagggactgcctgtgcggaccggacgcgggtctcagtgcgcagcaccgtacaacccccatgccgggaaactactggagcgtccgccgttccaagccggccagggacctgaacaaggccacgatttccaccacggcaccaatgatcgagcccacgatgcccagtaccagcagcacccgcaccactacgggccagccggaccagctttccccaaagtcgaaggggaagacctcccacaggcggagggtggcggcaagccctattcccaggaccaccaggttccccaaggccatgacgcccctgttgcggatcaccacaaagacgaggttcgccacaatgcccgcggtcagtgacgcgttaacgatgccgagcacgcgggtcatatcggaggtaaggaacggcaccacctgccagcccggccagacgttgattccccacatcatcgcggcattaaccaggacagagccaacgttgccgccgcggctggttaccgtcttgtcagccatgcaatctcccggagccagtgaacggccggcacaggtggatcctgcggcctgcaatcagggtgcccccggctcgacgccgcaaggaagtgccgaaggtccccggccgccgtggcaggtccgggaccgcgcaaatccgggggtcacaaacgccccgcagaggagtagcgttcgccttatggggcgctgatccgcgcccgtacaaaggggaggtcattcgatgggtgaagtgtggatccgaacgctcggcaacgggctggtccgggcagacagagtcaccgaaatttcatccacccgcgggtccctccaggaggaccagggctattcgctgaaggtcatcgtggacggcaagggacacgtgctcattgacgacgacgagctgcggggctcgctggccgagcggctggaatacgcccggcacgtggaggacgccctgctgcttgccatggacgaggcccgggacagcgacgccgccgtcgtcatctcctatgagccggagcgtgagcgctggtcagcagcaccggccaccgtgttagccggaaggctttctgaagcagtggggtgagcccgtggcggttcgccgcgtacgacgacggccggcggccctggtgccacagcctgcggttaccgcgaacacctcagcgcgtccgggcaggccgcccggcgatgctggtccgcgggcatcgcagccggagcgctcggcccacagcgcggaatcccaaacgatgcaataaacaacctcatgttgcgtggatcacattcagtccctactctggatgaggctgatgcaaacggccgtaagcaagaagctgcagcgtcgcagccaatgccggggaaggctttacaacttgaattcaaagctgaacattgttgtccgtgtagatctcgaccacgccagggcacaggtgattgcaaaggggcatgtcaccgtccacagcgtcaacgcactgtatgtagtagtcaagcgcgccaattccttacgtgaaggcctgggcgtcgaactggatatttcccatgcgcgggtggaccaggaagcgctggaaatgctccatgcctcttccgagacacaccatctgcccgccaagatcgatccgcagcaggcgccgtgcaccatcagcgtcctggctccgcgcacggccgcccgcagggcacacgcgccggcactgatcgccgcataggcgccccaggcaacggcacccgaagagcccaatcgtcgggccagggcgccagccgcacacttctttttcttcctgattgccacggactgcgagtgcagctgtatccgaatagacgggtagctgcactcccggtttgatggcagcccgccacgggccatgcccgggagtacagcttctcctgaatacaggggaggctgtactctggggtccatggagaccctcacgcatgccccggtcctggcccggttcggttacgcggtgtcagacccgacccgcgcccggatcctcctcgcccttgccgacggcggcacgtacccttcggatctggcagactcccttggcgtgtcccggcagagcatgtccaaccatctggcatgcctgcgcggctgcggcctggtggtggcagtaccggacggcaggcggaccaggtatgaactggcggacgaacggctggggcacgccatccgcgacctgctgggcgtggtgctcgcagtagatcctgcgtgctgcgcaccggacgggacatgccaggcatgacgggcctccagatttctccggccccggaacgccgcgcggtcctctcccgccgcatccgcttcttcgccgccgccaccatcacctacaacgtcattgaggcggcggttgccctctgggccggtggggtggccggctcggcagcactgatcggattcggcctggactcggtcattgaggttgcctccgccgtcgcgctgtcctggcagttcgcttcgaaggatccggaacggcgcgagcacctgacactgcggatcatcgccctgtcattttttgccctcgccgcgtttgtttccgccgaggccgtccgctccctggccctcggggaaggggccgagcattcggtgccgggcatcgtcattgcagcgctcagcctggccatcatgccggtactgtcctggctgcagcgccgggccggccgcgaactggggtccaagactgcagtggccgactccaagcaaacactgctgtgcacctacctgtcggccgtcctcctggccggcctgctgctgaacgccacggtgggctggtggtgggcagacgctgccgccgcgctggtgatcgccgccatcgccgtccgcgaaggcgtcgaggcctggcgcggcgatgtgtgctgcacggttccggccaggggtggcaccggcgccggccaggagagcagtccagcggccggcggctgctgcgcagggtgcgagggcaccgctgatgtgccgccggccggcagcggacactagtcagtacttgggccagtagtccgggttgaagccgctgggggtcgggggcctgggcgggtcctcccattggccggaaggactttccggctgctcaggctccggctcagactcctgctcggattcaggctgcggctcctgctccggcgtcacctcgcccgtgcgttccagcgcaggctcaggctcggtactttcctcgggttcggttttgtcgtgcgccatgtcgctcccttggggaccgggatagcccactgcctgagcacttccagagtaggttccgggatgcccgccatgtcaaggtttccacctcccctacttggccccctgccgtgcccggcacgaacggcgcatggccgctggcgcctattcgccgccctccacgaactccagcaggtcgccgggctggcagttcagcacccggcacatggcttcgagcgtgctgaagcggactgccttggcgcggccgtttttcagcacggccacattggcgggggtcaggcccacgcgctcggcgaactcccccacgctcatcttttgcctggccagttcgacgtcgatgcgcaccacaatgggcatcagatcaccgcttccatgtccgcccggaggtcggcggcctgccggagcagggcgcgcagcaccaccaccaccaggcccagggcggcgcctgctaccaggaccaggaacagcagcagcggcagtccgggatcgtcggcgttaaggacgacgacggcggaaagcgccgcgagcatcgtccagccggcggcgatggcccagacaatggcatccacccacaccagggctccgttgctgaagatccggtcgtgcttgacaagcgtcagcagcttccaggtgcccacgatcaccacctggacgcaggccacctccaggatgaagaagatggtgaggggccactgaaggtgcgcacggtccggattctcctgcgccatgtgcgcgaactggccggggatggacatggcctggaacaggaccagcaggaggaaggccgccacgaggacgatccggagggcggtgactgccaggcgggttatttgcatatatcgagtttcagctactatctatcgaaagtcaatcggtgctcgcaggtacctaataggagaatcgtcagggaatcagctggtcccggcggaaccggagctcacgccgggcgccattaaggggtgatcccgtgaaaggcagggcgtccagccggatgcccccggccgcggtgagggccaaggcgttggctgctgccgctgccttgggagccagtccgatggcggccgcgaactcctgccagtgccttgccttgagtcccttgaccttgccggcgaggggaagcgccatggtgtcgtcaccgtagagcagggtgcaggggatgtcgtacatcggagccacggcccagcttccgttcctgcctgcgaggacggcggcgttcttggcgtgcaggtccccgttgccggtgagccaggcgaagacgaactgcaggtagaggttgcggaccgccacggcttttgccttacacagtccggccagcgccaggaccagctgctcggagctgactgcgtatttcgacgccggcggcaggttcatcacctgcgctccgtcctcgagcgccaggcgcaccaggccgtcggagtgggcgcggtcgaaccgctccaccagcagcccgggcatgccgcgcttgtcggtgaccacgctgtgcctggccacagggatcttcagggctttggctccggtgagatgggcggcctcattcaggacgagatgcgggtagctgggcggatccagcttgagcaggtatcggcggttggcaagcgccagcggggtggtcatcattgaggcgcttgccttgtgctgcacgccgggcagtccgtgcggatccaccgcgtccgccaggtaggcgaagtccaggtcttcggggcgggaggtatccgccagcggccgctgttccgccagaggttcgccaaccgggacaacctgcacgtcacccggcatgtctgcgcctacggccaggaggaggctcagctcatcacccaggctcgtcttcacggcgtccttgagcacggtgagccggtggccctccggcaacagccccgagaagaacgccggcagcgaaccgctgggtgattccacggggtccactgcaaggggcagtgttgttgccaccggccgggcaccggcagcaaggtattcggcagtgtaggagaaggccacgctgccgcggtccgtgcgggagaggtgcccggccaggacacccgccttgtacacgtctgcgccgcggacgaacttcaggcgctgcaggtcctcagtcatcagcggcccggaggtggagtcctaccgcgttggccgcggcagtaaccgtgcccagcgacgggtttcccgtcccggtttcaatggcatggatggttcggggggacgtgccgatcagatcggccagcgtgccctgggtaataccggcctccttgcgggcgcgccggatgctggctccaatggcctgaacgtcgtccatcagtcccttccgcaagatattgctgatttgcgtgctcttctaggagaggatgtcccactatccgtgaaagcgcaatatattgcggaaaagagggcggggttgcgctcagcggcccggcagtccccatatcggaagtatctttcagatccgccgcgcattgagcgccgaggggccacgcccacagggaaggcatggagagggaaaaccagccggtccttggctgatcttgaggcaatcctcgccggtccttgatccgtccacagcacactggtgggagaggggcctgaagcgtaaggcagcagtagctgggatctgggcccggcaacaggccagggccggcggcggaggcggcggaacagcgtggttccgcaaatagccgccggccctcctctctcaccggccgcccgcccagccgtcatgcagcagcgcacggcattcgggcatggaatacctgccgtccttcaaaggaggccagcattgcacccccaaccgctgacactccggcccctgacgggcataggatttgcagcatgaggattgccgtcgcaggtggaaccgggactgttggccgccacgtggtggaggtggcaaaagcacgcggccacgaggtctcaagcatgagccgggccgacggcgtggacctggtgaacggccgcggccttgcccaggccctccagggtgtggaggcagtcatcgacgtctccggcatccagaccacgtccaccaaaaaggccgtggacttcttcaccaacgccacccagaacctgctggcagcggaaaagcaggcgggggtgaagcaccacgttgccctctccattgtggggatcgacggctcaacctccggcctctacgccgggaagctggtgcaggaggacgaggtccggcacggcggaattccgtggacgctgctgcgctccacacagttccatgagttcgttccgctggcggtgaagatggggaccgtgggtccgctggtgaacgttcccaagatgttcacccagcccgtggctgcccgggaagtggcggaggcactcgtggcggcggcagaagcaggaccacagggaagggtcacggacctgggcgggccccggaccgaacaactcgcggacctggcccgcgcctacgtcgccaggaccggccagcgcaaaaggatccttgaggctgtgctgcccggttccatgggcaaggccatgcgcagtggcgcactgatcccggcgccggatgccgccgtcggacgccagacgttcagcgaatggctggaaacacgtgatgccgccggcgggcagaaccagtaacgggggctcacgcgccagactggccagtggtttagggggtaaccatgcttttcgaatcgacagaccggtatttccggaccttggggccccgcggccggacagtgatgttccagcttccgctatcggtcacggtgctgctcgtcacggtcctggtggcccttctgcaccccgggttcgagtggtccgggccgttcctgtacagcctgggagcgcacctggtgctgctcacggccagcgccgtggttccttgggaacgccttccggcacgggccgtcttcgtgattccgttcctggactgcctcgccatcggactatcccgcgaatcaggcggccaacatctcaccgtcctgagcttcctgctcgtctttccggtcgtatggctggccgtgggcctgcgccgcagaggtgttgccatggccgttctggccaccatcctcagcgtggcagtgccgccggccgtcctcggcaccggatttaccagtgcctccttcatccgggtggtgctcctgccggtcgttctcggggccatcgcgctcacggcctacggagttgccaacggcatcaccatgcagcggcgcctcctggccaaacaggaagctgacctccgggacctgctggcggccagcgaggaccgcgaacagctgctgaacacggtgatggacactgtcagcgtgggtgtgtgcgccctcgacggccagggccaggcagtactggtgaaccggcaccttggcagccgcctcgcggacgccatcggtgctgacccgactcccggcaacgtgaccgacctgcctgtctacggcgtcgacaggaaacaccggcttcccgccgaacggcacccccgctcgcgcgctgcccggggcgagtccttcaccgacgagctgatctgggtgggcagcggaaccacccagcgcgcatactccgtgacctgccgtctcaccaggacgtccgctggagggcactcaggcgcggtcctggcgttcacggacgtcacagccctcgtgacggcgctctccgcgaaggacgaattcctggccagcgtctcccatgaactgaggacgccgctgacgtccatcctgggttacctggatcttgcccttgacgaagagggccttgagcctggcctggaagagtgcctggctgttgccaaacgcaacgcccggcggctgctgaccctcgtcggtgacctgctgaccatcgcgtccggatcgttgaccatcgctccccgtccggcggaccttaacgtcgttgccaccgccagcatccaggctgcacagccgcacgccacggccgccggcatcacccttgaactggaatcaacggggccggccacaggacggttcgaccccgagcgccttggccaggcgatcgacaacctggtgtcgaacgccatcaagtacacgcccgagggcggaagggttaccgtccgggtcagtgccacaggacaaagcctcaggtgcgaagtcaccgacaccgggatcggcatgaccggagacgagctgggccaggcctacacccgtttcttccgggcagccaatgcacactcgtccgccatacccggtgcgggcctggggctggcgatcaccaaatccatcgtcgaaaaccaccgcggaaccatcagcctcaccagcagccccggaaagggaaccacagcggtcctgacccttccggaggcggacacttcccttccctccctcgccgccgcccggtaacaggatcccggtgccgggagccgccgtcggacgccggacgttcattgagtggcagaggctacccgcgggccttcctggcgcccctgtgccgtcctgccggggcgctgcccgtcagcgggtgggccagccgccagtgcttgtgggagtggctgccggcgcggccggcgggaggggcagccgtggccaccagcgacgatcccctccggcggcggcgcaaccggaggaggacgatcaccgtcaaacccagccacacgaaagttacaccaaagacaaggaccagggacggaatcgcatccatgatcaagcttaggctcggaaccgccggtcttccttacctgtttcctgcgggctgactacgcgcccagcgggtgagtacctcctcgagcccggctagctttcaaaggccgcgcggaaagctgcaagggcggcatcccccgaatccatgcccactcccccggcggcagctgcttcgagaccgacgactcctgtgtagccggcttcgcggagggcggctgcaactgcgcggtagttgatttccccggtgccgggctcgcaacggcccgggacgtcggccacctggatttcccccacccagggcagcgcggcccggacaagttcgatcaggtttccctcaccgatttgggcgtggtagagatccagcatcatcctgacattggggtggtcaaccgccgagaccagcgccatggtgtctttggcgcgggccaaggggatgccggggtggtccagggcggtgttcaggttctccagggcgaaggtcacaccgtgcttttcacccaggactgccaggcgttcgagggtgctccggccagtcagccacatctcacccgttgatcggtgaacgggtgagacagcccggccgccctccccgagctccgccgggtgcaccaccatccgctcgacaccgagttccagcgcagcagggatcagcttctccgcagacgccagcacctcgtcggcgttgtcggcgtccgtcaggctgccgccaaaatatccggtcatcgacgagaaccgggctcccgtagctgccagtgccgcgatgtcccggccccgggtatcccacagctccacctcgaaaccgtgcccatggatcctcttgacccgctcgatcaacggcagatcgccgtagaccatttcggcgcacacagccagccggaagctcatgctttgttgcccacgaggtgctgtgcaggttctgccggccgcaggacggcaaccgatgcaacatccaccggcaggcccgtttcagccgaacggaaggcggcaagggctacggccagggcgttgcgcgcatcggtgccaccgggggcctgggcggcgggagcctcagtgccgtcacggccggccttaacggagtccacaaagtgggcgagttcagccgtataggcgtcgtggaaaagatccacgttccgccggacggtggccgagctgatgcccgcagcggtgtagctcgttgcgctggtttcctgcggccctcccgccgtcaccatccccgcggagccgaacacttcaccccgcacgtcatagccatacagcgcattgaagttcgcctcggccacggctatggccccgttgctgtacgtcacggtgaccactgcggtatccagcaatccgccctgttttgccccgggagccaccagcgcatcagccacggcataaacgctgaccggaacagcgcccggattcagccagttgagggtgtcgaaatcatggatgagggtttcgaggaagatggtgccgggcggaatccgccccgggtcggcaatcccgtccgcggtgcccggatcacgggtcaaggaccgcaacagctgcggggttcccacggcgccgtcgtcgatcagcttgcgggcagcggcgaagccgtccgcatagcgccggttaaagccgaactggaccaccactcccgcagcctcggctgccttcagggccccatcgagctcctccaccgtgcggccgcccggtttctcgcagaaggcgtgcttccctgcccgggctgctgccgcgatgagtccggaatgaaaccgggccggcgcggaaatcagaacagcatcgacatcgggatcctccagcacatccgccggatccgtactgatcttggcaacgcccaggcggccggcgagtgcctcaactgcgggcagtgccggatcagcgattgcctccagccgggcgttggggatgcgccgcgcgacggactcggcatggaaacttccaatccagcccgctccgatcaagccgatacgtaacggacggtcttcgctgaccgggtgctgaacgtaacccatacttactcctgacatcatcatctagatcgttctagtccgaccatgatgacatgcggttcacgtcaggtctagatcgttctatagactgttagtcccaggaggaaatatgacggaacttcaacgccgccccaccctgatggacgtcgccaaggcggcaggtgtctcgcgcgccctggtttccatcgtgatgcggggtgcgcccggcgccgcggaatcaacccggcaaaaagtcctggaagctgcccgcgaactgggctaccgggcagactcccgggcgcggctgctccggagcagccggaccaagctcctgggcctcatcttctccagctcacagcccttccacgctgaaattgtggatgccgcgtacgccgaagcctcggccaggggttatgagatagcgctgagcgccgtggccaccggacggcccgaggcccgcgccatcgagacgctgctggacgtcggcgctgaagccctgatcatcatcgccccgaccctcagcaccgaggacctggcactgcacgcccgccgggtgccggtggtgagcctcctgcgcgatgacgtgggcgacctcgtggattcggtcagcagtgacgactacgccgggatccggatagccgttgaccacctggccagcctgggccaccgccggatcgcccacgtggacggcgggactgccgtctcctcggaccagcgccgggaggcataccgcacggaaatgctccggcacgggctggagcccgtggttgtggctggcggcccggatgaggaaaccggcatgcgggccgggcaggttctccaggcggacctgcccacagccgtgatcgccttcaatgacagatcggccctcggcatcatggagagcttccgggctgcgggcataagcattcccgcggacatctccgtgctcggctacgatgacagccacttcgccaggctgagctacgtccagctttcctccatcagccaggacgccccgctccttgcggccgcagccgttgaccgagccgtggaccggatcgaagggacgctgccaccgggccgcgttgtccggacaccccacctggtcctccgcaagaccacgggacacgctggtgcgcaaaaagtgggtcaaaactaggcggatcctgagccggaatctccgctgcgcagccttggcggccttcagacttgaaagggggggatcactccggtcacctccttcttcgtgcgcccgcccccgccgtcgctctttccacttaaggtgctgcagcgcaccacctggaggtccagtgaagctgttcagatacatcctgtgtttcgccgtgctgctcgcgtgggcgcttcccgccggcgcgaccccggcgcgcgccgcgatggccgccatcaccctcagcccgaacaccggccctgccggcacctccgtgacggtcaccggaaccgggttccccaagaagacttcggggacagtcaccgcgggaaccaacagcgcccctttcaaaaccagcgcttccggctacttcgcggccgaactggtaatgcccgaatcagccgaggccaccgtcaccgtccgggccgcaacggcgacggcgagcgccaccgcacctttcaccgtcacctacagctccccatccgtcgtcgaagaagagcctcctgccgagccggccccggctcccgcgcccaccagcccagcggcgcccgccccggcaaccctgcgcttcggcgtcggtactcccggcggcccgctcgcggcggccgaactgaacgaggtcaccgccctggcgggcgaggcgccgtccatcatcctgtcctacaaggacttcaaccaggctgcgcccatcacggaactggaggcggtccgcacccgcggtgccctcaccctgctgacctgggagccctgggcgtggggcggcgggacggcgcagcccgcgtactccctggaccggatcaccgccggagacttcgatccctacctgcgccagtggggccaggcgctggccggctggggccacccggtgatgctgcgcttcgggcacgaaatgaacggcaactggtacccgtggtcggagcaggtcaacggcaacggttccggggactacgtggccgcgtggcagcacgtgcacggcgtggtgacggcggcgggtgccaccaacatcacctgggtgtggaaccccaacgtgccgtactgggggtcggtgccgctggccggcctgtaccccggcacagggtacgtggatgccgtggcgctggacggctacaactggggcacctccgcctcctggagttcctgggtgtccccgtcccagctcttcggcgacggtctatcccagctccggaccctggccccgggcaagcagatcctgatcgccgaaacgtcctctgccgagcagggcggctccaaagcagactggatcaccgccctggtcagctacctttccgcccagccggacatcaccgccttgacctggttccactacaacaaggaaaccgactggcggatcaacagcagcacctcctccgccgacgccttcaaacaggcactggccgcacgccggtaacgcaaaagcaagtggtccccccgccgcgccggaaaagtagagtaccggctactcgtgccctccgcgggctgtactcgtagattcggggaaagcccgcacgggtgcggggtggaaccgaagcttacgggggacgaagcgtggcagtacaaccggcggacggaaccatgcggacagaacgcccggggttcctgctggacctcatcacgggcgcagacactgacctgggtccggtgcagcggctggcggaggccggcgcgctggccctcgccgggtccgcggactgcgctgccctgctgatgcggccggccggcccgcccgtcattgccggcaacagcactgccgccgaggccctggccacctctgaggaccggaacggcgacggcccgctcacccatgccatgggcacggccgagctggtgaaggtggaccgcacaacgtcatccaggtggcaggcataccgacggcggctcgcggcttccggattcggcgcagcgctggctgttccgctggggctggaggaccgcacgtcctgcgcgctgctgttccttgtccgcggcaccaccgggctgaccccggacctggtggccgaggcccggtggttcgccgaagtggcttcccagagcatgaaactggcgctcgaggtgcgcagcgtccggtccgccggggacaacctgaagaccgtcctggagagccgcacctccatcgatgtggcgtgcggggtgatcatggcccagaacagctgcacctatgcggaggcgttcagcaagctggcgggggcgtcacgccagcggaacctgaaggtgcgcagcgttgccgagcacgtggtgaagtcactggccggctccccggcagcccggcaggatccgcctgccccggcgtagcctaccccgcaggctcgctgaccgttgagaacgtgtgggcccactgggtggtggccccggccgccagcgaatacttgggaagggcacgcgcggagactgtgaccgtgccggagcccggatactctccggccttgacgactgttccgtcccgcacgtattccacgcccttggaggatgggacggtgaagatgtccttcttggtgccgtccttgtccgtgaacttcaccgtcttgggcagcacaacgccggacggcaggtccgaattgctgaggtccagggcctctgcagcgtccaccagtccgtggccgcagccctcggggcagtcaacggccaagggccgggccgtggcttcgaggcgcttctccaccatttccggcgtgtaggcactgcccacctcggacatcagcagggcggcgatcccggcaacgtggggggcagccatggacgtgccttgcataaaggcgtaggcctcgggcccgggggtggtggagccgaagttggaggtggagaggatgccttgggcgtactggctggtgatgtcaccgcccggtgccgtcacgtccacgtcgtcgccgtagtttgagtaggacgcacgggcgccggtgggcccggaggcagccacagtgatcaccttcttgcagtttgccgggctcatgccggaggccgggcggttcgcgtttccggcggccaccaccacggcggccccggccttatgggcgaggttgatggcgttctgcagcgtgacggagcaggggccgtcaccgcccacgctgaggttgatcacgcgggcggggttggggttgaccggcaggccggccacctgcccgcccgcggcccagataatggaatctgccacgtccgactcgtagccgccgcaggcaccaagggcgcggaccggaagcagcctggcttcgggcgccactcccgcgacgccgtcgttgttgttggccaccgcggcgatcgtcccggccacgtgggtcccgtgccaggaggacatgccgctctcgccgccactgccgcacagttcgccggcgaaccagtccccctcgtcctgcgggttggcgtcacgcccgtcgccgtcccgagcgttgggggcgtcaacgatcatgtcgtagccgggcagcacacgggaattcagttcggagtggcttgtgattccggtgtccaccaccgccaccactgtcccctcgccgcggttcacttcccaggcgccggggacccggatgccggcggcgtcgtcccagaggttccactgcgccgggtacccgggatcattgggggcctcggcggtcgggtacatgatgatgtccggctcggcgtaggccacccccggggcggaacgcagtgctgccaggaaggcatcggcttcggcgccgggaaggggacggctggttttcaccacctgtgcgccagcggcagtgcctttgacgttttgggcggcgatgcccaccctgcccccggccatccgcgcagcctcggaggttgccgccgcttcagacccgatgccgggaccgccctggatccccacaatgaactggtctgtggcgggggacgcagcgggcgcagcccgcgccggggtgggccggatgttgtccagtccaccgtcagcccgggcaggaagggcaagggttgtgttcgccaggacagcagccacagcaagggcgacggcggtgcgggggttgaagcggtgggtcattggcgggcatccttcaaggacaggcgccaaccgctgggtgctggcgcgcggacagactcacccccgccccgattctagccacaagcaggagagggaagaaggggcagcggcgaatatcccggacccgcgggagctgaatcgcggtgagctgggccgatgtcgccggacgacgccggcagcacccgccatttccgcggctccgcgcgggtgccgtaaccttggagtgattcctgcttcgctggcggacacacacctgggagggttctgtccgggcaccagggcaggcatccgtttcccatcggtctcacataaggcgcagtcgtgaacactacttctccccaggggagcacccttggcccgctcgaggacctgggctggaccgctctctccgtcagcgtggccctggtcctgctgcccgcgatcggcctgaaagcactgggccagtccttcttcccgaagactcccaaagctgaagaacgccactacctgatccagtaatgccccgcaagcacgccagcagcaccaaacatcgtgtagtgctctccgccgcggcggccgcgctgctcgcccttgcgggctgcggtcccgcggcgatcccggccccggacaccaacggcactgccaccgccgcgagcccactgcccggctcccacgtgcacggcattgccgtcagcggcgaaaccagccaggtgctcctggccacccacgacggcctgttcgacgtcaccaccgccccggccaccaaaatcggcgccaccaacgacctcatggggttcactcccggcccctccgacggcgtcttctacgcctccggccaccccggcccgggctcggacctgcccaacccgctgggcctgctgaaaacgtccgacggcggcgaaacctgggagccgctctcacggcagggcgaatcagacttccacgcgctgaccgccacccaggcgggaatcgttgccttcgacggcgtactgcggaccagcccggacggcacggcctggaccaccgtcgccgcagacttcgccccggccgtcctcgccggccacccggacagcaccaccgtcctggccaccacccaggacgggatccagcgctcaacggacgccggcagcacctggacgccactggataacggcccggtgatccagttcgcggcatttgcccacccggcagaagccgtgggcgtggaaccggacggcaccgtccattactcggccgacgcgggcgaaacgtgggccgaaaagggccgcatcggcgccgacgtcctggcaatcgccgccctcaaaggcgaggacggccgcccctggatctgggccgccacagcggacggggtcatcgcgtccacggacggtggcatgacgttccggcccgcggacgcggattagcggactgcctccggctgcctgcctagtggcgcgccctgaaccggatcagtcccgccgccagcaggcccactccgccaagagaggccagcatcccgccaagggctgcaacgtattcggtgatggtcatcgtctccactccccttccctactgcctgggtgcccaaactatgcccggaggctcaggattgcgcgaaggatcgcccgcgtgtttggtcaagatctgtgcaggtccctgccacggacgccaggcgggaatgttcgacggcggcgcgccgccgtcgtacacctcacctggtgttcaccttccgttagccttcggctgataggcaggacgcgtggtctcctcccctccgtcccgcccgttctgtgaagccgtccacgcccacgctgggtgacctcggcttcgaggcgatggtcctgagcggcgacacgccctcgggagagatcgaggcgctgttccgggaggaccgcggactccgggccgtggtggttgaggtccggggaatccccaccctgctgacgcgggaccagcttgaccaccagatgaccgggcggctgggctacgggcgcgcgctgaacgcccgcgtgacggcggaggcgctggtgccctgcaccaccttcagcctgccgccgtccctggaccttcgggcggccgccgccgcgctgctggaccggcctgaggagaacaggtaccaggatgtgctcgttcttcccgaggcgggagcaccgcgcgttgtgcctgtctcgcaggttctggaggggctttccgatgtgttccggcatgccgcgctccatgacccgctgacaggcctggcgaacaggctgggcctggaagagtccggtcaagccctgctggccggcgccacgtccgcccggacggccgcgctctacgtggacctggatgatttcaagatcatcaacaacaccttcggacacagggcgggagacagtgtgctcaccgccttcgcggcacggctggaggcctgcaccaggccggcggacaggatcgcccggctgggtggggatgaattcgccgtgctgctggccgacgtcgatgaaaccggcgcccgcgcccgtgcggaacggatcctccacgtcctggacgagccgttcgtccatgacggacacctgctccaggtctccgccaccctggggctggcaatggccggcgatgttggggcaggtcatggcggggccggcgatgtcggggcaggtcatgtcggggccagcgggcaggaccccgggacacacctcgaggacctgctgcgccaggcggatgctgcgatgctgcaggccaaatacgaaggcaagcggaggctgggccgcatcgatccctccctgccggaaagccgctttgcacgccaggccctcatccgccgtcgcctgccacacgccgtcaacaccgcggcgttcagcctccactaccagccgctgatggacattcccacaggtgagtgccccgctgtggaggcgctgctgcgctgggaggaccctgaactgggcgccgtctcccccaccgagttcatccacgtggctgaacacaccggcatgatccacgcggtgggccagtgggtcatcgaccaggcctgcgcgcaggcccggctttgggcggacgccggcacgccgcgggctatatcggtcaatatttcgccgctgcagctggccgccggaaacctggccacggtcatccacggatccctgcaacggcacgggctgccgccctctttgctgaacatcgagatcacggagagcgccgccatcgtggacttttcgtccgcagcggcccagctgcgcacgctgatcggggccggtatcggggtggccctggacgactacgggacggcgtattcgtccctttcactgctcagggagcttcccctcaccgggctgaagctggacaagtccttcatcgacaccatcgattccgatcccacctcggcggtgctggtggccaacgtcatggcgtccgccagggccctgggccttcgaaccacggcggagggcgtggaacgggaaacacagctggaggtcctgcgcgagctgggctgcgataccgcccagggctacctcatcgcgcggccgctgcctccggctgagctggatgtgctcagctggcggcgagtgccgtgatggcggcggccgtgctctccgctgagctgtgctggacgatgtgtggctttcccggtatttcgaggtagcgcccgtccagggcggtggctgcgagtatcccgcaccaggaccgggaggccacgggatccttggagccgcggagcactaggaccggctgtgccaccagggccaggcttccctcgaggtcgtaggacatcatgacgggaagttcggtgaggtaccagcgcattccggagcggacgtagtccgtgagcacgatggcattgcccaccgggctttccctcaacgaatcaaggcccagagccagggattgctggcggacggtccggcgtgccgagtccaccaccgggcccaggagcaccacgtgggacaccatgtccgggtgccggaccgcgagttccgtggcgaactgcgcacccatggagtgccccaccaccaccacccggccggcgcccattttctgcagcgttgccgcgatgacatcggcgtagtcggagatgctgagctgccggtccgggcgcggagtggcaccgaatccgggcaggtcgatcgaatgagtgtccccgtgcccggccaggacaatctggagcctgcggaagtagcggtgggacatcccgatgccgtgaagcagcacgtacacaggaccgccttccggcggccccgcaagggagtgcacatgcgaggtcagggaccccgtggtgacaaccctcggcgtcagcggctggcgcatccaggccagcggcccgcgggattgcgttccacgggaccgccgtccatgggacagcgggccgcgggaccggggttcggcggacagcggcggttcgggggtgtcccgttggccggcactctgcagttggctggcgtcctgcagttggccggcactctgcggttccgtggcgctcttcggttcggagtcgttgtgctgttggttggtctcggtgtgcaccgatcttcccttcattgggggccgtgtgggcgggtacaaccgggagggaagggctgcaacgtggtccagggtggtttccaggacccgcgagacgctgcactgcgagcagtggacggccacggcgatcgagcctgcctgtttgccggtaatgccggggaactcgaccatcaggtgcaggtccgtatcgcagtttgcgcaccaggggcgctttccgcgcggctggtggacctcccggggcacgtacgtcgtggtggcggtgagtgcggtcaaggcgtcagaccgcggcctgcggggcggcgttccaggggaactgggaggcgtgtgctgctgccatgatggctcttctcaacgaggtgcaaacaaaaaggggaacgggatgatcgtgcgcagcaccggcagggtgccgcgccaacgtcccgggatggtgcgagcggccgtggcggccatgcaaactctgatccctcttctgaaaccatgttgatacattctctacgctgtagactttatgcgtagactggatgataagcaagctgaggaaccgtccgcccagggaccgcccggcgcccaacaggaggaatttttcatggccgacagtgccggcagtcaatcaggttcccggaaggcgcccctgagcagggaacttgtcctctcaacggcacttgccttggtggacgccgaaggattggatgccctgaccatgcggcgcctgggacaggagctggaccgggatccgatgagcctgtaccgctacgcggccaaccgcgcggccctgctggacggcgtttccgaactggtcctggacgaactggcgatcttccccgacgatccggactggcaggcccagctgcgcaaaatcgcccatgacctgcggctcctggcactgcggcatcccaacgtggtgcccctgcttgtcacgcgcccgctctccactcccctgggactgcgcccactgggaacgctccgcccgctggagcagatccttgccctgctgatcgaggcaggcttctcgccggccgcggccctgcacgtttaccgcgcctactacggattcctctgtggccacatcctgaacgaactccaggaatacattgtggacccggaggagaatgaagcaattctccgccttggcctgcaccgcttgcccgcgaaaagcttcccgcacctccgcgcgctcggcccggtcctggccgattacgacggcgccgccgagctggaccaggggctcgccatcctgctctccgggctggccggccagctctccatcgggcaaagggaaagcccctcctaagaggggccttcaacgtagtggtcaattgtctttcggtctaggtcagcggtgatgcactcccccttcccggacgccccctggcgcccatccggactatgacaagaactgactttagtaacttgattccgtcaagtaaaggggttcgggctaagtaatttcgtcccgcctcagcactggtcctgtcacccctggtcaccggcgggtgcgcggccggctgccaccggttcacgcccgcgccccgcggtgctttcgggagaagaaggctcgacggcgggctccagccttgcgttggcccaccggcggacgggcgtttccaccaggcggtgggacacacaggccagcagcaccgtcagggccgcggccagcgccacccggagccacagcgaggggacgagcggcatcagcagcaggtagaccggcaggtgccagaggtagatcgcgtaggacaggtcgcggcccggcccggcaagccacgggtggctgaggatacggcccgcaaaaccggccggctgcaggacgagcgatccgatgaacactgcggagagcagggacagcaccgtgggtccggctgtccagaaggcgctgaaccacaggccgggagtatccggttccttcagcaggaagacggcggccaggagggcggtgccggcaagcggtccggcccagcgcgcggcattccggagggatacgtgggaccgggatccgggggtgacggtggtgaagacgagggccagggtgcacccgatcagcagttcgtcggcccgggtgtccggaccgttgtagaggcggttcagcggggccccgagcatcaccaggaggaaccgttccagcaggaatgccgcagcgagcccggcggtgatccaggccaccgtgcggaccgtccagaagcgcagcagcaccagcaggagcaggggccacaccaggtagaactgctcctccaccgccagggtccaggcggggccaagggtttcgcctgggatggactcgcccaacaccccgatccgcgccaggttcatcacgtagccggcggccggtaggacaaaaccttcctggccggcccacttggacgcggggaaaaccacgcccaccgtgacgatcacgccgcacagcgccagcagcgcgggccacagcctggccagccgcttggcgtagaagacccccagccgcagccggcccgtggccaggtactccttcatgatcaggagggtgatcacgaagccgctgagggtaaagaagacgtccacgccgatcaatccgcccgggaccagttcggtgacggcatggaagaggaagacccccgccacggcgagagtccggagcccgtccagggcgtgcttccgtccggagatgagcccgctgccgggcacggccgtacgttccgcggctgacaatattccactgcttgacctaaaaaccactcatcaagcatatataacgtttcggtaactgcgctgggtggaggctgggcgtaagctccacgcacccaacgcaaaggcgtacgacggcggcacgtgccgccgtcgtacgcctcacttatcgggtggcagggtcagctaccggttgacgtactcgccgtcgcaggctgcctcctcggcggcgctgccgaggacgtacagctcgttgttgtccccggggacgccctggtggacaagcacgtgcagcggatgcgtcctgccatctgtttgcgggatgtccgcggcgtgcgggttgtgatcgaagacggcgccgggaagttccacctcttcctcccctgcgccctcagccattaccacgcagccgccgttgcccacgatcttgacgtgggtgtggtctgctgctgccgggccggaggcagccagcagcagcagtgctgacgcggcagaggcggcggcggctttgcccaaagcttttgtggttttcatgactggccctttcgatggtgtcaacgggaatatcatcgtggccagaagagcacgtgcagtcaatgggcagccacagcatcagccgaggtcagcgcctcccggacctccgccacccgccacgttagcggcgggtggcgcgttccacgatctcgtgggcgattgcgtagaccttcctgtttatctcctggctttgctggctcatcagttcgtaagccctgtctgcggttatacccagacgccccatcaggactcctttggcctgttcgatgacggcccggttgagagccgaggcggccacggcctcggtggcaagctggtggcggtccgaatggattgactgggtgaggtcaaccaccacgccccacacgcccacaggaacaccaccctcaaggatgtagtccgcagagtaaagcaatttgtgctgacggtccttgcggtcgcggatggacacgtaaatggacgacgggcctccaaccgatgacacacggtcccagtacgcctggaccacaggccggtctgcgggctcaatgtgggctagagccatatccatggaagggactacatcgccgggttcgtacccatagatgcggtacaacccttccgaccagtggaagacgccttcttcgaagtagaactcgacaagtcctgtggggcagtcgagaaagtcgccatgtggaaattttgctgacgaaagtgccggggagttgttgctggatgtcactgaggggccgttcggtgtgctctgtcctggcttcccccagcccggattctttaaggatgagaacatactaagcgagggaacacgccgcccggcatccctggacagcggcggcgggcgggcgccgcgccggagctgctcagcgcgtcagcacgaaggcggccaccgccaggacaagcaggataacgacgcccaggacggcgagctgccggcggctgcctttcgcgggtcccggccctcttctgcggccgcgctttcggttaactccatctgccatgcgccgactctacggagcctcctccgcaggcacccgcgtatcgcctacctgtcccccgagagtccactactggctttcgcaggacgccaccgccggcaaggacgcctgcggatacccgcagattttcggctaccggttccgctcgatggcccgcgttcgtatgattcatccatgcacgtccggctcagcaacgtgcaggtggtagccagttctccttcccggcaggaacggtgatgatgctcaaaaagaccgaaatccaggcgctcacggacgtggtggaccggctcgccgcgcacttccccggtgagccgcgctccgtcatcgaggacgttgttgcccacgaacacagccttcttgatgaaggccgcgtccgggactacatccccatcctggttgaacgcgccgcgaagctccggctggcccgccagcaactcttcgtccccggccaggtcgaggcggtaacggcgcagtaacgcgcgtctggtgaactcgttcctgtgttccctcgcatgtgaggacggggttatggaacaggggtggagttccctccgggtggcgggcctggcgctggacgttcccagcgcgctggccccctcggctgagcgcggcatcgagggcagcgccgctgtcctggagggtgccggcatgcgcctgaccgttgatgcgagcctcttcgccgatcccctcacccgctatgcagccaagcccggctatgaacactggcgggaagccgtgggcagcctcatcgctgacttcgtcgtgttcgaggaaggcggcacccgcaccgttgccgccaccatccccggccgcgccaccgccgtcgtccatctgcccgccggcgcccaacgggacgtcgccctgcagatcctgcgaagcatcagaactgatcaaggagaatccaatgcctgaagagcagtaccgtggggccccgtacctcgccgccgtcgaaaacacctcccccggcgagcgccatgccggtttcagcaaggtgcagacgtacctcgagcggttcggctacctggggccggccacccccagggaactcggcgtcttggacgaccccaccgaaggggccctccggagtttccaggagttcttccaccttccggtcacgggcgttttcgacgacgccacccgcgaagccatgatgcggccacgctgcgggcttccggacgtgcggccaggcgaactcgccttcgccaccacgtgcgcatgggcggaccggacgttgacgtacgcctttgacaccggcacggccgacgtcgccggcaacgccgagttcgacgccatccggcaggccatccagacctggcaggccgtgggcggactgaccttcaccgaggtggccgtgggctccagcccggacatccgcatcggctggcgtccggccgcggacccggaccattccatggtgggcggcgtcctggcccacgccgatttcccgccgggctgcagcgtcatcaccaccacgctgcccaagccggtccacttcgatgacagcgagcacgtgtggagcgtcggcgccgtggccagcgccttcgacatcgagacggtggcactgcacgagttcggccacatcgtggggctggcgcacaccagtgtggcgaacgccgtgatggcccctaccgtgtccgccaacttcaccaaacgtgccctcacccaggacgacattgacggtttccgggccctgtacccggcggcccccgccgcatggtccggctggaactccctgggcggcatcatcacctcggacgtgaccgtggccaacaacaaggacggccggatggaagccttcgcccggggaaccgacggcgccgtgtggcaccgctggcagactacccccagcggcgactggtccggctggaactccctgggcggggtgatcacctccgagatcgctgagggcaacaaccaggacggacggctggagatcttcgcccggggtacggacaacgccctctggcaccgctggcagaccacccccaacggcaactgggcgggctggaactccctgggcggcggcatcaccgggcccgcagcggtgggacgcaatgcggacggccggcttgaagttttcgccaggggcaacgacggcgccgtgtggcactgctggcagaccgcgccgaacggcaactgggccggctggcgctccctgggcggggtgatcacctccgagatcgcggtgggcaggaacgcggacggccggctggagatcttcgccaggggcacggacaacgccctctggcacaaatggcagacagcacccaacggcagctggtcagactggcgctccctgggcggcatcctcacctccaacatcaccaccggcagcaacgccgacggccgcctggaggtctttgtccgcggcacggacaacgccctgtggcacaaatggcagacagctccgaacagcggctggtctgactggcgttccctgggcgggctcctcacctctgacatcgcggcgggcaggaacgcgagcggccgcctcgaggtcttcgtccgcggcaccgacaacgccctctggcacaaatggcagaccgcaccgaacagcggctggtccgactggcactccctgggcggcatcctcacgtccaacatcgccgtgggcaccaatgccgacggccggctggaagtgttcgtccgcggcacggacaacgccctctggcacaaatggcagaccaggccgttcctgaccgaggagtccacgggggcgtccggtgccgctgccatgaccggggagggtggcggggacgccgccggtgccctcgaacaaacggtcgctatgccggccggcgccatggaggagagcgtcagcactaacggccatcagcagccggcgggcatgccgggtggcaggatggacggcgcctccaaggacggcgccgccaaggagtccgcgggcagccgcggcacggacgtcaaggaaccggagaagatgccggcgggcagcatgagtacctgaccagctacaggacggaagcgaacgacggcggagcgcggccgccgtcgtccgtcaccagccagccccggcaccaaggcgaagccggggcactggcacctacaaaggggaactacccgtcgaaccgcgcactggtgctgccgtgcggcaccaccacgtgcacggcgttgcgctcgatggtgaagtcggcgggcgtgacggtggcgatctcgccgtcgagattcaccggcatgggcggctcggtgaccagccggacgcgctggcaggtcaggtggtacacgccgtcgcgctccacgaagctgccgttcttgagcatccgggcgatcctgatgtgctcccggagcggcgcccccgggatggcatagacgtccagcaggtggtcgtcgatgcctgccgtgggcgagaccgcgttgccgccgccgtagtgccggccgttgccaacagccacctgcagcaggttgtccagctccagcgtttcgtggtccccgtccgggaactcgaggcgggcccggaacggctggtgccgggcataggcgcgcacggcggcgacggcgtaggccaccggcccgaggtaccgcttcaggcgggggctgagggtttcggtgacacccaccgagaggccaacggaggcaacgttcaggaacggctgcccgttcacgcgccccatgtcgatgtccaccaccttcccgccggccagggcagcgcacgccccggcgaggtcggccgggatctccagggtgcgggcaaggtcgttggccgtccccagcggaaggactcccagcacgattcctgtcccggcgagccggccggcggcaaaggacaccgtcccgtcaccgccgccaacaaccacaaggtcgtgcccctcggcaaccaccccgtccagggtcccggcgagctcggcgccggacagcacctggtgcacggctgagatgggcaggcctgcacttcgcagggtgtccaccgccagcgccggccccgccgatcccaggcgcgccccggcgttgatcaccacggcagcggacttcgcctcttgggcaagcatcatggggaacatcctaggccgggcgggttgggaaagccctgagtggtcccctcagcacgtgcggggcggaaggtgcgctgcgcgaaacgggaggcgtacgacggcggcgcgcggccgccgtcgtagtggtcacctgtggtgccccgcggtcaggaacggttggtgtagacgtcggtgctgaagcggttcagccccggggcggcggcgtagccgaggtagggcagcccgaagatgtcctcgatgcttcccagcaggctgtagtggttgtaggcccgctgtgatgttgtgccgcctttgatgtgaggggacaggaccagcgcccccacgcggccgccgccggccccacccggcagggaggaggctgcgctttccttgcctttggcttcgtcgaaggtgatgaccaggattccgtccttcttgaacgccgcggaggcaaggatgtccggaacgtgcttcttgagccatgcgtcggcccggggcaggccgcctttggagccgtcgtggcagggatcgtcatggccgtcgttgcacaggtcggggctgatgtaggacaggttgggcgtggtgtccagggaggtgaggtcaccggccaggctgctgaaatccaccacgttctcctggcattcgggcgaggacgtgatggctgtgaagtacacaaacggattgtggcgggtggcgtactgggtctcggagctggcgttctggttggggtccttcgcgccgatctccgggtgccggcacggtgttcccatgtcctccatgtagcccttccaggacttccctgccgcgctgagctggccggccagggtgggcaccgaatcggggtagacgcagccgctgccctggacctggccggggccggccgtcccggtgacggtgacggtgacgtacgtgtggcagtcgctgctggtcaccgggttggggccctgcccggagagctgcgcgatgtagttgggcagcgatgcgtggccgattgcgtagtactccgtcagcagcaccccctggtcccgcagggtcttggagaggtacggcgccggggagtcggcgccccacaccttggcgtacgacttgttctcgaggttgatcacgaacacgtgcccgagttttccgtccgcgatcccggaggccggcgggccgggcgccgggcttggattggcctggcacgcgacaaggacagccgccgtgatgcaggccagcacaattggcccgcggcggcgcttgcctgtgcgggaccgtttccggggattgtcagccgccatcaattcctgcctcccgggaggacggccgcagtaccgtccacctgagggttatcctgccactccggcgctgccaaaagatgggcacaaagccccgctccggcctaccctgccagggcgaaggcggcaatgaccaggccaatcaccaggacaacgttgaggatcacgtacggttggattccgcgcttgggtcccgtgtccatcctgcggcgcccgtgctttcgggtgactacatctgccatgcaatcgaacctatgcagccgcgggagccggggcccgagtaatcgctactcgttttactaattgccaccactggggtgcgcggtccagcgggggcagcggcgttcattgcttccggctgcccgggttcctatggtgttcccatggacttcaaccaagttcaaagcgattacgatcagctccagggcctcgtggcacagtttgaggacctcaggagctttctgaacggtttgaccgtcctcgggtccgaggtgatgactgaagcggcgggggcaaacgttgaatgtgcggtcacattgctcaggcaaaaacgcccggtcacgattgcaggcagcagcgaggttgctgttcgcctggacgagattgagcaggctgttggcggcgggccctgtattgaggctttaaggatcggcaggccggtgctgctggcggacgtgtctaccgactcccgctggcccaagtacagcaaggcgctggctgcggccggatgcggcagctgcctcggcgttccgcttgaccccggagaaaacgcggcggcggcgctgaatctctttgcctcccctgccggtccgctcacagagccgatgatcgccagggccacagccttcgctgaatcggcgggccacgcgatggctctggcggtcaggatggcggccaaggacgaactcaccaaggacctgcgggctgccatggaaaagcggactgtcattgacctggccgcgggcatcatcatgggacaaaaccggtgcacacaggatgaggccatgaagatcctgatggcggtgtccagcaaccgcaaccagaaactggccgcggttgccgaggaagtggtgtcaggcgtctcagggagccgcgacgtgcggacccatttcgatgactaagcggtgctcccccgcctactgctcccggcgggtctcctgcagccgcttgatgaaccagcgggactgctccggcccgtaaggcaggacggggatggccttcgtggcgtcgtccggggtgtcccggatggactggcgtgcctggcggaccgcggtgctcagggtgttggccatggtcttgacgaactggtcgctgcagggcttgccatgcccggggatcaggaattcgtaccggtggcgcagcgctgagatgtgccggagcgcatccgcccactcctccgggtaggagtcctcgaaggacgggtgggcgccctgctccacgaggtcgcccacgaacagcgtggtgggggtgcccaccaccaggtcaccgtccgtgtggccgcggcccaggtagaacaaggtggcggtcagcccgcccaggtccaccagcaccggctggtctttgacgatggcgttggggaccacgagttccacgttctggccctcgccggtggacatttccggctccagcgtccccacgaagcggcgctgcaggtccccgcgctcctcgatttcggtggcgcagttctggtgcgcccagaactccgtgacgccggcttcggcgaacaccgcattgccgaagaagtggtcgtaatgggcatgggtgttcaccaccacgagcggcagctgggtcttttcacgcacggcgtccaggatttcccgcccctgccgggggccgcagccggtatcgatcaccatggcccgttcggaccccaccaccagtccggtgttgagcagcgatccttcggtgaccagcacatagttgtccgcgccgacttcgagccattcctgcattgtttctccgtacctccggcaaaagcagtcttcgttcgtctaggggtcgattgtacccagcggcccttgtggtttccgggaggcggcccgcgggcaggtgcttcggattccccaggcacgcgcctgacggaagaagtacgacggcggcgcgcggccgccgtcgtacttcttccgggcaaggacggctgaggttcggctagggcgtcttgggccgaagcgcaaccagccagccggcccattcccgggcggagctgaaagtccacgccttcgccccgcttgatcccgcggcggccaggatgccgtcggcaacctcgaagcggcgcgcgccggtctccgcggcctgggacatcccggcgggcgaggtgagggtgaccgagctggagttgacgctcatgcatcccacgagcatcgcgttcggggtggtgctggtgactgccgggacggttcccgaggttgcggatgcgccggccgcggaggtggcggcggtgtcaagccctgcggcgccggaatacctcacgatgctccccccgctcgtcgtcgacgttgtggtccaggcatagctcgccggctcggtcgccgttgccaccttgtagtagccgtagactttcgggtttgcgatgctggtcaccgcagccagccgtgtccagccggcaggggcgcctgtggtgccgatgctgccgccgttcagggaaaggcagctgaccaggagatccccctgggccacgctggccggtttggggacggtgagcgtggtgctcgctgtggtgttcgaggcttgactgaccgactcgcggacgatgcggctgccgcccgtgtcgccggagccgacggtccaggtctgcgtcgctgccgtcgcgtcggtgttcccggcggcgtcggtggcccagacattgaaggtgtgggatccaactgccagcccggtgtacgcctggggcgaggtgcacgccgcgcgcgccgcagcatccaggctgcactggaacgtcgaattggcttcactcgaggtgaaggcgaaggaggcgctggttgacgtcgttgtggcaggtggcccggacgtgatggtggtttccgggggtgtggtgtcccccggagtcgtgcccaccgtccacgtatagctggcgggggtcgggtcaacgccgttctggtctgaggcacggacctggaaggtatgcgagccggtggacaggcccgtgtaggacaccggactggtgcagctggtgaatgctgccgagtcgagcgagcaggcgaaggttgcgccggccggcgtcgaagtgaagctgaactgggccgacgtggaggtcgtcgggttggccggctggctggtgatcgtggtgtccggtgcagtgggagtgggagtgggcgtcccggccccgatcttgcgggggtcgtaggcggcatcgaccagcaaagccggtgagtacgcgccggcgatcgactgccatggcaccgccttgaagttctggttcccggtgtcgttggcgtggtcctgcgtgacgaagaagccctgggggaaggggccgccgacgccgaagttcgtgacgtctatcccgtccatgccggtcacggcatcaattccgtttccggccgggatggcgaaggctccgagtggccggttgtcgtcacgggcatagacgtggaatcggttggagccctggctggccgccagcaggtagcctgcgccgccgctgccgtagtagatgctgatgcccttgatgtcctggacaatgtcgccgccgttttcgatggtgctgacaaccttcgtcccggtggtcgggtccccgggttcagcaccgaagcgccagattccgccgatgtcctcctgcgcaatgtagatccgcttcatctcatcatcagccaccaggccctcggtgtgggtcggaccgctcaccgtccagctgcgcacaagtttgccggtgactgacccggtggagccatcgagttcccactgctccaccttgccgatgtcggtgacgaaggcgaagtacttgccggtgtccggtgagtggtagaaggagaacccgcggggtgttgagatgttggcggtgggggcgaagctgccggcctttgtcagggagcgatccgactcgttgaccttgtagaaatcaaggctccgggcccggttcgagacgccgaccaagcccaccttgctgctgccgagggggaagttgtagcggacatcaacattgttcatgcgtccgtccccgtagtagaacagctcctttccggacaggtcgtagaccacaagaccgtgcccgcccgtgctcttgtctgtgccgatgatggtgcttttcgacgggtcggtgggatggatccagatggccgggtcatccgcggcgtcccctgatccgtgcatcggggccgtttccaccgtcgcgggcacctgcgccacggccgcattcgcgctcggagcggtgagccccacaagcagtacagccaccgtcagaacggcagcaaacctcgatatgaacgtcacctttggcctccaaagcttgatgccgccagtacggcgggtggttggaacgtagccccgccggttccagcttgtgaagcgatacctaagaaccagggggcatccatacgaaagtagggggcactgcggggtggtttggtgcaggaatgcgggtcatagggtgctggggtgccccagggctacttccgtgcccagatggctacccagtcaacgtaaacgtggccgctggtttcggggagcggacagccagtcaggcaggactccgtctgcaggaggtagcgcatgggcttgttcgggaccaacgatgtggcaacgccgatggacttgccatcaaggaagaattcgatgcgcccgggactccactcggtggtggcggtgtgccatgacgtaaacggaacgttggggcggaagacttcgtccacatgcgttccgcttgggtcgaggccatgcacggcagcgtagatgacccgcgaaaggtccccttccggaaaatcgatttccccatcctccggccactgtttactgacgggccacagcagccaggccagtttgaagcccggcagggagtcggctttgaagcgcaccgagtagcgcccgtacacctggctgttgtacggccactccttgaaccccgcaaatttgggagacggggccgcgcccatcgatacgccattttccgtgtgcagatacatgtccaggacgccgtcatgaacactcaagaccttcgatggatagtatccggacggggcctgaccttttgggaaggttttgccgtgggtgtccggagtgccgtccttgtagccctcgctccaccgcgtgccgtagatgggccccgggaatccgccaagtggggtatcgccgtcagtaaagtcctcggcaaagacctgcttccaacccggcagatcgcccactggcatggcctctgaggctggagctgcgatggggtctgcggcagcgctgggcatggcgcatccaagaaccggcaaaaccagcatcaagacaagcacctgcgccagcgaatgcttccggatcgtcgccaaaggtgtcactccgtccagaaggagttgttgcgtttcacactacgagcggagcagcagcacagtcgtgagtaccgggtactcgactttccgttactccctacctccatggaacagctcccgggctccgaacggtcaccaaggtcgcgccgcccgggatcagaaggagcacgacggcgggcgcgcggccgccgtcgtcctcctcacctcccgctcccccagggtgagcttttcccgatgagggcgacgtgcatcctcgccctcgacgcgcaaagacgatgacgcgggcccatatacaggtagcgtcgccgtctttgcgtgtcaggaaaactcatgcgcgtcgaaaacgactgcgagaggattcgggttgaactcgcatcgagtgatagagggtttcaggtagaccaacatcaagtgatagagggtctcaggaaaacccacatcaagtgatagagggtcggttgggggtgggattagaggtcggctaggagggactttgggttttctattgcgtcggctacgaagcggaggaagccggctgctgtgccgccgtcgcagacccggtggtcgaaggtgagggtgagttcggtgaccttgcggacggccagctctccgttcaccacccacggcttgtcgatgatccggcccacgcccaggatggccacctcggggtggttgatgattgccgcggacccgtccacgccgaacacgccgtagttgttgagcgtaaacgtgccgctgccgagttccgtgggggtcgccttgccctggcgtgcgacgtcggtgagccggcggatctcggcatccagttcgcgggcggacagcttttcggcggcgcggacggacgggaccaccaggccgcggtcggtctgggcggcgatgccgaggttgaccccgtcaaacgagacaatctcctgcgagccgtcctccgcggtttcgatgcgcgtgttcagctccgggtgcttttttagcccggctgtgacaaaacgggcgatgaacgcgagcaggccgggcacctggtcactgccggacttgagcccctcacgcagctccatcagcccggtagcgtccacatccacccagacggtcgcctccggaatctccgagcggctgcgggccatgttggtggccacggccttgcggacgcccttgaccggggtccgggacgagatgggcaggccggtccgggcgtcggtgccctgggtttcggcaggcttggctgcggcaggctcaagcaccgggcttgcggcaggctggggttcggcgggcttggttttgacaggctcagctaccggggtgctgatggctgcttccacgtcgcggcgcatgatcaggccgccctcgccggagccggggagttcgccgaggtccacgccgtgctcccgggccatgcgccggaccagcggggagattaccgcgccaagcttgcccgggaccctggtgcgcaggagcgaaaggtccacgtcggcattttccgccgcgccgccgtcggccgccccgtcctccagcggaagggtgctgaccgacccggagccggaagccgcaggcgccttccgcgcgcgggtgcgccgggcaacgccgtggccgcccggggttccgtacccaatgagcacgttgccggacccggccttctcctcttcccggtacgcctccgcttcggcctgggcgggggtatcggccggctcgtccaaggcttcgcccagttcggtttcggcaggctcggtctccggctcagcgggggcggcagcatccgcggcaggcccgccaacagaaacaggcgtcaccgaaatgagcggcttccccacatccagggtctcccccggctgcccgtgcagctcggccacgatcccggcatagggagacggtacctccacggtggacttggcggtctccacctcggcgatgggctggtccacggcaatcgtgtcccccacggcaacgtgccaggacaccagctcggcttcggtgaggccttcgcccaggtccggcaacaaaaacacgcgtgtttcactcatggtcagttctcccactgaaggtcgtcaacggcgtcgaggatgcggtccacgccgggcaggtagtacttctcaagcttgggcgccggataggggatgtcgaacccggtgacgcggcggatgggggcggccaggtggtggaagcagcgctcctgcacccgggccacgatctcggaggacacggacgcgaagccgtgggcttcggcaatcaccacggcccggccggtcttccgcacggactcgcacactgcctcgtcgtcgaacggcacaatggtgcgcacgtcgatgacttccagcgagcgcccttccagcgcggcagcctccgcggcggcgagcgcggtggggacggacgggccgtaggcgatcagcgtggcgtcggtgccggggcgggcgacggcggcacgcccctcagaggattcccccgccgaagcagcggcagagtgggcggaccgcaactccaaaaggtccaccaggtccttggaccagtagagcttcttgggctccatgaagatgacaggatcgtccgagtcgatggcttcgcggagcatccggtacccgtccgccacggtggccggggtgaacaccttcaggccggcggtgtgggcgtagtaggactcggaggagtcgcagtggtgctccactcccccgatgccgccgccgtagggaacgcggatgaccatgggcagcttcacggcgcccttggtgcggttgtgcatcttggccacgtggctgacgatctgctcgaacgccgggtaggcgaacgcgtcaaactgcatctcgatcaccgggcgcatcccgttgatggccatgcccacggccatgcccacaatgccggactcggccagcggggtgtcgaagcagcgctgctccccgaacgtggcggtgagcccgtcggtgatgcggaacaccccgcccaagagccccacgtcctcgccgaacaccaggacggaggaatcggcgtgcatcgcgtcggccaacgcagtattcaacgccttggccatggtgaccggctgcgggccggacgcttccgcggtggccgcggccgaagcggccgcccgcgcagttgccgcagaaacgttgccgttggcctcggaggagttggtgacggtggggctcacttgccggcctcctgtgatgatgctgcgtcgcgggcgagttcgtcggcgagcagggcggactgttccttcagctgcggcgtggtcttttcgaagacgtggcggaagagttcctgcgggtccacgggcacgtcctcgctgagcccgtcgcgcagctgcgtggcaaccgcttccgccttctcgcggatccgcgcctcgccgtcgtcgtccagcaggccgcgctccgtgaggtaggtgcgcatccggttcaccgggtccttggctcgccactccgcaacctcggagctttcccggtagcgggtgtcgtcgtcggcattggtgtgggcctgcatgcggtaggtgttggcttccaccagcagggggccggagccttccctggcgagtttcacggcccggtccaggacggcgaggagggccaccacgtcgttgccgtccacgcgttcgccggccatgccgtagcccacggccttgtgcgcgagcgacggcgccacggactggtgcgccagcggcacggagatggcgtacttgttgttctggacgaagaagatgacgggcaggtggaagacggcggcgaagttcagggcctcgtggaagtcgccttcgctggtggcgccgtcgccgcacatggccagcaccacggtgtcctccccgcggagcttggcggcgtgggcaacgcccacggcgtggagcagctgggtggtcagcggggtgcactggatgcccaccttgtgctggaggggatcgaacccgctgtgccagtcgccgcggaagatggtcatcacctgcacggggtccacgccgcgggtcatcacggcgacggcgtcgcggtaggtggggaacatccagtcgccttcggagaggcacagggcggcggccacctggcaggcttcctgcccgtggctggaggggtacacggccatgcggccctgccggaccagggcggagttctggtcattgacgcggcgtccgacgacgagctgctcgtaggcggccagcagttcgtcatcgccgggcagggggtattcgtggccgggttcggtgccctgctcaccctgcggcttgagccggccgtccgggtccaccatctcgatctggtgccgggcggggagcatgtagtcctcggccgtgatgccgaacttcttggcggcctcagtgagggcgtcctcggcgggtgcctggctggcttggtccgggtgcgcggtgtggtctgcggagatcgtcattgttccgtccttctgttgccactattccttcccagtatcgtcctgtggccggtttcgtatccaccatctgaccgaatcgtggagaagctgcacattttccgcacttcccggagacgaattgcaagtgtgagccagattactgacacggtgcgtggacatattggctggcaggatgccgggacggagagccaagggctcatcctgaggaccctctccggcgttgcgggtaggtgccgaaagacccttgacctctcctttgcgtggggaccacactcggaggacgcgcagggcgcagacgggacaaggcagtccttccgcgtcccagccacagcgggcaccgcggttttatacacagcagaatttcaaaggtgggggcgtctgtaatgaacattgagaccttgtgggaccggcttgagcctggaacgcggcaatggctggtggacaaccccgggtgcaggatccttcctcggaccgtggtggcagccatcgcaaaggccacgggggaagagctggagcaggacaggcacggtgaaactgtcctctcccccagcgactgcgagttcatccgcacggcctctcgccttcaggacgccaacagccacacgtccccgtaacctcggttgtggcggaatttcgtatccgtcataccgtggaacggcactaatgctgcgcggttctgcctacactggaagacgaattgtagtgtgaggcagattactgacgggggccgtgggcactgtggcagccaaggatgccgggacggaacccgtcccgctggacgagatcgaccgcaggatcattgcggagctgacccgggacggccggatgtccgtgacgcaggtggcggagaacgtccatatctcccgggcgcatgcctatacccggatcgcccggctcacgggcgagggcgtgctatccaggttcacggcgctggtggacccgatcaaggccgggctgcgctcctccgcctacgtgaccctgaagctgaagcaggacgcctggagggaactccgcgaccagctgggcgccatcccggaggtacaccacgttgcgctggtgggcggcgacttcgacgtgatcctgttggtccgcgccgtggacaacatcgacctgcggcgggtgatcttcgaccagctgcagtccatgccgggcgtgctggacacccagacgttcctggtgttcgaggatttggatacgcggtaggtcagctcctgaaccagccaacgaacctagtgatctatcagggatctagctctcaacccaattgcgcccatccgtaaacagatggggcgaattggctgtcatttcggctctaaggctactccgcgagattgagtgcgtacctcattccggaccaagtgaggcggaaaggcggctgttgcatggcttccgtcggggtgaaccggagtagcgccaataaggacgggcagtcgccggactgggtacagaaccactcttgagtgtccgcaaacgccatcgcctccttaccgatttcggttagcgcagttcttgagtgctacacctccaggtggaggatccaggaggccggttcgtttcacggcaccagacagggctttgagtgtctccgaatagctttccccactctataaggaactccgccccttcagcagcgctagcctgagtagggctctgcctcagtgctgcaaaaaagagatttgctcagcggaattgcgaaaataatttcggctgagaaaaatccggaaccgcagaagtccggagaacgctaccgcccagacccgttacaaaagaagaacgccctgaccgagcgtcaacccatcactactctggcgccaataaagggagccgggcagctgctgtatcgttgtcgaggaccgcttggggacgaagcacgaggacatgccgcatgaagctcaacactcacagtgccggcaccaccaagaatggggccgctgctggcattgcgctgctggcaacctcgatcattgcagtagctgcatcgttcgtcgaccttcgtttcggctttgcaatattcggcgtgctcgcagtcatcgcccttatccgaatgctcgacctcggacaattcgttccccggacctatatcggctggctatacgctgccgtaatctttttgacttgctgggcgccgtcgcttggttctaccgggaccgtcgccaggttcagtttggcgggcttgatcgtggtggcattgatccacagctcgcggtccccgtcgcttcctcttcaacgaacgcttcgaataggtttagcgctactacttctttctctcctgattagtgcaatgggcgcagcgtcagcaggttacggcatggcgagactccttaactggattatgtttgtaccactgctatttctcgccctcagaaggcctgacatcaaaggagccggcttcggtattgtcgccacgagcgccttccagatgatcggtgtggccctgcaagccgccggactgatgggaggcatgtggggaggccttcttacctccggcacgacttataatcccgaaaccagctcctggctcagaaggtacaccggcttcatccttaatccgaacaaccttgcgcttgtgctagccctggccgtcgtagtcttggccgcggtcatgctcgggaaggctacccgccgcgcaagaatcgggtgtctgacgctcattgcgatattcgtagttggcatcgtggtaactgggtcgcgaggcggactggtggcagttgccctggggctctttgtccttttggctgccgccggcaggcgcggctttgcgttaggcgttgtagcggtcggcttggccgcagcggcatacaccatggccgggtcccgagagttggatcgcgtaatcgagtccttcgcggagattgtctccggaactgacgccagtgccgcgcagagaagtggtgtatggcttacacgcttcgattccgcggacggtaaatggctcttgggtagtggttttggtggctatgccccccacatcttcgcgcagcagcagggcctagacatcaaccccaagctcgccgcgttggcaactgtggataatgcctggctgaagatcttcctcgagtccggattgatgggtgtcatcggcgcagcattaaccatgatatttccggcgctgtccgccctgactaaatcagcgggccgtaaccgcctctggggcataacctgcggtgcggtcgtcatggcgcttatatggcgatccatctcggtggatatgctcgatcagaacccttggaatgcgcttgtgttcctcgcggttggtctggcggctgcctccaccgcctcatctcagccagcgttctctaaacccgtcgccgctcaaaggtcagcgcactccgcagcgataaaaagagctaagcgagcgacgcggacacgtggcgccgcctgttgaaaagcctagtcgctggctgttcgacccagaaccagctcagaatagcgaagggagcggttgctagaacgctgaggacaatgtacgccgcgggcccgacgtgggcatagccgccgatcactagccattgctgcatcgggaaggcatacaggtacgtcccataagagaagtcatttcgcgcacaaaggcttgcgagacgcctgggtattacgattccgagccataacagtaaataggcgacggggagcgcggacattgtttttccttgaccgcaaacgagcacaacagcaagcgcactgaaggataaccatgccagcgctttattacacgggatctcgtcggcataggcgtgaatcgtggcacctgcaaggaaaaaaggaaccagcagggataggtcggccgagataccatcaatccctgctgcgtgcacagcgacgctcgcagcagtcgatcctacaaaagcggcgggaaatacagcgcgccgtcggcgaacgaatccggctatcaaggctacgccaaccatgacatagcagaggagctcgaagcggagcgtccataacgatccgttccatgcgcttgggtacggcagccccgcaagggtggtcccgatgtcactgccaccggcgcgtaccatcacggcgttgagcgcgataaactttgcggcctcgactggcgaccacccaccccggacaaggcccgccaaaccggccgttacgactgccgtataaagcagacagacccagtacccgggaaggattctcaacgcgcgcctgatcgaatagcttttcagatcactccggaatcggctttgcgttatcagataaccgctgatggcaaagaatccgccgactgcaaagctccccaacccaaggccgccaagggccggatccggcccgtagccagcgatcgggaacgcgtgcgaaacaatcacgaggatcgccagcaccaggcgtataaggttgagcgcgttgtccctgcccaagcgtttcccgatcgtgtttgcatcagcacccaatggccttatcccccagaagtagttagctcaattctactggagctttttcatcgctacttgtttgactgctctacgctccggcccgtccggtagcatcagccgcatagaaaatagcagggggcgtgcctccatcgcgcggcgcattcatttactcgacggcttgaggggtattgccgcactcgtggtcctgtttcatcactcgcttctcacgattccggtgcttgcagctgtctacgagaacgacgccgttcccgtcgaagacgttgcctcggtggcatggatgctggttcacaccccactacataacctgtgggaggggaagggcgccgtgtacatcttcttcgtgctgtcgggagtcgtcctaactctcccggtcctccgcgggtagtacgttggcaggcctactatccacaatggctcgtgccgctctacgttcctgtctgggcggcggtgctgtttgccgtaggcgctctgcttgtcgtcccccgcgtgggcgaccctggaagtagttggttggacgacagggccaaagaacttacgctgatggcctttgtgaaggatgtcacggtactgaacggtacaggacacctcgcgagccccttgtggtcacttcgctgggagatatggttctccctggcactcccgatatacgatggctagcaaagaaatggccacagctctacatgcttaagattatggcttgcattggtgcggtgggcgccgcaccggttctgaactagtcatcgatgatctttatgcctatgtttctcatcggtgcggtgatggcgaccgagtgggcacggcttgaaagggactgccccggttttgttgactccttgacctagcgagcttgcgctcgtggaaggatgttgacgatgcccacggcttatagggcggagttccgccaggatgttattgatgtggcccgcaagggcgaggcgccgctggcgcagattgcgaaggatttcgggctttcggtcacgacgctcaagcgctggattgcaatcgccgaccgtaaagaatcaggggccggcccggcggtgacggagtcggccgagatgcgggagctgaagaagcggaaccggttgttggagcaggagaatgagattctgcgccgggctgctgcctatctggccagggacatcaacccaaaatgatctacccgctggtcacggatcttgccgtcgacggtgttcccgtggcggtgacctgcagggtgttgagattcagcaagcaaggctattaccggtggaggaccagcccggtgacagaacgggactgggtcgatgcgcacctggtcaacgccgccctggacatccacgccgacgacccggccttcgggtaccgcttcatcgccgatgagctcccggggatgggcatcgtggcgggtgagaacagggtccagtgcttgtgcagggaccacggcatcttgtcggtgttctcgaagaagcggggcctgaaccggaagccggggccaccggttcacgacgacctggtggagcgggacttcaccgccgccgcgccgaatgagctgtggctgacggacattaccgaacaccccactgccgaggggaagctgtacctctgcgcggtgaaggatgtctattccggaaggatcgtcggctactcgatggactcgcggatgaagtcctcgcttgccgtcgccgccctggagaacgcggtgcgctcacgacgccccgcaggaacagtggtccactcggacagtgagactgtccgtaccggtattcccggagggtccttgactcgcacagtgatggatgcgacaggatgctggtgccgggtgcgtcccggggttcttgactctcactccgatcgacagtcgttgtctttccccggatctgtcagtccccgaggcgtacccggcgaggcgctacgcctcgccgccggagtgacctaaggagagcctgcgccaagggcgctcatcactgtcttgtccgccggtcggtcgatgcgcggggccgtgcccccttgcatacccgatggaccggaggaaaacgacatgaccagaactcccgctaccagcgacccggaccaggcactgacacctgtcttcgccggcgtcgacacgcacaaagaactccacgtcgccgccgtcatcgacgcggccgaaacagtgctgggcacgaagagcttcccgacaacacgcaccggctaccgggcgatgctggcttggattggcgagttcggtgatctggcccggatcggcgtcgagggcacaggctcctacggtgccggcctgacccgacacctcgccaaggccggcgtcatgatccttgaggtcgaccggcccgaccggtctgaccgccgccgcaaaggcaaggacgacgacctggacgcgatcaatgcagcccgcgccgcactccatgaccgccgcaccagcatcccgaaaagcaaggacggcgccgtcgaagccctgcgcgtgctgcgcgtcacccgcgcccacgcggtccgggagcgccgcagcgccctgcagctccttcggatgacgattgtctccgcgccggaggtacttcgcgaccaagtccgccacttgacccggatgcagctcatccgcaccctcgctgcatggcggccggacgtatcaaacgcgaccgaccccgtcaccgcctaccgggtctcgatgaagtccctggcccgccgctacctggaactcaccgacgaaataaccgacctggacgagctcatcaaccccatcgtcgaagccctcgcacccgaactcctcgaacgcgtcggaatcggcatcgaagtcgccggacagttcctcgtgacggccggtgacaaccccaaccggatgaaatccgaagccgcattcgcgatgctctgcggcgtttcaccgctgcccgcgtcctctggaatgacacaaaggcaccgactcaaccgcggcggcgaccgccaagccaaccgcgccctgcacctcgcggtcatcagccggatcaggctcgacccgagaacgcagacgtacgtcgcgaaaaagaccgccgagggacactccaagatggagatcatccgctgcctaaagcgatacctcgcccgcgaggtctacttcgtcctcaaccctggccgccagcacatcgtcccgaacaccagacaacacggaaacgccgcttgacacttaggagagcatccgcgggtcccagttccgctctcgtcgcttcgtcgaatcactccgccaccacggcctcacaggatcgatgggcagggtcggtgcgtgcgcggacaacgccgcgatggaatcgttctgctcgctgctgcaaaagaacgtcctggaccgtcagcagtggctcaccaggcaggacctgcgcctggccatcacgacttggatcgagcggacctaccaccgccggcgacggcaaagacagctgggaaaacttacgcccatcgaatatgtaacaatcaaccggaccgcgctcacagcggcctaagaccccgagtcaacaaatgccggggcagtcccaaatgaaaccggttatgtgagggttctatacggcacccgagcgttggcctttttgtggatgagctctccagttttgcggaagcgggcgtgccgacagctccgaattgccatcgcacggcacgaagacgcgttcctgctcacccgcgtccgaagatcggcatctttcgcgatgtgattgagcgtgtattcttcctttgatcaccttcacatctaggtccggggagccccttgaagtcaacttttaagcgcatttatcagaatctcataacgcgcatgcctgttaaggcacgccggcgcatcatgtacttccgggtaaccagacggcatctgcgcctgggtcgacctcgcttgttcactgaaaaaatcaattggcgaatcgttaatgaccgcagggatatcctctcgggaacctgcgacaaaatttggatgcaggactttgcgagagacgcgggtgtcaaggttcccaaccggatatgggtaggaacgtctctggctgaactggccgaggttgacctccctgctcgatgggtgctgaagcccaaccacagtagtggtcgcgttcacttcggggaaggcaaagcgaaccttgctgagctgcaggccgttacaaagggttggttatatgagcaaacctccgtaaccctagctgacgagtgggcctacggggaggcccggaagtgcttcatagcagaggaaagactcggccagtcggacattgatctgcccgactacaaatttttcgtatttcatggcaaacccgagttgatacaggtggattcttcacgatttagcggtcatgagagaaggctctatactcctgactgggaacctcttgaagtggtgaacatctacccactgggccctgtcattccgaagcctgctaccctcgaccaaatgctcgccgcagcagcaatgctagggcaaccgtttgatttcatccgagtggacttttacgaggtcggtggagaagtaatcttcggagagttaacaccttatccgggcggcggaatcgagccttactctccgcgcagcttggacgctgtactaggtagcaagtggacactgccacagctgcagcaatactaactgcagcattaccagggatgccccaccacgcgaaagcagggtggggcatttgcgccacacgtccacacaggcatgctcctgagagagctgagggactctgccgacaagcgcgttcaaaactgcgtgtggatcgtagcgctattcgagttggaaggaatgtgcacggaccgggcttgaagcgacgcgaccttgaatcccggagatcaggctatctatagccatccacaatcgcggcggcaatttccctataggccctcctcgtctctgacttcaggacgtccaaggtcaccaagtcaccgtcggccacaccacggtcatgcgggacagcaatcagctctctgcagatgccggcaaggtgctcctggatggcttgtttatccacgcgagacgatatttcgtccttgtcagtaatcaccacgatcgcgtttcgggctagttcttcgtaaccatggctggccagccactgtagggtgctgcgggcacgtttggccccgctcacagcatagccagcggcaatgaccaggttatccgctgactgcagtatcccgctcatagcattgtgtgtcaccccggtgccgcagtccgtcagtgccacggagtagtaggcggagacgagtttgcggatccgcaagtactcctcagcggtcaaagagtcagagacctctggatcctgctcccccgcgatgaggtgaagtcggccagcgtgatgcatgtatcgagacagggcagtaagcgattctatcgactcgatgtttttcagcagatccgttatagtgcgcgggcttgactgctggtaaatgccctcccccagagcgcgttccaccaaatctccggagtcggggttcgcatcgatggcgcagggtgcgtcgcctcggtactccgcgagagtcaggcccactcccacggttgttgacgtctttcctatgcctcctttgagactcagaacagcagtgttgtagctgccctgcagctgccgggaaatgcggcggcccaactcctcttcctgacgctgcttcaagcccggccccatattcacagctccgccagtcatgctgtaaattgcaccccggagaccgcctaccggccggagtttctgttccttcacaaacagtcccggggaggtgatgaagtcgggcatggggctttcagcgatcgtgttagccactgttggccgggcccggcggaaggcctgagctgcagaaggaatggccatctgcgctggcctgacttcctcagcagctgcaggcgagttggaagcaataatgccctccacacacggctgcgtggatacagtcgcgctggcgcgtgcgggtacgtcggcggctggctttgctgcgtcagcaacggcagccgcttccgcccaagaagtgcgtcgcgtcagcggcgcgcctggttcaggctgaacggaagggctgggcgtaactgcgggcatggttcctgtccggtcatccgtctgcttgccgtctgctcggcgaaggtcacggcgacgacgaggcttgatctgccctgcatcctctgcatgggcacgtacattatgatccactggatcgggcatatatgtcccccaaggacgttcggcgaattctttcgcagcaccgtttgtaacagtaagtctaggggctcgggttgacccataatgtcagatgcggattagtgcggcggccactactactgccgttaggactaggaggacgcccaagacggtgtaaccctgccacctgggacgacccttgtggggattgatgtcgacgtagggcatagctagcgtttttcatctcgggtcgacgttggagcggaaaccctgatggcgcggcgtttgatccggagcatctggtacaagacaaagaaaggaaccagcagggtgcccagcagcgcacacagcgcaaaggcgtactcggatatagccacaacagacctccgttggcgagttagtagtcccatgtcggacccttcggcacgctaccggcccgtcattcctttgacaagttcagtcaatcccacactgaggacccatttttccttcgccgcaccatcaacgagacgttttcccgccagcactgggcagtaagggtactgagcagtctgcttgcacaactgatcatctgatccaagtcacgccgcgtatgacacaacggtgattggcttgattcgcattcatcgtgttgggcagtgatcgaagcgtccccaaggcgtcgttcaccactacgggaggccgggtccctacggcgattagtacgagtactgaaagagcaggcgatgattggagctggaaatgggactgagcgcgcttccgagggacggggcatcagaaacgtgcatccgcgcgccccgatcaggggctgagtgccattgacaccactgcgacagtagccacggccagtaagccgagaccgacataggaaaagaaccgtacccgggcattccgcgactcgcgccgagtctgacgggcagaagaggtagcaccgtatttacgcattcggtgatgctagctaatgcagcatcaaggttcgatcaagttgatcttattgtgacgcttacctaaacattgttgcgggaaccggcgctatcccaacagttacgatgatgcaggagatttgcacgggatctaaagcaaagttgagttctgccacgcaagcagcagattgtagacctcgtcagccagcagagggttcctgccaccgtcgttccgcacccttaggtgtactgactcaggacgttcgttacatctgaataggtgaagacctcttggattggatcaggtcgtcgcgttggccaccgcgctcgtccatcaagcagaagcaaaggctccagctaccgcctcaaacacacttaggtagattcgctgccctcgacaagaccggaaagtaccgcagaatatccagcaccgaagtggctccccttcaggccgcgagatagctcaattttcgagaatcgctgacaaaccgccaagattcagcagcgagccttccgtaatcagcaaatagttgttcctgccgacgtcgagccatcccgacttcgactctccgcacgtacggcaagtaacgcgctcccttcaggctcgtgtacccaggtgcgcacataacactaatcaatcagcagaccgacgctgtcacggattcttcggcgtaagccgctctgaagtatgcccacggggcgttccgcactcatatgataacgctgcgtgcaaaacgtgcaccaagttcacaacagagcagccgccaaaggctgccatcacagtgtcttggttgatcgaacctaaacgccatgatcacacaggaattccctctaacagcaaccgtttctagccgcctccctgtgatccgaagtatcgcggcgcggatgttacatccttgtcaccgtacacaatctgatcaaagggactctcactcgtctcgcgatgcgttgttggagcctgcatgttgtcctcgacctgcacctccgtggggctcttactgctcgagtaataagaatatgcatacgaatcaggatctttcgctggaagtcggttcagcaccacgcccaacacatcagcgtcgaccatactcaaagacgagagcgacttttgaaggtccgtgaccttgacgatttgacttccaacaacaagcacaactccgccaacgcgttgagccaggatcgcagcgtcggtcacaggcagtagcggcggcgcgtcaattactaccgcatcaaactcattttccagagcatcaatgagtcccgacatagcagcagaaccgagcaactcgctggggttcgggggaatactgcccgaagttagaacttgaagatcatcggatccccagggctgcatgagtgcatctaggcttccccggccaactaagcaggtcgtcagccctacgcttccgtctaggcctaggtattcgcccaccatgggacgccgcaaatccgcgtcaaccaaggcgacgcgctgtcctgtctgagctagtgcgatagccatattgacggccgtcgtgctctttccctcacccggcaacgacgatgtgaccaccacagatttggaactatgactgacgtgggcaaactgtaggtttgtccgaatctgccggaatgactcagcacggggactttgcgatggcacttgggtaaggagtggttttttcacagcatctgcgtcgaacgcaatgcttccaagaaggctggcgtccgtgaccttcctgagatccacttccccccggatcctagtgtcgatggccgatcgtagaagtgcggtgccgataccgactgcagctccaatcaagagaccagcggcaagatacaaccgcgcattgggagaggcaggcgccgaaggagccgcggcgggagtgaccacagatagcctgacaggcgaaatgccgtccgatgaggggttttccaagcggtctacagctgaaatcagactctgcgcaacagcctcggcaatagaggcggcccttacaggagacgagtctgtgacggctatgttcagaaggacggtggacccctcaacactggcttcaattttttccgcaagagccgacggactgatctccaaacccaatgaatcgataacaggctgcaagaccaccggtgtccgcgcggtttcaacataagaagcgaccctggcctggctgaaagtgttcccctgctgaagctcgaggacacttcccgagttctgcgtggccacgaacaattgggtgcgcgcggtatacgtaggtgtgctgaccatcgctgccgcacccgccacaagcagacccaataacgttgaagctacaatcagaacccagttgcggcgcagtacacgcaagtagtcgatgatctccaaattgaacctctccgattcatgcctctgcatggatgacaacgctacggaggccagctacttgcttcctgcagctctatgtcccccgaactaaaatatccggctcgtatccgagaaggtgtcggtgccaccgacactctccgagaccataaatgatcgccgatcctaaaccttaccgtttttccacaccttttagacaagcgactcaggcgtcttacttccgagaactgtggcactggtaacttttgtccgacaggtttagttgcctacgccgcgctcctctgtcgagcttgcttggtacaagccggcctgggcggacgacgagtgcgacaatgggcggtcgaaatgtcctcactcggagtgctatatggtagggaccgtcccatgcacagcgcacccaatcgatggtgggggaacaacagttgaaagggagtagtgcaacgctctcggatggttcgaatcctcggctttgtggtcgtaccgatgttgagcatcgcaagtcccttgctcgcaatccccgcgatatcttcgcaatacggtgcagcagggtggtcagcggtagcaataggacagtccgtgggcgcatcctttgccgtcatcctagaactcggatgggggctcactggtccgcagcgaatcgcccggcaaagcctgcgaaaccgtcaacaaactttggcggtggcgctaagcacgaaattcgttctcatcgttcctttggttgccgcggcaagcattgtcagttacaacttgtccagccaatatagatgggaggcggctgctgttgcggctgggtccacggcatatgccctaaacagcacttggtactttatagggacgggttcttcagctaaaatactttactgcgatgcaattcctaggcttttcggtgtagccatagccgccattttgatttttgccggcggcgagctcgtgctatatccagttataggaatattgttgcccatttgcgtaagcggatttctggtaattcgctctgaggacatcaagctttcacaccttaaggggatgtctgttcgtcgcctccagtttgttgttgcatcccagagctccgcattaggagctcgttccctcagcgccatctatatgtctcttcctatcacactcgtgagcctggtagcgccgggggcggttgcggttttttctgcaatcgaacggctgcagagaatctacctgcaagttttggcggcagttccaaatgtcatgcaaaaatgggtggggcagtccctcggcggcagacgaaagattcgccgcgctaaaaagagcgttctttataatgcagttatgggctttgtggctggctcaggtttcaccgtcgctgccccaataatggcggagatagtgttttcctccacgatcaaaatttcactcgaatatgccgcgatctctggtgtacttattttcatagtatgcacatcgcgcgcgactggatcaattgcactggtggccttcaatcgagtcaatgccgtgttcctcagtgctgccgccggagtaactgtcgggattcctgggattttactaggcgctaggtttttcggacccccaggggcgctcattggtgaagttttggcagaactaacggtgctctgcattcaaatgcgggcgatgcgaaatatcagataacagataacgggccgtcttaactaaaccggtcgcacgtttaccaaattaagagaaagcgagtagatctaattgaaaggtttaatcgtacatgagtggattgctcgctcaggtggatcagagaacgtcctccaagcaatgtcgaacacgttcccaaactcagacatctattgcctttggaatgatgcacctgagcgcttttcgcatcgaattgttgaagagtcctttctcgcccagaccccgctgcgcaggaacaaagcagcggcccttcctttcatgcctaaggtgtggcggaatgtggttcttgacgactatgactggaccttggtcagttcgcaccttttcgctcaccacgttggcacgaaaagcagccgcgctcatggacaaatttttgcctacatccatacccccgcacgctatatatgggcacctgagctcgataagcgaggacagtctatggctactcgcatctcctcccccttctttcagagacttgaccggaaacgcgcctcggaggggacgaccttcgcagcgaatagccgtttcatccgtgacaggattagggagacttgggaccaggatgccacggtcatttacccgcctgtggctgttacaaagcttcagtcggaaagggcttggaaggaccgcttagacagcaaggaaagcgaggttctttcgagcctccgtggcgagtacatcttgggcgcttcccgcttcgtttcatacaagcaactggaaaacgtcatatccgcgggggaatcggctggtttgcccgtcgtgttagcaggggcaggtcctgaggagaagtttctgagagagaccgcaaaaaccgcatccgtcccggttcactttgttgatgcaccatccgatcatcttctctacgcgctgatacaaagcgcgcaagtttttgtttttccaccgatagaggattttggcatcttgccagttgaggccatggctctcgggactcccgtcgtcgtgaactccgtcggcggcgccattgagagcgtgacagctttggatggaggctccgcggttgacagcttccggggacctgaactcgcggctgctgtgcatgatgccttaggaaaagatatgagcaaggcccgaatgaaggcgcagatgttctccgaagaatctttcagcgaaaacatacaaaaatggatgggactatgatcgtttgtcaatgcggacaagcgagcgctcgtctttcgaaagaccgaggatagatatgactgagcctggatccgtgccatcgaaagcgcaatcgaacctagggcagaccgcgaaaatcggagtgtcggttgttaactatttttcaagtacaagtgtcaagctattactggattccttagctgaattcgcggatggttgccagatcctcgtaaccatcgtagacaatagtcaagactctggacgacgagaagctgaactccttcgcgacatagcttccatagcctctggttcatacctacaagtcgaagttatcgaagcagaacaaaacctcggatatggcgcaggcaataacctcggagtgcgtcgcctcatcgaaaggggcgcaacgctactatgggtactcaatcctgatacggtggttcacggttcagctacttctctggcgaacgaagctgatagcagacccgctcacatatggtccaccgttacaaaggaaaatggcgtcatatcaaatggtttaggcatgctcaatactttgaccgggcgagctcgtgcgagttcaagttcgacagtaggacttcaacgctttggtatgcgttaccccggggggcattccatagtgttttccgtggaggcctggcaacagctcaatggatttgatgaagactattttctgtttatggaagaagcagatgtgactgtcagatcacaggccctagggatgacagttgccactttaggcagcgtcattgttcaccacgatcaaggcctgacgaccggaagcacacggaatatacgtttgaaatcgagtgtcgcttttaccgcggctacgacgagcaggattgtctttttcagtaaattttacccgcggcggcttccatttgtgcttatgtgtcgccttgcgtatttgataaccattttattgaggggaaacttagggggagctaaagctgtagctaagggcatccaccaaggactctcactgatacgtgaacgtaaggatcgaggccatgaacagtagtaagctttgtatcatcatcctaaattggaactctattgaagacactctcaaggcagtcggcctccttcatgcatctccctgggatatctgtgttgtagataacggatcccaaaacgctggcgaagtggctttactccgtgagacctattctgacgtacacgtcgtggaaaccggagacaatctcggttacgcggggggtatgaatacaggtatgcggtgggcggcatcccaaggcttcacccactcgctattactcaatccagacaccacacctagcatcgatgttgtggaagggatgctgcgcctctcagacggctgcgctgtagttggtaccgtgcaggtgacagaggatcacataccgtatgtgtctgccgcgattcttcagggaaagaaaaaggtaatcccatttcgatgcccagcaaactgcggcaatggccatgacgttgacatcgtttcaggtgctggcatgcttatcgagctagacgctgccgcagcgctaggttatatggatgaacgcttttttcattacaaggaagagtttgatttctgttttcgggtgacatcttccggtggtcgcatcaggttcaattgcggctcgcctcttattcatcgctgcggcggctcacttgcaagttcttcagcgtcgggaatgtactacacatttcgcaatgaggtcctttttttgaggaaacactttggactgctggcgtcgatatccggcataggcatttatcgtaatgcgcttaagtccatgatcgacgagccaaagaacagcgctgctatccttcgcggcatactgcacggcgtgcaaggaattactggtccgctttcaaaactaagacctaggggtatcacaaagtgaagattctgttcgcttcccatagttcagctctggcaggagcagaacaaagtcttgttcacttagtacgtacggcggcggagcgaggacacacaggggccgttgccctgccggagcctgggccactagcgggccgactcgaatcaacttctgactcctttgaaacagtcatcttgccaagtcatctatggatgggaaggcgttattcgttcgtcgtgggctcggtgcgcttactgcaggcgttgtccgatgttccgcgttacttatcacacatacgtaccgcaggttacgacgtcgtggttgtaaacagcagtgtttccccagttcctttggtgtcggcccggctagcacaggtgcccgtcctgcaggtggttcgggaaagcctgatttccaacccgatgcttcgttctgctctcccaaagagcatcatcaggcaattactctcacggttgtcgacatctgtcatctgtatatctcagttcgtcgctggtcagttttcataccccagcaaagtcttctacccccaagttggaagtgaattccttgcaactgccgaactgactgaacggccaactcagacgccgccgcaggcagtcatatgcggcaccatcagtcccgagaaggggcagttagatgcggttcgggccattcaggtcgcacggtcgctgggcactgaggtgcgtttggacatctacggacgaggagaactcagagatgtcgctgagttggagtcagtcatcaatgaactcgaccttgaaggtctagttcgcattatggggtctacctccgacatgaaggccgcttatgattctgccgacatcgcaatcgtttgttccagaaacgaaggtttcggcaaggtcacggccgaggcaatactgatgggtcgacctgttgtagcttacggcctaggcggaacctcggaaattttagactacggcggtggtcttgccactgcagcttcgcctgacgcactaggtgctgcactgcataaggtatttacggaacgctcgttgctgcaggaactgggcgcagaagcccgaacaagtggcattcgcagcgaactggctgagagcgcacaaagagtactcgactgcatcgaaaaattaaaagtgacacagtctcccaagggctgaattgagttgagctgacgcgtggagatattttcatcgcgggctggaccaccagacccagcaagagttacacgccccagacatggttgtcagcacatagggcaacagcaagtatgatctgagagcacaaacttaggggtgggggaaattggggcgtttagtgagcaaagcctcgtggcgtcgtaagtacgcgattcgtcttaaattcttggatgctggtgtcatcctgtgggctgttgcaggtgcctacggagtacgattcggtttttcagacgaaggtgctgtaggttccagcgatatcgactatgcgactctgtctgtcgtactcgtccttgcgtggtggctcatgctggacttttggggctcgagagagcctcgcgtgttggggtccggatccgaagaatacaagcgtgttctatcaagctctctgtggcttttcggtcttgttgccattgtttcgtatgcactgcgcatagacacggcccgtggtttcgtcggcttggccttcccagcaggtgtagccggcctactcgccggacgttggctcgtccgtcaacacctgagcattgagcgcaaaagcggtaagagcagctcgagagtgatgataattggtggcccgtactcggctgcgcacttagtcgcatcgctaaagagtgtcccaagcgcgggatacacccctgtggcagctcaactgcctggggctacgcaacccgttcgttctttctcgactctggatgttccggttgcgggcgtgagcacggacttcgattcaatccttgccgctatcctggattcgaacgtcgatgctgttgctgtctcagcaggcgtcaatcttcatccgcaggatctcagaaaactaggctgggaacttgccgcaagagacattggcatgattttggcaccggccttaaccgatattgcaggtccaagaattcacacgcagccagtcgccggcctgcctctgattcacgtgtctacgcccaagctcaccggcggaaagaaagtagccaagcgcgctttcgacatcgcagtggcaggactgctcttattggttctctcaccagtgttcctgctcctcgctttgctggttcgcacgacggatccaggaccagtcttctaccgtcaagagcgcattggtcttcgtgggactacattctttatgctcaagttccgctcgatgaaggtaaatgccgatgcagaactgcagtctctcttggctgcccagggctccgctgacacgccactattcaaggtggaaaatgatccgcgtattacaccacttggtcggattcttcgcaagtactccctagatgagcttccccaactactcaacgtattgggagggagtatgagtctggtcggtccacgtcctcaacgcgagggggaggtcgctctatacgacgacgcagcccatcgacgtctatacgtaagcccgggaatgagcgggctttggcaggttagcgggcgctccaatctcagttgggaagagagcatacgcctcgatctctattacgtagagaactggtccttaatgggtgacatcgtaattctctgtaaaacattcaaagcagtatttgctagcacgggagcggtttgatctgtttcggagcgggtggcaactctaaagaacctagcattgcggaaggcaaaaaatgcgcataacggtaattggctgcggctacttaggagcggttcacgccgcttgtatggcaaagctggggcatgacgtaacaggtattgatgtagacgagaccaaaattgcggcgctgtccgcggcaagggcacccttttacgagcctggcctggaagaattacttgaagaggttcagtcgactggcagactcacattcacctcggacatgtccgctgcagcaggcagcgacgtccactttgtctgcgtcggaactccccagaaaaagggcgaaaacgctgccgacctgacatatgttgacgctgccatagcatccttgctccctcacctctcagccggggacatcgtggttggcaagtccacggtacctgtaggaaccgctggacgccttgcggcactcattgggtcacaggacccctcggtacaccttgtttggaaccctgaattcctaagggaagggcatgcagttaacgacacgctacaacccgaccgatttgtatacggtgttattgatggttccgaggaccacccagctgtagccgtcctggactctgtttactcgacacctctgtcatcgggaacgcctcgcctggtcactgatcaccccacggcggaacttgtgaaaacggctgcaaattcttttcttgctaccaaaatatcttttattaatgcaatggccgagctatgcgaagctgcgggagcagatgtcacgaggttggcagatgctatcggcatggacgacaggatcggaaggaagttcctcaacgcggggattggatttggtgggggttgcttgcccaaggacatccgcgcgttcatggcgcgcgctggcgaactcggtgccgaccaggcccttaccttcctacgtgaagttgatgcgataaacatgcgtcggcgcactcgagttgtggaacttacccgcgaattgtgcgatggatcgttactcggacagcgcataaccgtgttgggcgcagcatttaaaccggagagcgacgatgttcgtgattcgccagcgcttagcattgccgcgcaattacagttgcagggcgccgtcgttaccgtcactgatcccaaggccctgtcgaacgcggctcgccgttttcctgagttgcactatgaacctgacacggacaaggcagttgagaatgccgacgccctcctagtgctcacagagtggcaagaatatgtccagctcgacccttacgcgctttccggcttggttgcttcgacgcgcgtccttgacggccgaaacatcctcgacccaggaaagtggcgttctgctggatggagctatcgaggtatggggcgcccctgaccatggtgaaaaggggtagtgctctcggcgaaccaagctcccggcagagactgatgcaggaagatcgcaacagaaaccggcgacgctggaagagtactcgcgccataatggcgatgttagctgtgcttgcggttttgaccctggggacactttggcttggcgcgagggccttaacgataaaaacagaattaactgcagcggaagctttggtggggccactgaaagagagcctcagcaagaatgacgtcgcaggagcggccgataccgtgcacgacatcaggacgcgcactcaagctgcaaaagaagctgctaacgaccctctttggtccctcgcagtctccctcccctgggccggacgaaacttcagcgccatagctgagatcgcgcgctctgctgatgacgttgcaaacctcgggctggcgccgttgctcggtgctttcggttcattggactggaatgccctagtcccggggaagactggaactgacctagcagctctcgaagcagcagcacccagcgtcagttcagcagcctacgcagtgcgggcttcttccgagcgcctcagtcagatagatgcaaagcaattgctgcctgaggttgcggagccattgacacgagcgcgcctacaactgtcggaagtaacagggacgttagatggggcagctagcgcggcgcaagtcctcccagcaatgcttggttccgacggtccgcgtaattacctcctagtaattcagaacaatgcggaatctcgatcatctggaggtattccaggggcgctcgcaatactcacgcttgatgaggggaaattgtcgcttagcggccagagcagcgcttctagcatcggggtaatgaacccggtcgtgcctacggagccgcaacaagtacaaatattttcggggcggctcgggaagttcatgcaggatgtgaacctcactccggactttccgaccgcagcgagtacggctcaaaaaatgtgggagcgcaagacgggccagcgagttgatggggtaatttcagtcgatcccatcgtgctgggttacgtactgcagtccacgggaccagtttcacttaaccaacctgacctactttcgatcgccggctcgagcctcccgcttgaactcactggcgctaacgtcgtacagacccttctctcagaggtctacgccgctgtggacgagcccgaactgcaagattcttactttgcgtcggtggctcaagaggtcttctctgcaatctccctgggcaagggagactcgactgggctacttgcagccatttcgcgaggcgccgaagaaaaccgagtgcttgtctggtcagctctccaggaggagcaagccgtcatctcccggtacgccgtgagcggatcagttacagggccaagcatctcgcctgcgcaattcggcgtgtacttcaatgacggtactggagcgaagatggactactacgtcaagcgcactgtgcaactaatcaaagaatgcccaaaggacggctacgagcaaacgacagtccgcgtgaccagtacaaactctgcgcctgctgacgcagctacgtccttacccccatatgtcaccggcgatggaatcttcggagtgccaccggggaccgtgcaaacgaacatcgttgcctacggccccgtccaagcaaacgtcgagatggcgaagcttgacgggcagaaaactgaatttgcgcctcatctccatagcagcaggccggtcggcgttcttgccattcggctcgcaccgggagagagcaaaattgtggagttcacgtttggaaaaatcgtgcagcatgccgagccggagttggttgtcacgcctacggttcaggatgtcaaggacgtgacactgcccacagaaaacgcaacttgcccctagaagacaagaatgcctcgttaacactatgtaaaccgactggattgacattgctcacaaacaggagcagatggtaccgtctctcttgggatcattatccgtagttccgcataggtctcgtgtggagaggaaaaatttcctcaaaatcgggtacaccaaaaacttaacgtctccggggggacactcatgaagaaaacactcgcagcactcgcactcgctggctcactcgcccttattggctcacctgccgtggcagccgaatacccggccctcccgccgcaggctgctgtctctgacggaacagttggacccggcgaatcctttgtattccgcggccagggcttcctcgccggcgaatcactgaccatcaccgttacgccaggccaggcaccggcgtctaacggagccggccttggccgctccgttgccgtgaagattcccgtcttccaggcaccgcagaccctcgccgccacggctgacgcacagggtgcattttccctgccgatctccatcagcgaagccggcacctacagcctgacggcaaccggtaacacctccggcgtcgtcgttggtcccgttacggtcaccgtggcagcttcactggccaacaccggtggcaacgctggcggagctcctctggccagcacgggtggtgcaggcctggcaaacaccggcgctgactccgggctggtcctgtggaccctggtgggcgcaggcgcactggctgccggcgcaacctcggtagtggttgttcgccgccgcgccaaggctgaggtagctgcataaccagcaacacccaataaccacctaagaaggtggatgtgctccggaacggagaacatccaccttcttcgtttaaagtctcagcgggctaagccggccaaccgggcggccgggctgtggtatcaatatgagctatggggagacattggcgaaaagcaccacggcagtacgacttctcgtttcccctcccgagccctcaggtactcccctacgctcttcttgccctgctggcgatcgccgccctggctaccgcagcgttggcccttctgcggacctcctgaaagccccgtgaggcagctcgagaacttccggctgtggcgcctggtcctgatcgccatgctggttcccctggcgtttatcgccttctggccaagcccagttgaccagcccgttcaaggccagctcgcagcagtcctgaatttccttcaccgtcacggaattccagtgtggttcaattacagatttgtggaagcctccgccaacgtcgccctttttgtcccggttggagtagtcagctcgctagcatttcccggctggctctggtggcgaatcggcttatttggactgctcatttcctgctgcatggagctgggccaactgctgtttcttcacaaccgatttccaagcgcccttgatcttgtgacaaacacgtcaggctccgtcatcggcgcccttctggctgcggcagtcctcgaaaggctgcgggcccgcagcatttcggctgcgagcccacatagccccggaaacaccgcctagcgaatctactggccctgttccttgtacttggcttcggtctgggccttctgcgggcgccaccagttttcgttctcgcggtaccaggcgatggtgtcctcgatgccggcgtcgaagttcgagaacttcggttcccagccgagctcgtcgcggagcttggtggagtcgatggcgtagcgcaggtcgtggcccgggcggtcgacaacgtggtcgtacgcgtcgggggcctgccccatgtgcttcaggatcagctcaacaacgtccttgttgttcttctccccgtcggcaccgatcaggtaagtctcgccgatcctgcctttggcgatgatcgccagcacggccgaggaatggtcgttggcatggatccagtcgcggacgttctcgcccttgccgtaaagcttgggccggatcccgtcgatcacgttggtgatctggcgcgggatgaacttctccacatgctggtacgggccgtagttgttggagcagttgctgatggttgcctgcagcccgaaggaacggacccaggcgcggaccagcaggtcagagccggccttcgtggaggaatacgggctggaggggttgtacggcgtttgatcggtgaaccgttccgggtcatccagttccaggtcaccgtacacctcgtcggtggagatgtgatggaaacgcttgttgtgcttccgggcggcctcgatcagcgtgtaggtgccgatgatgttggtatccaggaacgggcgcggatcatgcagcgagttgtcgttgtgcgactccgccgcgtaatggaccacaacgtctgcctgcgcaaccagtccgtccaccaggccaacgtcagcgatgtcgccctgcacgaacatgaaccgctcctccggcagtccccgcagagattccaggttccctgcgtatgtcagcttgtccaataccgtgacttggtcatccgtattttccaaaacgtagtggacaaaattggagccaatgaacccggcaccgccggtgacaagaagtttttgcatttgtacatcgttccatgtccactcgatttggctgaatttgtaacaccccggaaaatagccgtatgcgcggaataatcctcgccgggggaaccggttcacgtcttcatccaattacactcggcatcagtaagcagcttgtgccggtctacgacaagcccatgatctactacccgctctccacactcatgctggcggggatccgggacatcctgatcatcacgacaccgcatgatgccgaccaattccagaggctcctcggcgacggcagccggttcggtatcaacctgacctacactcagcaaccgtcaccggacggcctggcccaggcttttgtccttggggcggaccacatcggagacggaccggtggcgttggtccttggcgacaacattttctatgggcaaggcatgggcaagcagctgcgccgcttcgaaaacatcgatgggggagctgtctttggttacagggtggcagacccctccgcgtacggtgtggtggaattcgatgagaatggtaaagcgatctcactagaggaaaaaccagcaagacccaaaagccattacgcagtccccggcctgtatttctacgacaatgatgtggttcaaatcgcacgggacctcaagccctcaccgaggggtgagctcgaaatcactgacgtcaaccgggtatacctagagcgcggaaaactgcaggtcgagattcttccgcgcggcactgcttggctcgatacggggaccttcaacgacctcaatgatgctgcggagtttgtgaggacggtccagcaccgccaaggtttgtccattgggtgcccggaagaaattgcctggcgcctcggcctcctaacggacgaagaacttcaggaccgggcagaacctctcgccaagagcggatacggcaaatatcttttggaattgctttccgaagataccctgtcaaaagacggtctacagctggttggccgctgaccagctcttctgctttaacaaattatgggccccgcattgatagcggggcccataattcgttataggtagcgtcgcctagttcacgaagcccttcatccaggtcttcaggtcctcgccgaactccacccgctcggatgcgagggtgatgacggctttgaggtagctgagcttgtctccggtgtcgaagcggcggcccttgaacaccacgccgtacacgccggacccttcgccctcgccggcggccagggtctgcagcgcatccgtcagctggatctcgttaccgcggccgggctcggtctcctccaggatgccgaacacggccgggtgcagcacgtaccggccgatcacggccaggttggacggcgcatcccccacggcaggcttctccaccaggctgttcacgcggacgtaatcctcgccgtccaccgcggtgatgtccgcgcagccgtacgcgctgatctgggccggatccacctcaatgagggcgatcaccgaaccgccggtcttctgctgcacctccatcatggtggtcagcaggtcctcggcctcatcaatgaggtcatcacccagcagcacagcaaacggctcatcacccacgtgctggctggcgcacagcaccgcatggcccaggcccttcgcctcaccctggcggacgtagtggatggggcccagctcggaggcgtactgcacggactccagcctgtccttgtcccccttgagctccagcgcgcgctccaggccgggctcgcggtcaaagtggtcctcgagggagcgcttgttgcgtcccgtgatcatcagcaggtcggtgaggccggacttcacggcttcctccaccacgtactggatggccggccggtctaccaccggcagcatttccttcggcattgccttggtggcgggcaggaagcgagtccccaatccggcagcaggaatgacggctttggttattgctttccccgttgtcatagctgaaccttacaaatcagcggcaggcaaaggcaattttccaccagtaaaccgcggctcacgcttttcctggaaagcccggaaaccctcggcataatcgtccgttgtgcacaggcgcgcctgctcggtgttctcctcctgcatggactgccacaggcccaggcgctggtcacggatgtgcgccaccagctccttgcttgcagtgaacgcgcccgtggccccctgggcgacgcggttcacgatcccccgcgtcgtctccagcagctcgtccgccggcatggcccggctgaacatcccccgcgccacagcctcggcaccgctcatcagctccgccgtgtagatcaggtccagcgtccggtgcatgcccagccgctcggtgaagtaccagtgcccgcccgagtccagcgtggcacccagcttggcgaacggcgagccgaacttggcgttctccgccacgtacaccacgtccgtggccagcagcagccccagccccacgcccaggcacgccccgtgggcggccgcaaaggtgggcgccgggaacgctgccatctttttcagcagaggctccaccagcccgcccaggtacgcggcggcgtcgtcgctttccggcgtcacgttctggatgtcccggcccgcgcagaaggcgcggccctctcccctgagcagcagcgcccgcacctcaccgcgggaggcggcggcagcagcgtcgtcgtacgcctgggttaaatccgccagcgcctgttcgtccagcgagttcagcttgtgcggtgcgtccagcaccacctcggccacggcgttgttgatggagagggaaatcatggaactccttgtttgagaccggtaggactagacgtcgaagtcgacggtgacttccttgctggtggggtggctctggcacgtcagcacgtaccctttgtccagctcatcctgctccagcgcgtagttttcgtccatggtcacgctgccggtgaccaccttggcccggcaggtgccgcacactcccccggcgcacgcgaacggcacgtccgggcggacccgcagcgcggcattgaggatggactcgcgggcgtgggtggggctggccacctcgccctgcaggccgtccagcttgaacgtgatcttgtacgtctccttggactcgtccaccagcacgggccggccggcgttgccctccggcttgtccggcttgccggaggtgaacagctcaaaccggacgttctccggcttcacgccgcgctcggccagggtgtcccggcacagctgcaccagctcgaacggcccgcacaggaaccactcgtccacatcatccgcatggatggcggtgcccagcagctgctgcagcttctccgaatcgatcctgccggacagcagcggcgcgatccgctgctcgcgggagagcacgtggtggatggccagccgctgcgggtacttgtccttcaggtccgcgagctcctccaggaacatcacgtccatggcggccttgttggcgtagatgagatcgaaccggcactccgggttcttcgccagcagcgtgcgggcgatggcgatcaccggggtgatgccgctgcccgcggcgatggccacaaagctcgcttccccgttggacgccacgtcccccgccagcgcctccggatcgttcatggagttcatccggttctgctccacggcctggccgtcgcggccgtgccgggacacaaacgcacccatggggctcatgacatccagggtgtccccggccttcagctcggcgttggcccaggtggagaacagcccgcccagatccttcttcacggccacgcggatctcgctgctgccatcctcgaagctgcgcggctccgcacagatggagtagctgcggcggatttccttgggttcgccggcctcgtccggcagcgtggtgcgcagcgccacgtactggccgggcaggtagtcgaactggccggcgagctccgcgggcacgtggaaggacacctcgatggcgtcctcggtgagccggcgcacctccttcacggccagggtgtggaaggacggacgacggcggccggtggcttgcgcctcctcggcggcagtctggcggacaacaggcatggggcttccttacagcactttgaagtagtcgaacggttccttgcagtcctggcagacgtacagcgccttgcaggaggtggagccgaagcgggtgagttccttggtgttgaggctggagcactgcgggcacttcacggccatggtgaggcggatggggccggcatgccgtgccgcatggctcttgcccgtgggcggggcgatgccgtactcctgcagcttctgcttgccggcgtccgtcatccagtccgtggaccaggccggggcgagcaccagggcaacctcgacgtccgcgtagccctccttggtgaaggcggttttgaggtcgtcgcggatggcgtccatggccgggcagccggagtacgtgggggtgatggtgaccttgacgtgctggcctgttccgtgttcctgagtcaccttcacgtcccgcaggatccccaggtccgcgatgctgagcacggggatctccgggtccaccacggtggcggcgatatcccaggccttttgctgctcagcacgctgctcgtcctgccgcggcgtctgggtcctggattcaaaatcggagatgtacatggccgcggtcaccagctcgctccgggatgttcgcgggccagcacctgcatctcggccaggatgtagccgaggtgctcggagtgctttccctgccggccgccgcctggtgctgcgggcacgtccgggacctccagctcggcttctgacaggacttcgccggtgagccggtcaaagtcctccttgatggaggaaggcgcaacggcgatgcccgcctcagcgagccggcccgtcagggcgtcatcgcggaagagttcctccacgtacggccacatgatgcggaaaccgtggatcatccgcttgcgggattcctcggtgccgccggccagacgcaggacccactgggcggcgtggtcgcggtggtagtccacttccttcacggccttggcggcgatggcggccagggtggcgtccttcgattcggtgaggcggctgtagagcaggaactggtagtagctcaccacgaactggcgggcgatggtggccgcgaagtccccgttgggctgctcgaacagctggacggagcgaaactcatgctcgcggcggaagtaggcgaggtcgtcctcagacttggctgagccgtcgtcgttggtcatggcgccgccagcgtagctgaggaaggagcgggcgtggcccagctggtccagggcgatgttgcccagggcgatgtcctcctccagctcgggggcgcgggagatccagtggcccaggcgctgggccaggatcagggcgtcgtcgcccaggcgcagcgcgtactcggcggtgtcctcggttggcttcgcgaggccggtgcggacctcgagtgcgatgtcctcggggcggagggcgttgccgggggtgatgcgggtggcgctggcgttggcttcgctcacaggtgcttcaccccttcgctcttggtgtagtacgtggcgtggcggtagtccttgccctggggggactcgaagaacgcgcccttggaatcgggatcgctggcggcgatggcgtccgcgggcacaacccagatggacacgccctcgttgcggcgggtgtagaggtcccgggcgttgcgcagggccatggcggcatccggcgcatgcagggagccggcgtggacgtggctcaggccgcggctggaccggacaaagacctcccagaggccccaggcgtgctctgtgtgttcctgcggctttggggatgccttgggggcttcgcgcttgatctcggtggcggagctggcgggtgcttccgggttcccgtgggggctcatgctgcgtattccttcgtcgtcattgactgtttctgtgcataggcggcggctgcctcgcggacccaggcgccgtcgtcgtgcgcttccctgcggcgctcaaggcgctgggagttgcaggggccgcggccggccaggacctcgtggaactcgtcccagtccagcgggccgtgctcccacttcttggagtcctcgttgaagcggatctggtcatccgggagggtgaggcccaggacccggacctgctccaccatcatgcccacgaagcggctacggagctcatcgttgctgaagcgcttgatgttccaggccatggactgcttggagttgggggaatcgtcatccggcgggccgaacatcatcagggccggggcgtaccagcggttcacggcgtcctgggccatctgcttctgggcgggggtgccgttggagagttccaggaggatctcgaagccctggcgctggtggaaggactcctccttgcagatgcggaccatggcccggccgtaggggccgtaggaggcgcggcacagcgggacctggttgcagatggcggcgccgtccaccagccagccgatggcgcccatgtccgcccaggtgagcgccgggtagttgaagatggacgagtagcgggccttgccggcgatcagcgcgtccgtcatctcgtcccggttctggcccagggactcggcggcggagtagaggtacagcccgtggccggcctcgtcctggaccttggccatgaggatggccttgcgcttcaggctgggggcccgggagatccagttggcttccggctgcatgccgatgatctcggagtgggcgtgctgggagatctggcgcaggagggtcttgcggtaggccggcggcatccagtccttgggctcgatccgggagtcctcggcgatgacgcggtcaaagttggcctggccgtccgcctctgccgtttcgctggttccagccgttagctcgaccggcactgactgcaagttctgggctgccatggttgctcctatgcaaagaccgtctgggacgtgcggaattatttaccgaccgttcgttcaggatatgcggaaccgcgagggcccgtcaaggccacccgcctccttctgcctccctcccccgtcccctgccctccgctccctgccctcccctgcgacgctctctcactcgatgcgccctttcttccgacgctctctcactcgatgcccctttttctcgacgctctctcactcgatgcgccctttttctcgacgctctctcactcgatgcgccctttttctcgacgctctatcacttaacgccccccttccccggacgctctctcacctccggcgggttcaggttaggggtcatcgacaagctcgcctgctgttgcaaagcgatggttgtgaattcactagaaaagcggtcctcatcgagggcttacgctcggaccatgagacccgatgaaaagcaggggcaccccactccgtctctgcttgccagcgctcaagccccgcggggactacctcaggcgcgctgcaaccgacttcaagctggcataaacgaccaggacggacaatgacccagaaccccgagcggacacaaccagcacctaagaagtggaacgtgcgcagggttctgacgtggtgggctggaattctcgctgctctggttctcatcgctgagctgttttcagtgttcgccatgggtgttcacctcaatggccgggaagctcccccgcacatgagggacatcgcgaatcagctcaaggtaaagccggaatggaagctcgtcagcgattacgaaacgctgcaacatgacaggcacgcttgcttggttccggcatgcccgagactggagcagaagtgggacctcgggatggaatcagtgagctgcaacgggctgcaccagctactgagagactcgggttacaaggtcatcatccgcaggtccaactacaccccggaagcaaatgagcaggcggagagctgcactcgggtattgaatgcagtctcatccgacgccgaagcagcatggggactggtgcgtattgaagcccttgtctacccgcccagcgcccgcgagggatcagagcgcgaggattacgaactcctgctgcgtgtcatcaaataacagcgactcagtgtcagtttcagaaggcgtctgcaccggactatgccgtcgtgctgtgcgtactggatcttggtgcggtgcgggacgatcttgcggactgccgtttcatcgccgggagtactgcgaggattccgaggattccggccacggtgaaggccatgaccggcgagacgtggtcgaacaagactccaagtgttgccgagccaagcgcctggccgatggcgagggcgataaacagcactgcagtgccctcggcggcacggtcgggaacaatgcggactgcccagatgataagaaccccgcacaaggcggtgtagctggcggcgaacagcgccacggaggaatacgcggtaaagggaatgcccggcgccacgcccaggacgatggtcgcgcctgccatggccagcgaggtcaggttccaggccgtccgcaggctccagacctgcacgatctttccggcggccgcaccgagtaccccaaaggcgcccaagaccatccaggcaaggatggagtatgtctcgtcagccgggcgggaagcggccatgaccgagcgaccaaaagtccagatcgcggcactggacgccccggccaggactgccgcggcgatgggcaaggccagtggcgccaggtcgcgggcccgcacctgggatggccggccggcagcccggtcccggctggcagtgtggtcagcacggagggtggcaacggctgctatggcaaccagggccgcgattgccacccagcccaggcgccattggccaaccgtgagaagcatgaggatccccgcgacgacgatgcccgccccggtgccggcattaacaatcgtctgcgcgctctcctggcgtgcaggggcgatattgcgctcgatgaacgtgaccaggcccggggttgcgaaccctgcgccggcacctgccaggacgacactcactgcgaggacgtcgacactgggcgcaaccgccacacccatagatccgagggcagcagtggcgcccgcgcacatcacgaccagcctcggacgggcagcaaggcgtaaagccaggactgccgccaaacagaatgagaggaagctcccggcctggatgaaccccgcagtggccgagcccatctgaaaggcctccgtgaaccggggcaggaaaagcccgtaaccgaagcgcgccaggccataggtcgccgctatcaatgccattccgctgaccaccatcgcccgcacgggatcctcctcaaacatcgaaaccagaacgctcgttacggtacagcagaactagcgttccgcaataggggcagttacagtggaatggtgaccaccggccagcgacttcccgcccgcgcacgcttgctcaaggcagccgaccaagtcctgttcgaccatggcatccgggccacgcctgtcgatgcgctgctgcagcaggcggaggtctctgccgccaccctgtacacgcatttcggcagcaaggacgcgctggtcgctgaagcgttgagggtcaggctggcggactggcagggagtctgggaccagcacattgttgcggccggagacgatatggggcggttgctggcagtgtttgacgcccttgcctcgtatcggcgcgaccagaaccacccctcacgctggtgcgcctttctggccgcagccaccgagcttcccgcagccgcggacgagatcagcgccgtcctcgccgcggatactgagctgctcgctacccgcctcctgcacttctcacgccccctcgccggagcccgcgcccaggacctggccgacgaggtactcctggcctacagcggcaccctgaccgccttcctgcgcggctatccccactcaccgatcgacgtcggccgccgactggcccgctcagcagctcaagagcatagccgcagctgacaccgcgtcagcagaaggacaaacgccccccttccaacccgaccacggcgggcacgaataccctcctcaaaggatctatttgatcgggcgtacagcaccctccccttcctccttgcccgccccctgccacgctctctcactggatgcggactttccccggacgctctctcactcgatgcgggcttccccggacgctccatcacctggctgcgcccggtgcgtgccgccgtcgtgcgttccccctcccggcgtccgtgccgctggggccgtccatgagggtgtaacgcaggtgtaacgcgtcagggcgacgattagagctcgctgatcattgggcgacgcccgccgggaggatggacaccgaaccgcggaaggagatgtggggccgatgagccgacatacccgcccgaccgcaatcttgttgggcctcttcgcgatcagccccctgctggtggcctgtccatcatcacccagctgcagtggcagccagcggccctacaacaacgtgtgcctggacaacgtcgccatcacctacatcgaatgcaccaagggacgcggcttcgatctgacaaccgaattgagcggaaaacttggcggaaccttcaaggtgatagccgacgcgtctgtggaggccgcgtacaaacagacccaggaagaaaacacggtggtgggcctccagattgtttctgactgcttgaaaattgccgaaagcagtgcggacacggcagcgaataggtcggcggctgaggaatcccgtcaacgtgctgacttgatcaggcagcaggtcgaacaaacggcccacatcgagatcgctcccaaccaggcccgggccggtgaaagcgtcctggtcagcggcacaagcttttatccggaagagaccgtggccatttatgttcacgcaacgctcgttactcaaatcgaggttgatggcgaaggggcattctctgccaccatagcggttccgaaaaacgccctccccggcttccagaccgcggtcaccgtgacgggtgaaacttcagccaagtccgcccaggcaccgttcgaggctttgccttagggcgcgcgacattcggtgccgccgcggatatccgccctcgcgagccacattcggggccgggtcactgagcctgagtgtcgggattgaatctgcgcgccgcaggcagtccacgaacgtgcgctggaacggacactggcagcggccggcgtgccccgccgtcgtacgcgttctgcgattctcgacgcccaaacccacccacgagggtgctcagaatgcggactcacgcggcagtagcgggccgggcgttgtgcttggtgtggtgggaggaagtggcgtggtcaggaaacataagtcaaaaatccgcaggcgtcattgcccgtgggcccgccctcgtccgctcttgtatttgcgctggtacgtaattacgctggtgcgcaaatggatgacctgagcactatcttcctggcgctggcggatccgacgcgtcgagccctgctggcgcaattgcagcagggtgacgcgacggttaccgaactggccgccccgcacgcaatgagcgttccgtccgtttcacgccacctgaaagtgcttgagcaggccgggctcattactaaatccaggtcggcccagtggaggaattgcaggctccaacccgcgccgctacgccagattgaggaatggatgcgcccgtaccgcgacttttggggcacacagttggaccgcctcgacacccagctcgccgcaacgcccaaccgacccaatgagctttcagaaccggaggatggatcatgacggattacccggcacagccccgaagctttacccttacccgaattttggcagcgtcgcggcaagcggtattcaccgcctggaccgaccctgagcacctttcctggttctacaacccggacatgcccacacccaccgcacccattgaggtggacctgcgcgttggcggaacgtggaagcagcagatgatcgtcaacgaagacctcagctaccccaccggaggaatctacctggagatcgttcccgacgaacgcctcgtcttccgctggggagcagttggagggtggccagaacccgacggcgaaaacgaactgactgcgcccgttgtcacggtgcaactgaacgacctaggcacggaaacggaactcgtcctcacagtccagttctctgagcatttgaacatcgaagaagtgcaaaagctcatgctgggaggcacccaggaaggctgggctgccaccatcgaccgggtcaaggacagcaccgccgtgacgcccaagactaatgggcgcatggccgggccccagatctatgtcttctttccgggaacggcgcgggaagccctgagcttttacgcggatattttcggcggtgagctttccctgcacacgtaccaggacttcggcaggagcgacggcccgccggaagccgtagcccatggagtgcttaacggcgtcgttgcactggcaggctcggacgcagctgaagggcagacaacggtcaggccggaaggcatcatgctctcgctgctgggaaccgccgaaccaacagtcctccacgaatggttcgacagactttccgttgacgggtcggtgctcgatccactctcccccaagccgtggggcgcgtccgacggccaagttgttgaccgtcacggactccactggcttgtcggttacgagcccgcgacatgagcgacgcccaattgcttacccagttggcgagcgagcgaagccatgttcttcgaacagtcgacggcctcgagaaccaggagatgcgccgaactctggttccgtccgggtggacaatgacgcagctgctcaaccatctggccttcgacgacgagatgttctggatatctgctgttctcggcggtgatgaccgggcgatcgccgaactccacaacggctgggcgtccgaaccgatgaccggtgccgaggccatcaacatctacaagcgtgaaattgctcgaagtgacgaggtcctctcgaagatcgacttggatgcgcctccccgctggtggcctccagccagcgtgttcgacgcaccaccgatgtccaatgggcgtgaggtggtgtttcgcgtgctggctgagacttccgtccacgcggggcacctggacatcgtccgggagctaatcgacggccaccagaatctcgtagtgggatagtcagaactgcggatgcttcagaccgccgcccgattaaagaacggctattttcaaactacagttacagttacccggactctttttgctggaaccactccgctaggtccgggaacctccggctcgtaacgagcggtcccggagtagtctcctgcggatgggtgtgattcaccgttatgaaccctctagtccctacgttttcggaagcggtcctttctttcgggccgctcgtcctactcctccttgctgccttgggcattgtttactactacgcctccagggcatacctaaatgtgaaatctaaggcttttctttcgggtgctcgtggaaagagcgcgccggaaaatcaccagaatctgaaataggccgcttttggttcaataaggccggcaaggatcccgcaatgagtggaatccttgccggctttgtgtgcgcgcaggggtcctcgagctggcgcgcaaacccgaccgtgatgcgctcactcgttggcgccaggggtatttcggtgtcgctacagaatgtgggtgtcgagcccgaatatgcgcagcgcaggcccaccgcggcccggctcccccggctcccctgctcccctgcggcccggctcccccggctacagtgaaggtttcgaagtggccctgggccacgtccggcaccggaaggaatcgatatggcaccgtcagtcattgttttcgacgtcaacgagacgctttccgatatgtcgcccctggctgaccggttcgcggacgtcggcgcaccggcccacctggccaagctgtggttcgccaccctgctgagggacgggttcgcgctcaccgccgccggggacaacggaagctttgccgggatcggcgccgaagctctgcgcggtgtgttgaacggcttggagctgaaccgggaagcggaggccgccgtccagcacatcatggccggcttctccgcccttggcctgcacccggacgtggtggacggcgtcaaaaccttgggtgctgcaggctaccgcctggtgaccctgacgaacggttccacggaggtggccgagaagctgttcgcggactcgggtatccgggacagcttcgagctcctgctgtccgtagaggacgccccttgctggaaacccgggaaggcttcctatgagtacgcggcctccgcctgcgggaccgcgcccggggagatgctcctggtggcagtccacccctgggacatccatggagccgcacgagccgggctagccaccgcgtggatcaaccgcgccggggaccgctatccggactacttccaggcaccggatcacaccgtatccgccctgccggagcttgcggctgtaagcctgtaaggggaaccccgttgccccgggcaaggatttagggcgcggtttacggacaccccttttgcccggcaggcgcctgccggtaacgcggcagtaacggctcgctgctctacttggcgatgggaggttgtgccgtgcccaggaaagccaagccggagaaacggaacccccggtacaagccggccaaatcacccaccggcggtgcgggggcgggaaagtccaagcgcacaactaaacctccctggcacaagcgcacctccacgttcatcattgccgcgggcgctctggcggccgcgatcctgggcgtgctgaacctctgggacaggatcttcccgccgccggacgacgacctggcccgcatcgaatccatccacatcatcaagcgcacaccgctgaccggctttgccccggaagggatcggcggactcctgcccctgaccgccgtccctgaggctgcctcggcggggcggatttacgacgacggcgggctggccggggcgggtttcgtcgaggcggagccgccggccggacgggacgcagtggccacgccacaattcacgggcctggaacagttcaccatgcgtcccctgcccaccgtacggcccgtcccgcggcccacgttcctgacgttcacgccaacgcccacccccacgacgcccactccgacgcagacgacggcgacgcccagtcccacgcccaccggcacctctacagggacagacagcccgtcaccaacactcagcaccacgcccgcaggcatccttaccgtcctccccgacccctcaatcatgctcctcgggcacgtcccgcccctgaccgatgaatacatccgggaagtgtccaaccaccttgagctgcgggacgtggctccccgcgccgtcgtatacatggcccactccttggtgatcgaaaccgtcgacgaaaagggcgaacctgttccgccggcacaggtggctgtgaggctggccgcggcgctggaggaggtggagtcgaccaccggcccgcagggcgaggatccgcagggttggaccgtggccgtcagggtagacctccagggactcgaggatgtccccctgctcctgacctggtccctggacggcctggatgtaccgctcacctggcaggccgaaaaactcgcttacagagtggtgggaggcacccctcacgatgcgggggtggccgagatctgggtgccggacctcagacgtgccggcacctacaatgtcaacatcaaactctcctacgaagccaccgggatcattgccgactggcgcccgctggccctgccggacacgggagttacacagggcggctgagtccgcgggcgccggcgctcagaggcgagcgccgggcttcaggcggcatagctttagggcagtgtccctgagcgtgcttggaagaaaaggtttcgtaagataagcggcagctccggccgccagacctgcgagcacgtcattttcctctgccctggacgtaaggaacagcagaggtgccgggcttagcttccgcagttcgaggcaaaggtcctgcccgtccatatccggcaaacccaagtccagggtgatgagggccagagtggaaccggctgcggcggctgcggctctgccctcggcccctgagccgaccgccactaccttgaacccggcgcgagtcaacacggcggtaatcagtccacggacatcagcgtcatcttcaatgaccaggcagacgtgctgttcttccactaagcgccccccggctccagttagttgcggcaagtttaaggctggccggcccggacagggctccaaggcggaaacatttcctccccgagacggactgtacaacaagctcagcattcgcggataacggccacgggtctgttctggacccgggtgagcttatctgccaccgcaccctccatagtcctgccgagtttggcgaggagacctggccggccgttcccgaccatgaccatgctggcgccagtgctcacaacaagccgcgccagcgccgtgctgacgtcgccgtgcagttcacggaaggaccaggctgttccgtcagggcccagaagaacggtgatgcgcgaacgtacctcgttggcagggtagagcgcttcctcattcacaacaggatctagcgaaagcgccgtacgtatccgctggggttcccattcggtgagaacactggacggatcaacataggcacaaacaaggtggatgtcgagagcagcggccagctctgcacccgtgcgtacgagcgccggcggtgccggccacgggacgccaagaatcagcggccctgcgtaagccatgaccacgcccaaactggcggagaagtgattggatgcattcatgctccctgacagcactcagcattcgtgctcccgcacgttgccctctccgaattcaagcacgcccggggccaccgcgccttcaaaaagtgaacctgccagtccgtattcaccggatgttcaccacgcacggctgccgcagctgttcaccatccgttcactcccgcagagtaacttcagccggtgaatgtttctgatctgactgaaccggcagggaagcaggcagcacacctgccgcagctgcccggtgccgggaaggctgcaccgccgcgcacccttgtccaggtttttgaggaagcagcccggcagttccctgacgcttcggccctcgacgacggcagggcctccctgagctacgcagacctccacgctgccgcaaaggcctatgcccggcgcctgcaccggaacgggatcggggccggcgacaaagtcgggatccgcatcccgtcaggcaccaacgaattgtacgtagccatcctcgccacgctgctggtgggtgcagcctacgttccggttgacgcggacgaccctgaagagcgggcggccctggtcttcgaagaagccggcgtggcagcggtcctccgcgccggtgagatcttcaccgttcccggcagggagagtcccttcccggcgccccggcaacccggggttgaggatgacgcctgggtcattttcacctccggttccacgggcaaacccaagggcgtggcggtgacgcaccggtcagccgccgccttcgttgacgccgaggccgggctgttccttccggacaaccccgtgaactcctcggaccgcgtcctggcgggactgtcggtcgccttcgatgcgtcctgcgaggagatgtggctggcatggcggaacggcgcctgcctggttcctgccccgcgttccctggtgcggaccgggatggatctgggcccgtggctgatcacgaacggaatcaccgtggtgtccaccgttccaaccctcgccggtctgtggcctgccgagtcgctggatgctgtcaggctcctgatcttcggcggcgaggcctgcccgccggagctggcctcgaggctcgcagtggacgaacgcgaggtctggaacacctacggtcccaccgaagccaccgtcgtcgcttgtgccgcacggatggacggatccgggccggtccggatcgggctgcccctggacgggtgggacctcgccgtggtggacgccgccggcgttcccgtggacgagggccagaccggggaactgatcatcggcggcgttggcctggcccgctacctggacccggccaaggacgccgaaaagtatgcccccatggacacgctgggatgggaccgcgcgtaccgcagcggggacctcgtgcggtacgagcctgaaggcctggtctttgtgggccgggccgatgaacaggtgaaactcggtgggcgccggatcgaactgggcgaaatcgacgccgcgctgcagtccctgcccggcatccagggcgcggctgccgcggtccaggccaccgctgccggaaaccagatcctcgtggggtacctggcgccggcgccgggtacttcccccgaccttgaccagttgcgaaccctgctggccgcccaactgcccgcagccctgattccgctgctggccgtcgtcgacagcctcccggtgaaaaccagcgggaaagtggaccgccaggcgctgccatggccgctcgcgcaggcgtccgcgggtgaagccgtggcgccggacctggacgcgccatcagcctggatcgctgatcagtgggcggccgtcctggggacgccaccggacagcctggacgccgatttcttcgcctacggtggcagcagcctggccgccgcccggctggtctccgccctccgggtgcgctaccccaccatcaccgtggccgacgtgtacgcccgtccgcggcttggtgcactgatcgatcttgcccggctttcatcgcccgacggcggcatggcggcttccgtgcggatggaacgttcagtgcggcctaccgcccggaaatcgcaggtcttccagctcgtggccgggctgccgctgcacgtgctggtggcaatgcgctggctgacgtacctgatggccatcaacaacatcctcgccgcgtggggtgtcttgagcggggccccgacagtgtcctggtggtgggtgctggtgtcctggctggtgtttgtgaatccgctgggccggatggccatctccgtggcggcggcgcgcctgcttctccgtggagtggttcccggcagttatccgcggtccgggaaggtgcacctgaggctgtggctggcagaacagatcgcggacttgtccggggccgtcagcctggccggtgccccctgggttccgtactacgcccgggcattgggcgccaaagtaggcaaggacgttgaccttcattccgtcccgcccgtgaccggcatgctgagccttggaacgggctgctcgatcgaacccgaggtggacctttcgggctggtggatcgacggcgacctggtccatatcggacatgtccgggttggcccgggcgcgaccgtcggctcgcggagcaccctgatgccgggcgcgcgcatcggtgccggagcggaagttgccccgggctcggccgtcctgggcaagctcaaggcgaaccagcgctttgcgggctcgcccgcccagcgcctcggcaaggcacagggcagtacgtgccgccgcgcgcggctgaaatcggtgctcgcgtttggcgcctacgcgctcgccgcggcagccctggcgctcatccccttcgtctccgcagcactcggcgccctcccggtgatcgccgccgtccggggccaggacaccctgttcgcctcgtggccggtgctgctgtgggctgtccctgctgccgccgtcgtctggttcctgtccaacatggtcctgacggccgccgtcgtccgcctgctcggcctgggactccgcgaaggccactaccgcgtgcgcagcttcaccggctggcgggtgtgggccaccgaacgtgtcctggacatggcccgggacctgcttttcccgctctacgcaagcctgttcacgccggtctggctgcggctgctgggggccaaggtgggccgcaacgttgaggcgtccaccgtactcctgctgccctccatgacgacggtgggcgacggcgcgttcctggccgatgacaccatgattgcctcctacgagctcggcggcgggtggatgaggatcgctccggccaagatcggtaaacgggcgttcctggggaattcgggcatgaccggggcaggccgcagcgtgcccaagaactcgctggtggctgtgctgtccgcgacgccggcgaaagcgaaatcggggacatcctggctgggcagcccaccggtgcgcctccgccgcgcacggatggaggttgaccagagcctgacctatgaccctccgctgaggctgaaaatctaccgcacctgctgggaactgtgccgtgctgttcccgtcatcctcaccgcagccatcgccgtcgccatacttgccgtcctggactggatcgccggaaccgccggatatgccgccgccgccctgctcggcgcgcccgtggtgctggcggccggggctgttgccgcggcaagctcggtagcggccaagtgggttcttgtggggaagatcgatgcacgggagcaccccctgtggagctcatttatctggcgcaacgaggtggtggacaccttcatcgagatggtcacggcgccgtggttcgcacgcgctgccgcgggcacccctgcgcttgtgtggtggctgcgtggcctcggtgccaagattggctccggcgcatggtgcgaaagctactggctgcccgaggcggacctggtcacgctgggtgagaactccaccgttaaccgcggctgcgtcatccagacccacctcttccacgaccgggtgatgagcatcgacaccgttacgcttgaagccggggcaaccatgggcccgcacggagtgattttgcctgcagcccggattggtgccggcggtacagtgggtccggcatcgcttgtgatgcgtggcgagaccgttccggcggccagctactggatcgggaatccggtcagcccatgggcttccccggccgcagccgttcccgcccgagaggcccagctacagtgaccgcacaccaggagcacgtaccaggcgggcagcggacagccgtcccctgcagtccgctgcccgattcctacactccggggcacggatccgcagactacggggtttcccgctacgagctgtacctcgactaccgcgtctccaccaacaggctttccggccacgccgccatcacagcacgctcccacgttgagctggcaacgatcatgctgaacctggccgggctgcgggtactgaaggttcaactggacgggcagcgcgtccagagattcagtcagcgggggcaccagctcttcattgttcccgcccgcccggtgcccgccggcagcgacttcagcctggacatccggtacgagggctcccccggtccgctgcgcggcaactggggcgaagtgggctgggaagagctcaccgacggggtgcttgtggccgggcagcccaccggcgcgccgtcgtggtttccctgcaatgaccatcccagccagaaagccagcttcggatacaccatcaccacggaggccaactacagggtggtctgcaacggtgtgctggtctcgcgccatgccaaggccagccgcgaaacctgggtgtttgaacagcccgagcccatggccacttacctggctacggtgcagatcggccgctacgaccttcagcccctggccgtccagccccaccttccggcccaccgcgcgggcaccgcggacgacggcggccagcgtccggtcccgcaatccgtggcggcacccccggccctcatggccaccgccgctgccgccctcggccggcagggccagatgatggagacgttcgagacctgcttcggcccgtacccctttgccagttacaccgtggtggtggctgacgacgatctcgaaatccccctggaagcgcagtcgctgtctgttttcggcccgaaccatctcaatcagcaatgggagtcccaacggctcattgcccatgaacttgcccatcagtggttcggaaactccctgaccgccaccgcctgggctgacatctggctgcatgagggattcgcctgctacgccgagtggatctggtccgaggcttcaggaaacaccacggcccaccagaggtcacgtgcggcctggcaactgctttcatcccaggcgcaggatcttctggtgggtgacccctcaccggagctgatgttcgatgaccgcgtctacaaacgcggcgctcttgccctccatgccctgcggcgagccacaggtgatgtgctgttcttcgagctcctaaaaacctggacacaccggtaccgtttcggcggcgtcacaacagctgacttcgtggacactgccaaccaggcatgcatcgaactgcccggattcgacgcgcgcgctgtgttggacccctggctctaccagtcagcactccccccgctcccgtgacgccggcagatcagggcctctcgctggcagccgtgcggttgtccagcgtggacctgggcctgtcgcatgtcctggatgaggcggagctggccagggcttcgacgttccgttcccccgccctgcgggacgccttcctggccggccggatagcgctgcgcctccacatcagtgcgctgaccggggacagccccgggtcgctcgaagcagactatttctgtcccacctgccgcagcggccggggacacgggatcccccggtatcggctcccttcccaatccggccttcttcgcgccagcctcagcaggtccgggagctggtgccttagtgccgccgccctggaccgccggagcgccggtattggggtggacatcgagaacgggtccgcagcagacttcgacggattcccgtcgcttgtgctgaccgagaatgagcgcggccagctgcaaagagtgccgcccgcgctgaaggccagattccagacccgcctttgggtccgtaaggaagccgtcctcaaggcactcggtacgggcctggcaaaggccccctccctggttgatgtgtccggatcaactccctccgggcttcctcgaacttctgagccggcactgtggagtctcgaggacatcagccccgccagtcttggtcttccggaggacttcgctgcctcaatcgctacctggcaaccccgcgacgtccttccggattagcgggcgcgctgaagggtgtggttctttacctccgcggtgatgcgtcgcgccagctggacggtggggtccctccagctgccagccggcggcccccggggaggaagcgcccaatccctggctgggcggccggagagggaatgcggagaatgtggagttctgacacgtcgacaagacacctggcaccggtcaccgtgtccagaatccacaacaggccacactgcggaatcgcatccacgatcggcccgcgatggaccagccggccgttgcggtacgcttccacggcatcgcccggacgcagttccttggataggccggcagccggcaggccatcacgcgttgtcatgcctggtggctgtcccgggccatgagcatctcggtcagctggcgcggagtggcgcgggcggccgcgagggccacgatggccagcggcgggaccgcgacgaggaatgcgacgaggaccgcgacggcggcctcaacggttgctgcatccatcgcgttattccttccgcttggattggttgtgatcggtgcggctgcctggccgtccctatctcgctgcaggactcccccggcttccatcctgccgccacaaggttgactgcaggtgtcctcaggatgatctttgcctgatgtttattgcctcgctcagatgcgcgcacggccccgcgcggtcctgcgtccgttacttacgagcaagagcgttgccggattcgttgcgttaagtgagagagcgtcctggggggcggggtgaagtggcgtccatcagccagcgtttcacctcctccagcagctccagcatgtgccgcactaagcccataaacgcgccgcccgccctccacgtgggagggcgggcggcgcgatctatgaatcacatccgaggatcagcggggatccccggaggtaactttttagcggcgggtgcggccgtcgccgtcgagctctatttcttccttgcgcacctcttcggtgaccgtgcgctcatcggtaacggtgtccttgtccaggcgcacgcgctccacggggaccgtttccttttccacgacggggcgctcctcgtggaggatgacctcgtgctcttcctcgctgatggcggggccgtccagggcgtcgccacggttggcatccgtgatgggctcgcgctccaggcggacctcttcacgctggaccgggaccgtcttggtgacgttctcggtgacaacatacttgcgcaggcgggcgcggccggtgacttcgcgctcggtgcccacgtgcagcttctcctccgagcgggtcatggcgtcatcggtggtgggacctgaggtgtcgtgtccaaccgtgccgcgagcatcggtgtcaacggtggtgtcccgatcggtggcgtccgtgtcccggccggtgccggtgaatcctgcggtgccgtggacgccgtagtaggagtagaggcgctcttcctcttccggctccaggtggccgtccggggcgacgcgcggtgcgtccttcaccttgtccttggtgtgcgcaatgacaatgtcgtcgccgtcctgggttgccgaatccagcggggcgaaggactcgtgggtgccgaagagcccggtcttgacggtgacccaggtgggctcacccgtttggtcgtccacgtagatctggcctacggagccgatcttgctgccgtcggagcttacgacgtttccgccggcggtggtcaatgcggaaaggttctcggtgctgatcatgtgtttctccttctgatactgcgtgagtgctgttcgagggacaaatttaggagcggttccgcggcggccgggcctgctcggtggcgcggagttgtttggccgcacgggcctttttcaccttgttgatgatggtggggaggaaaaataaaaacagtcgcttcatgacgatcgtcctttcgaggatggttctgcgttttcgctgatgtcagctttgacggattaaggccggcgctctgctccacgggcttcgctgaaaggatcatccagatccttgagcgggacgccgcctgtttcagtgccggagtaggcgggccgtgccggctccccgtaaatggtctcgccgtaggttgcgggcgtggccacctgttcctggtagaccggctcaccaccccagggcggagcggccggcgcctgtgccgggcggggcgggattgctcctgcggcctgcggggcgccggcctggagtccccgtgcgagccggcccgcgaggaggcctgcgcccgcagagaggagcaggaacgttccgggtttgcggcgggcgaacgactgtacgtcattcaaaagggttccggggtccttgccttcaatccaggaagcggccgaggacgtgcgctcggcagcctgccggaccaggtcactggccaggccctgctgttcgggcgcatccgccatggagcgcagttggctggagagggtccggacgccctccgcggctttctgctgctgtgcgccggcttggctgttgaggccggcctttgcctggcgcaggacgtcctgggcgccggatttcgcctcggacgctacgtttccggcctcctgcttggcagcctggaccacattctgggccccaccggccgcctgcccggcaaccttcgacgcttcctgcctggctgcatccttttttgacgccgagctcaccggctctgccgcggactccgtgggtgctgcgttgccgtactggtcgagggggctgcgggcaggagcctggggcttctggttgtccgtcatcatcactcgctttcgttgggggcaactggtctcacgaacccagcatgtcgagatagtaagtatggttactaactaaatagtaagcacacttgctatctgcagcgcaaggcgtacccggccgcgctcctggattagggtgggccacttaggtgcgaaacgccgtcgtgcgtcccggcagtccgcccggccgccggccccgaaccaccggtggcactcactgcagaccaaagcagactaaagcaaaggacgaacaatggctgacctcaccgcatttgccctgatttgctccctgaccccctccccggcgccgtcaagcagcgagctcatggcccgccacgtgctggacgagctggccacccacggcgtgagcgggacgtcgctgcgggtggtggaccacaacgtgatgcccggcgtccaggtggacatgggcgagggcgacgcctggccgggcatccgggacaggatcctgtcggccgacatcctggtaatcgccacgcccatctggatggggcacccgagcagcatcgcccagcgggtcatggaacggctcgatgcggacctcgccgaaacggacaacgaaggccggcccatcatgtacgggaaggtggcggttgtggccgtggtgggcaacgaggacggcgcccacaagaccgtggcggacacgcagcagggcctgaacgacgtcggcttcaccctcccggcccagggcgccacgtactgggtgggcgaggccatgcagaccgtggactacaaggacctcaaggccgtgcccgagaaggtggccgccaccaccgccggtgccgcccgcaacgccgcgcacctggcccgtttcctccgcacgtcgcagtatcccgcgggttagggggtccgcgtcggccctttcgctacgggcggcggcctcgggcttagcgggaagccaggaggaacggtgctgccgcctcagccatcttttggtgctcgtgggccgcccccggaaccaccatcaggccccaattgaactcatcgctttcccgggcggcgtccctggaggcctggtaaaagttcagtccccggctaagcctgttgtctccttgggcatcggtcttccggtctcgttgcagaagtgtgtcctccggatcgacgtcgtcggcacccagcagaatgacgaggcgccgcgaaaaggcctccctcaactcccttggggaaagcggcgagttcttcagtccgtgcgggaattcgacatcctggtccggcattgtgtaccagccggcgtttgctgcgacggcaacccggacatggttttcctcggtgaactccataaagcggtgcacgaactggccgccagctgagtgcccgaaaagggcgtaatctttttctccgctgtttgtatccctaaccacggcttcgaagagggcttcgaccatgttgaaggtccaggcctcgggcgggttcacatcgccgctggcatccaggatattgccttggttataggaggacgatccggggtaatcatctttgggaaattcgagaacaagcagcaacacgttgcggtcttgcactatcggtagccaatcttcccgatagccttccccattacggtgggcccctgtcataaccagcaggatttgggcagaggacggatcgtccggcgcggaataccaaacgcggatgggttggtcggcgaggggcccctcccatgaaaaggaaaaatccccttctgtgcctgggctgatttttcttgtttgagtgctggtagtaccggaacttggcatgttgtccccctgcatgttgtcgccttgctcggattcttttggttcttggcgcgcttctcctggcacgaaggtgcaggaagccagtagtgcaaccactaccaggacccatgacaccagcacaatcggatgcctcttgccacgcatgggctgcacagggggtagggtcattccggcggctcgaggcaacggcatggcatcctcgctacatcgccttggatttgcagcgctggattgattgccgacatcacacccaccatttgcggggcggaacacagctgagtgaggaacccattgacgcggttatccgtcacgatgcacttgactgccagttgggtaggcccgtctcgactcagctcgaggctaagcatgagcccgacaccttgcatgccgaacgacgcgtagcggccccgcgtgccgaaaacgaagttgccgagaccgtaggccactgggacatcaccaatgaactcgattttctctgcgatgtgggatcctgccccgacaatgacgtcatatccggcatcaaccagcacttgtgcccaatatcgctgctgcggtgttgtgtcggtgtagttgtccccccagtgcacgtatccgaccacccagtcagctccagcagcgcgggcaaggtcatacccgcgctgcactgcttcagggctgaaaaccacggtgccggggctgacgtcgtccgccttggataacttgccgaagttttcgccgatggccaccacgccaatggtgccgacatcggtgcgcagcatcaacggccgctcagcctcggccaggttgttcccggcaccaaaactggccatttctgcattgcgggcatattttatggtgtcttgaagcccggcgagccccatgtccattgagtggttgttgcccagactgatcgcgtcaacacctgccttggacaacgcccaggccgcctgcggcgctacccggtgtgagaaggttttccctgggatcaatggttggtcgctaaacgtcatcgggccttctgcgttggcgatgacaaagtctccatcaaacaaaggcgccacccccgccagagcagcgtcaagtgcgagcgggtccagcgttcgggtttccccgttacccagcatggtgtctcccacgaactggacagaccactttccctcagaggggttgccggcccacacatcgatggactgaacggccggggtctgtcttcccccataattggctgctatggcgcctgtaccaccaagtgcgacggccagggccgtgaggatgaggagcctgtcgcgtgttttcggtttcatcggacgtcgttttctgggccgggggcttggctgagtgtcgcttggcgggtgccgtcgagtgtggcgatggtgggtgctgatggcagcgccggaaggttactttcgagccaaacccggtcccggtactcttccccgcttatcacttcggcaatggtgcctttcgacaagaccactattctgtccgccaaggtgagctcctggggatcctgcgtggccaggagtacggtgccgtcgaaccttctcagcatggtggcgaacatctgcttggctgctgtgtccaggccgagggtgggctcgtccagaagcaggatgggagggttgcccatcagtgaccgggcgagcgctatccgttgccgctggcttttggacaggttgagtccgccttcggaaacccacgtttgcatcccatacggcaagtcggcgagcatttcgtccaagccggtggcggccagcacgcgctctacgtcttcttctgacgcgcggggggcggcgtaggtgaggttccgccacagcgttccgcgcatcagcggcagttcagggcccacggccccaatccattgggcggcagaccggagagaggtattcgccaggacttggcggtcgacgatgatgcaaccttgatcaggatcgatggttctggacaccagcccgagcagggacgatttgccgctcccgccgtctccggttacagcaaccagttcccccgctctaacgcgcaaattcacgtcgtggagggacccgttcaccgttactgaggagaactcgatggcgccctgccggaccttcaggggaccgtggccaccgctgtccatgtctctgctggtactgcgcaggtactcctggattttgcccacagagacctgggcgcggtgccagtagtcgtgggccagcccgagggtacgcactgggctggagagctgccgggtgacaacaacgaaggcaatcacggttccgatgctcgccgtaccttgccggacttcgaacagacccgcggtaagaacggctccaagagcgagtagcgaaaaagcggttgcgacgccgcggagatagcctcgtaggcgggcaaccctgatgagggcacgagtgagttcgtcgttctggtgtgaaaggcgtgcgtattctcctgctgagcgcccaaacacctgcaccacaggttgggcgttcatttgttcgtcgagattgctcataacaagcgaccgccgacggcgcatgatccgggttgcctggcgcatgcgttgtccggctaccaaggaggccgcggccccggcggatattgccgccacgatggcgagcgacatccagaagctgaagaagaaaagtaccgtcagggtgccaaccaggaccagggcggcgatcagtccgccgagcaccccgcggctgatccacattctggtcattgagagatcaccaagaaagcgcagaagcaggcctccccgggccctgccctggaactgccggggtgtcattccctgcaggtgcttgtacatcatcatccgcaggtcccggaccacgttgtagcctgctgtctcggcaacgttgaagccaagcgcccggagccagccgtggagcaaggcgacagcgcccagaagggcagcctgggccaacgcccagcgccactgcagatccgccgcttcaccaacggtgaccggctccaaattatcaacgatgccgcgcagcagcagtatgtaggccaccaaggtgagaacctgcgccagcccgattgcaatgattttcgcgaagacggctggaggaatccggtacagcctattcttgccggccacggggttcaccaggcgtccggactgcccgagggggtagccggccgggggaacccgaaaacactgcgtttcggttctgcccactcgggcgttgcaacgaacgggccgatcaggacgtcgcttgcggcgctggcttgttgcacttcgccggcggcctgggtgtccgtcttggcggcgttcgccaggacatccggtattcgaaggagcgacgccgccaatgcagggtccgtgagttcttcacgggtcagcacagggagccccgtggctgccgcggcttcccggatcgccaggggtgaccgggtgagcaacccggtcacagccaggacatcgtgtcccagcttcttcaggtgggagacgccagccatggcacccatggagtccggagcagcgaaaataacggcgtccaccattgctcgaaaaaccgccgaatccagcaaacgggaggtttcatcctgatagatcccatccgcgatctcgacaagattcagggcggcaccggaatcagtgaggtggtccaccaactcaccgaatttggcctccaccacctccatcggctgacggtatgtcgaggccaaccccacgtccgtgaagtccagcatcacatgggcgccggcatccagcatgcaccagtagtcgttgccggagcccgtaccggttgctttcgtagcccccacgcggacaccgactctgctaaatccgttaaccaggcagtggacagtggttgtcttacctgaattcatcgcagttccgatgattgcaacggttcggggccgcggcacctgcggggacacgggcggcagggaaaagtcccaaatgttcagtggccggcccttggcgtcgcccaggagtcccaaaggttctatttccgtagccctccggacagccagactgcggcttagcacttcggaggcgatacctcccgaggccaccagctgggcgttgcccagtgttgcgggcacctgtgcttcaaattggtccgtggcgtacctgtccccgtacgtgacgatgatttcgtcgtcgtcgtgcaacactgcacggcgtccgttcggctgctcaatatgacggtgatgacccaactgcacaatgcgagccagcaccatgtccccggaccggggacggactgctccggaaaccagggaagctatggcctccggaggtacccggcgggtagtaaacgccgctttggctctcgccacacgttgcgcgtccaggggcttgacccacactcttcggtctgctctcatatttcgcaccgtacgccgggaaaaatgcacggggaatagcgcggggtacccgaccttgcaattaggtattactgggaagcgttcgtgagagagaccggtcctggatacccacagttgcccccaggaacgccctgagcttttctgccatcggtttggactccgtatggtgcaggtagtgaccgcccgcaacggtgacaatctcgtgccggctgacgttttccagcaggttttgggctgatgacactttggcggctgtggagtcggagctttcgtcggcgatgaaggccaggaccggcaggtcaccgggataggtgacgcccctcagcgaagcggcgttgttcgcgatccgggctgcctcatccgcgacggccggattgccgaagttccagttggccatcaggcgcatgcggttcagctcatcctcggtgtaggcgccgccgtccgggtccaccaggcccggcgccaggaaggtcacggcccgcacgatgcccgtgacggccagggcgcgctcccaattaacgcctggctggggctcttcaacggactctggcccgggtttcggtatggtcgcgtcaatgccgaccaccgcggatacttccgcctggtaccggttggcgtagtcaagcatgtagaagccggcgatggagtgcccgaccaggacgtacggctgcctgacctggagcctggccaggacttcgtgcagttcggtactgatgttttcattggtccgcggaggaccttccatgtcgctgtatccgtacccaaacccctcaacaacgatgacgtcgaagccgcccaactcccggaccagcggcgcaaagtcaaggcccggagccgcggtgcccagtccgctgaggaggacaatcggctgcccctctcccccgttccgggacacgttcagggcaccgccgccaaccgggacccgttcgccgtaggcaggaatactcgacttctccgcccgctccatggccgcgttgaccgccgtcgacaccagaagcagccccagtgccaccagcatggcgacgccaaaacggcgcaaccggcgccggggcttcttccggggcctggagtccgtgatgtcccgtgccccggaagtccttctaccagggacgcgcacagccgcccggcatcaggcaggcttggcgaaggtggctgcgctcatgacctcgtagcccacgaacgcctcgtcaccctcaacccacgcgtcgtggccggccgggatggtgtacgcgtggccggggctgaccgtggcccgcgatccatccgccatttccacggtcagcgttccggcggtgcagatccccacatggttcacctggcacgtgtccgtgttgaccacagtcttaacggtttcagaccaccgccatcccggctcaaaggtgaacctgccgagcgttgtgtcaccgagcgtcaccacatccacctgggtcttgggcgggcggcgtttttcatcgggctggtcgaacgatttggcttccagggcgttgacggtcatttccttctcctgacaggaaagggcgtgggaactatgcatccggagcgcccagacagctccgggtttcggttggcgggcctgcggtgggccgcggccgccgaccactggcgcccagcgctatcagcgtgcgcccgcgggtgggccgtgtcaatatgtcctgccaccggcgatcgcggctaggcttccgggatgggactcatcatcacactgcttattatctggctcgttctgtccatcctgggcttcgttatcgagggtctgctgtggctggccctgatcggcctggtgctgttcgccgccaccgccgtttggggctgggtaaagcgcaaagccaaggcctgacccactccggcggcgctcacctgaagtgaggcgccgtcgtcgtgcgttcctgcccggttgctttccggggcaccctagcggcgcgccgcgcacgacggcgtgtcccggcccgggagggcagccggcccccgaccaactgggcaggaccgcacggcagcccgggcccgcacgcgcctcgccagcaatcccgcgccggccgggctgctgctgcgcctgccttgataccttgagggcatcatgtttaccttcgaccagctggccgcgttcatcgctgtggcagaggaactccacttcggacgggcagccgagcgcctcaacatgacccagccgccgctgagccggcagatccaaaagctggaacggattgtgggcacggaactcctggaacgcgacaacaggaaggtccagctcacccctgccggcctggcgttcctggatgaggcacggcggctgctcaccctggccgggcgggctcccgccaccgcccggcggatcgcctccggccgctccggcatcctgcggatcgggttcaccgcagccagcggctacagcgtcctgggccccctgctggagcagatttcgggcattgttccggacgtggacatcgagctgcaggagctggtgaccggcgagcagctggacggcctcctcaccggtgaactggacctgggcctggcccggccgccgtttaatgcccggacgttcgattcccggctgctgtcccgtgaatccatggtgttggccgttccgtccggccacccgctggcagcgctggaccggaatattgggccggacgatttcgcccacgaggccttgatcatgcactccccaacacaggcacgctacttttatgacctggtggtccggctcctccccatcgaccacggcaacgtggtgcacaccgtcagccagatcgtcaccatggtgtcgctggtggcggcgaagcgcggggtggcgttcgttccggaatcggccaccgcactgggcatcgccggagttaagttccttcccctgtccacgggctccaccgggcaggtggagctgcacgcgctgtggaaccgccgcgtcagcaatccggcactcggcctgctcctacaaaacctggagttcaaagcggcctgacggcccgggctggccatgccctgaaggtatcgctgcatccagaaatactcttggacaggtatggagacccgtccctagtgtggaaggaattcagcacgctgcccgcaggcggcacaggaaccggaggaccaccatggcacgctacacaccgcaggaactggcaagcaccctcaaagaagggctgctttccttcccggtcacgtccttcgacgcggacctgcagttcgatgaagaaaactacaggaagcaccttgcctggcaggccagtttcccggtggcgggcctgttcgccgccggcggcacgggcgaaggcttttccctcactccggcggagtccgagcgcgtggtgcgcaccgccgtcgacgaagtgggcgccacggttccggtgctggcatcagccggcggctccaccgcccaggccatcgccaacgcccaggctgccgaggcagcaggcgccgaaggcatcctcctcctcccgccgtacctcaccgaagcggaccaggccggactcaccgagcacgtcagcgccatctgccgcgccacctcgctgggcgtgatcatctacaaccgcgccaacgccatctacaaggacaccaccgtggccacgctggccagccgccacgagaacctgatcggcttcaaggatggcgtgggcgacctcgagcacgacgcccgcgtctacgccaagctcggcgaccggctcttctacctgggcgggcttcccaccgcggagaccttcgcccttcctctgctgcagctggggatgagcacgtactccagcgccatgtacaactttgtcccgcagttcgcgctggacttctaccaggacgtccgcaacaacgaccgcaccgccgtgaacaggaagctcaacgacttcgtcatcccctacctggacatccgcgaccgcgtgaagggctactccgtgtccatcgtcaagggcggcctggacgcggtgggccgctccgccggaccggtccgtcctccgctgcagaacctggcggcgcaggacctcgcggacctcacggcgctcatcgccaccgtctcctgaacagcccttcctgaccacacctaggagaaaccatcgtgaccctcaccggacattccctgatcgccgggcgaaccgttaccggaagcggcaaaaccgctttcggcgtcaacccggccaccaacgaacaacttgaccccgcctactcgctgatcaccgaagagcagttgacgacggcgacctccgccgccgctgctgcctacccgtccttcagcacactggaccccgggacgcatgccgcgttcctggacgccatcgcggacaacatcgaggccatcggcgaggaactcgtcatccgcgccggccaggaaaccggccttcccgcagcccggctgcagggcgaacgggcccgcaccaccggccagctgcggctcttcgcgaacgtggtccggcagggtgacttccgcggcgtccggatcgaccccgcactgccggaccggaccccgctgccgcgcgccgacatccggcagcgccagattcctctgggcccggtggccgtgttcggcgccagcaacttcccgctggccttctcgacggcgggcggggacacggcctcggctctcgccgcggggtgcccggtggtcttcaaggcacacaacgcgcacccgggaacgggcgaactcgtgggccaggccgtggtcaaagccgtcaaggacttcggcctgcaccccggagtgttctccttggtatacggccccggtgccagcatcggccaggccctggtggccgatccgcacatcaaggccgtgggcttcaccggctcccggtccgccggcgtcgccctgatgcgcaccgccgccgcccgccgggaacccattccggtgtacgcggaaatgtcctccctgaacccggtgttcgtgttcgagggcgcgctcaacggctccgccgaaaagatcgatgccctcgcccagcagtacgtcaccgcggttaccggaagctcgggccagctctgcacctcccccggcctgctgttcgcccccgaaggcgaggcgggggacaaacttgccgccgccgtcgcacgcgccgtctcaggctgcgccgggcagaccatgctcaccgaaggcatcgccgggtcctggcatgccggaagccgggcactcggctcagcggacggcgtcgaactcctcggccaaggtacggaaggcacggcagagaacgcgcccgcccccgcgatcttcgggacccgggtgcaggacttcgtgaccaaccacgtcctgcacgaggaaatcttcggcgcagcgtccctggtgatccgctacggctccattgaagagctgctccaggctgccgggcgtatggaaggccagctcacggcgtcgctgcagctcaccgaagaggactatccgacggcggcgcccctgatcccggccctggaacagaaggtgggccgcatcattgtcaacggctggcccaccggtgtggaagttggccacgcgatggtgcacggcggcccgttccccgcaacgtcggacagccgcagcacgtccgtgggcacgctggcgatcaaccgcttcctgcgccccgtggcctaccagaacctgccccaggaactgcttccggcgccgctgcaggacgagaacccgtggggcctgaaccggcgcattgacggcaccagcgtcccggccagcgtcccggctggcagctaaaccgtccgggtttaaggcggccggcaccgttagcggatgccggccgcccgcagggtcctggccagctcggcggccgccgactcgagggcggcaacagtgctgcggaggacttcttccgtggcaagctccgtggggatggagcagctcatggcatcggtgccagggatccggtacggaaccaccacgctgacgcagcaaagccccactgtgttctgctcccattcgacggagtggcccgtcttccggaactcggccagttcgcgtttcagcgcgtcaaaatcctgcacggagttcggtgtgagctggacgtagggcccgtcaccgatgcgctgccggacctccgcatccgtgtattcggagaggatggccttccccagggcggtcacttgggcgggcagcttgcggcccacccgggaggacagccggcggcggtcaacggcctgccgcgtggccaggtagatgacatccgagcggtccagccgggcatagtgggtggtgaacgtggtggcgttgcggaccttctccaggacagcggacacatgctccatcaccggatccctgtccaggtaggccgtgccgcacagcagcgcgtgggtgccgatgcggtatgcgccctcgggcgtctgctcgatccagttgagctccagcagcgtcagcagcagccagtgcaggctggaccgggggtagccggtcagcttaaagatctctgccgtggtgagcggctgcggcgcaccggccaggagctccaggatggctatggtccgctccgccgatttgaccagctttacgtcccccgatgcgctaacgcccgggccggactgtacctccaccgccgccatcaccgttcccccttctgccactgccccggcctgcagcatgtcacttcgcggccaggtgcgggtagttgtctactcccaccctatggctatcgcttgcccaggcgccgcccaaaagttccgcccgttcgtcccgtgccgtggtgtccaggccgccggcgaaggcctcggcatcatcctgcggttcgaatccaatgcgcttcccggcttccaggtttgcccagccccgggtgttggccgagacggcccacaccacgtggtgcccgggggcgccgaggttgttcagggtggcctccaccaggcggaaggagtcagcgggcgagagccaggatccaagcgtgcggaggtttccgggccgttcacctccggtgccgatgcgagcgctgaccaccttcatgccgtatttgtccgcatacaggcttcccagcgcctccacggctgccttgctgacgccgtagtaggtgtccgggcggggaatcagcaccgaatcctgcgctgccgtttcggtggggtggaagcctacggcgtgcgtggaactggccagaaggacacgttcgacgccgttctgccgggcagcttccagcgtcacctgggtgccggtgatgttggtggacaccagttccgcccacgttttctcgcggtgcagcccgcccaggtggatgacagccgtggcccccttgagggcgtccgccatgaagtccggatccgtcactgaccccacctgcacggactcattgggacggggatcctgcgctgccgccaggtccagcagccggaccgcgtagccggccccggcaaggtagggccgcagcagtgtggccatcattccggcgccgcccgtaagcgcgattgtcacgggggttactgctgcactcaattttcctccgacggttgacagcctgtgatcctaatcatactctcatgaagtacgtttcatatggtaacagcattttatatatgtaaaaagaggagaatcagggtggattccaagttcaagtcgtactcccgcgcaacactggcaatggccgttgcctccgcggccatgctcaccggctgcagcgccggctcatcaacgccggcagccactgacgacggtcaacccatcgaggtctgggctcgcgccggcaccgatgccgccaccacctacgccgccatgttcaaggaattcaccgccaagacgggcgttgaggtcaacttccagggcgtgccggacctggaccagcagctgcagacccgcgcagcgtccaagaagctcccggacatcgtgatcaacgattccgccgccctgggcaactacacggcgcagggctacctggtggaggtggacaagtccacggttgagggcaacgacaaaattgccgattccctctgggacgaggccaagggcctggacggcgccacctacggcgtcccgttctcccggcagaccatggtgaccatgatccgcaaggactggcgcgaaaagctgggcctgccggtacccgagacccaggaggacctggagaagctcgccaccgcctttgccacccaggaccccgacggcaacggccaggcggacacctacggcatgaccgtccccggctccaccgagcgcggctacctgggctggtgggcctcctcctacctgtggcagaacggcggcgcctacctcaaggacgaaggcgaggggaagttcgcggccaacgcttccagcaccgaggcacaggaaggcgtcacctggatcaagaagcagttctgcacccccggcaacacgcagccgggcgccctcacagcggccaccagcgttgcctcgcccttcttccagaccggcaagaccggcatcatcctcaccggcccgtacaacttctcctcctttgacacgtccctgggtaaggacgtctacgaggtcatcgaggccccgaagggttccgtggacaacaccgtcctggccgaaggcgaaaacatctacgtcacggccagcaacggcaagcccgagcagaccaagcaggtcatcgactacctggtgtccgcagacggccagaaggcaggcatgacggcgggcaagcagccgatcgtccgcgtaccggtcaacggcgacgttgatgccgccgccgtctacaacgatccccgctgggccgtggtccaggacgccctgcaggactcctccaaggcattcccgtcagcgatcaacttcgtgcccatcaagcaggttgctgccgaggccctgaacaagatcgtctccgactgcggcgcagacaacgtggaatcaggcctgcaggccctggataccgccatcaacgacgagctgacgagccagaacgccaagtcatgacttcagcagcaacaaaaccggcggtaacgccggtccaggccaagcggtccagcccgcccccgcgccgcaggaaaggcaaccgggcacatctcctggccgtctgggtgttccttcttcccgcggctgtcctggccctctacttcaaattcatccccatggtggagggaatccggctgagcctcttcaaggtccagcccttcctgggcgacgtctttgttggcttcgacaactacgtcagcgtcctgaccgatgcccgcttcatggacgccctgggccacaccgtgatcctgggcgtcacccagaccatgggcgccctggtggtgggcttcgtcctggccctcctcctggagggccaggcgaagtccctgtggttcctgcgcaccgccatcttcctgcccgtggtcacggcgcttgccgtagtgggtgaaatctggcgcatcctctacttccccaccgccgacgggccgctgaacaccatcctcagctgggtgggcctggggccgctccagttcctgaacggcacggacacggcactgtggtccatcgccgtcgtgggcatctggagcggcgccccgtacaacatggtgatcatcctggccggcctggccggcattgaccgcgccctgtacgaatcggccggcgtggacggcgccacggtctggcagcgcctgcgctacatcaccctgccggcgctgcgtccggcaatcgtgatcgtcctgacgctggccgccatccgaagcctccgcagcttcacggaagtgtatgtgctcaccggcggcggcccggccggatccaccgaggtgtggatgacccgcatgtattcgctgggcttccagcgcaacgacatcggcgtggcctccgccgcggccgtgctgctgctggtggtcacgctcctgctgacagtgggcacccagctcgtggcccgaaggaaggcagaacgatgagccacaccacaacccggacgtcgccgcggaccaagcggccgtcgtcgtcctcccgtttcgactcagccctgggctggtcccccggctttggcaccaacatggtgctgcgcatcgtgctgtgcgtcctggtgttctgcatcttcgcgctgccgttcgccgccatcatctccggagcgttcgacaggaacagcagccccaccgagatcacgcttctgcccaagacgttcaccctggccaacttcgaggcagcgtcacagcaggggctctggggctacctgctcaactccctggtcattgccggcggcgggctgctgctgcagatgacagtgtccgtgttcgcggcctacagcctgagccggaagaagttccgcggccaggcaatcctcctgctcctggtcctgctgaccatgatgctgccggaggaagtcattgccatcccgctctcgctggtgctgggcgatctccccttgctggggatcagccttcgcggaagcgtactggccgtcatcctgccggtgggcatctgggggttctccatcttcatcatgagcgagttcatgaaggagatccccgccgagatcgaggaagccgcccggctggacggcgtgggcgagttccgcatgctgttcaccatcatccttccgctctgcaagcccgccctgggcgtcatcgggatcttcggcttcatgatggtgtgggaccagtacctcctccccctcattgccgccaacgatccgagcgactacacgctgacggttgcactctccgtgctccgcaatgacaccacggttggacccggcgtcctgctggccggcgccgtcatggccatgatccccagcctgctggtgtacctcttcctgcagcgctccatgatccgcggcatcacagcaggcgccaccaaaggctagggcaggcccaacccgtccgcccacaccacgaaagaagttcaatgaaaaccagcgccatcctccctgcagcccacgcccccaccgcggccgacctgaaaatcaccgagatcacgattacccccatcgcattctccgaccccccgctgctgaacgccgtgggagtccacgaaccgctggtgcaccgggtggtgatcgaggtccagaccgccaacggcctgctgggcctgggcgaatgcgccggcgggcagagccggctggacaacctggcggtgggcgccaacgccatcaagggcctcggcgtctttgacacctccctgatggagcagctcatcaacgaggcactggaccccgcgctctccgcgttcgagaaggcagccgtgttctccgcgttcgaggtggcagcgctggacatccagggccacgccaccggccgcacagtcagcgaactcctgggcggcaccgtccgggacgaggttcccttcagcgcctacctgttctacaagtgggccgaacatcccgccatggacggcaaaccggccatcacggacgaatggggcgaggccctggatccggcgggcattgtgcggcaggcgcagaagatgatttccgagtacgggttcaagtccatcaagctcaagggcggcgtgtttcctccggcacaggagatcgaggccatcaaggccctgcgtgaagcgttcccggagatgcccctccgccttgaccccaatacggcctggaccgtagagacctcccagtgggtggcccgggaaaccgacgggctgctcgagtacctggaggaccccaccccgggcctggagggaatgggcgaggtggcggccaccgctgccatgccgctggcaaccaacatgtgcgtggtggcattcgaccacatcaagcggagcgttgaactggattccgtccaggtcatcctgggcgaccaccactactggggcggcctgcggcacacgcgggaactgggcaccatctgccagaccttcggcataggtttgtccatgcactccaactcccacctgggcatcagcctggccgccatggtccacgttgcagccgccacgcccgccctcacctacgcctgcgacacgcactacccgtggaacgggcacaatgacgtggtcaagcccggcgtcctgcgcttcgttgacggcagcgtccgtgttcccaccggcaccggcctgggcgtggaactggaccgggagaagctggccgagctccaccagcagtacctcgacgccaggatgaccgccagggatgacaccggctacatgcagcgctttgtcccggactacacggcggatcttccgcggtggtaacgccgccggcgccgcaggtcacgggatacctctacccctgggacgtcctgggcgatcctgctgcggccgcctgggtcaaagatacgggcgtgcaccgggtggcgctggctgcggcctaccactcggtgcgggccgccaccccgcggcacccggagcgccgggtggttgatgccggttccgccgccctctacgtgccggtcaccggggcgtgggacggcagtttcctccgccccgctaatgccgctgagtggaccgaacgcgacgactcgttttcagaagctgccgcggtcctccgcagtgccgggctccccgtggatgcgtgggtggtcctgacgcattcaagtgccgtgggcagccggcagcgggacctgtgcgtgcagaatgccttcgccgaaacataccgctacgccctgtgcccgtcacagcttcaggtccgcgagtacgccgcccggctgataggacaggtcctggaactgggccggccggatggcctggtcctcgaggcagtgggtccgctgggcttcggccaccagaaccagcacgaaaagaccgagggcgcgggatactcgccctgggtgcaggcgctcctctccctgtgcttctgcggcgcctgctgcacggcctacgctcaacgcggcctgcccgtggaggctctccggaagcgggtgcgggacgtgatccggctccacacggacgctccggacgccacgccggaaacggctaccgaaaccgccgagttcctgccgctgctggcggcccggtgggatgccacggccgccctgctcgacgcctgcctcgcggtggtgtccggctcaggtgtccgcatctcactgcacgcctcccctgatccgtggtccaccggcccgtttgtctccgttgaggcactgcgccggagcctgctcttgcccctgatggacaacgtcaccgccgtggtcccctgctggggggaagcggcgcagggtgctgtcactgtggccgccatggctgcggccgcgcccggggcaacggtgggctcttatgtgctggtgctgccgccgaagcccgccgaggccggggccctgtcccgggaatggggcgcgctcctggaggccggaagcagcgaactgcatgtctaccacctgggcctggcttcctccgcccgcctggacgctgccgcggaagccgtccacagcgtgggcgccggcagctgacccggcggtgcccgcccggagtgaggtgccgccgtcgtgcgttcctccccggttgcttcccggggcacccgggcgccgcgccgcgcacgacggcgtgtccccgccccggagggcagcgcgccctgactaactgggcaggaccgcacgcgccctgctctagccgacgtccggggtgaggcgccgccgtcgtgcgttcctgcccggttgctttccggggcaccctgccggcgcaccgcagacgacggcgtgtcccggctgagtcaggcatgggaccctgacgaaatgggcaggaacgtacgcaacccgcgcggcgtgtgacgtccgtttcatctagcgggccgcgccgtccggcggtggtaccgtggcgcctatgcacctgaaggcttaccagcgaagcccccaccctaagcgtccaaggaaaaaaccgaaggccgtgctggccgggtacagccggtccctggcagaactccagggcaagcaggtgccaacccttcgaagggtggcccacaagctggtgccccggcaccccgcgcagctgatcgccctgggcttcgtccttgccatcgccgcagggaccgcgctcctgatgctgccggcggccgccacaggcccacggccggcgtcactgctggaagcactgttcaccgcaacgtccgcggtgtgcgtcaccggactgatcaccgtggataccccggtgttctggacaggattcggccatgcggtcatcctggtgctgatccagatcggcgggttcggcgtgatgtccttcggtgcgctcctgggcgtactgacggcccgccgcctggggctgcgttcacggatgctggccgccacggaaaccaagagcaccggcttcggcgatgtgcgccgcgtcctgatcggcgtcctgctgatcaccgtcattgtggagaccatcctcgcggcggtcctgatgctccgcttcctgctgggctacggctacacgcccggagaggccctgtggcacggggttttccactccgtgtccgccttcaacaacgccggctttgcgctgtactcggacagcctgatgggctttgtgggcgacccgtgggtgtgcctgcccatcgcgggcgcggtgatcatcggcagcctgggctttccggtcctgttcgagctgcgccgccagtaccgccggcccattttttggagcatgcacaccaagatcgtcctggcgggcagcgccgtgctcctggccggcgggaccgtgttcctcacggccgccgaatggaccaatcccgctaccctgggcggcctggctcccgaggaacgcatcctgggcggattcttccagtccgcgatcacgcgcaccgccgggttcaacagcgttgacatcggccagatgcaccccgtctcctggctgggcatggacatcctgatgttcatcggcggcggcccggccggcaccgcgggcggactgaaaatcaccaccttcgccgtgctgttcttcatcctggccacggagctccgcggggacaccgcggtgaacatctttggcaagcgcctttcccgggccgtgcaccgccaggccatcaccgtggtgctcctggccatcgccctggtgactgcgtccaccatgttcctgatgctgatcaccgacttcggccaggaacggatcctgttcgaggtggtgtccgcctttgccaccgtgggcctgtccaccggtatcactgcggggatgcctcccgccgggcaggtggtgctgatcctgctcatgttcatcggccggcttggacctgtcacgctgggcacggcgcttgccctccggaaacgccccatactgtacgaaaacccgaaggaaaggcccctcattggctaaggacatcttcacccgcaggggcgagcgcgcccaacaccccgattccgtggccgttattggactggggcgttttggcggctccctggcgctggaactcgaagcacagggcaccgaggtactggggatcgacagcaacgaggaaatcgtgcagtcctacaacggacggctggcccatgtggtccgtgcggactccaccaaggaagaagtactgcggcagctctccgtccacgagtttgaccgggccgtggtgggcatcggctccgacctggaggcgagcatcctcaccacctcccgcctgctcaccttcaagcacccggaaatctgggccaaggccatcagcgaaccgcacgcggaaatcctggaacaacttggcgtgcagcacgtcatccggcccgagcacgacatgggccggcgcgtggcgcacctggtccgcgggtccatcctggactatgtggaattcgaggacgactttgtgatggtccgcacccagccgccgtcggatgcccgggaccggcccctgggcgtgctgggcctccgggacaagtacggaatcaccatcgtggcggtcaaaaggcccggcggaacctggcagcacaccaccgcccagaccgtgctgtatgacgacgaccagatcattgtccagggcaccaagaacctggccgaacggttcagcacccgcccctaggccggtactgccggagcagcgggctccgaactagtgcccggcgccgagcttcccgcccaggcggttgcgcatggtggcgctggcgtcgttgaggccgatgatcttgacgtccttgccgtggtgccggtatttctcggtgatggcgtccagggctgcgatggttgaggcgtcccagaggtgcgaggcgtgcatgtcgatcaccacaaactgcgggtccagcgcgtattcaaactgcgtgtagagatcgttggacgaggcgaagaacagctcgccgttcaccgtgtaggtggcggtttcgtggccttccacgccagtgaccgtccgttcgacggtgacgaagtgggccacccggcgtgcgaacatcaccatcgccaccagcacgccgacgccgacgccgatggccaggttgtgcgtggcaacagtgacgacgacggtggccaccatgaccagggtttcgctcttgggcatcatcttcagcgtgcgcgggtggatgctgtgccagtcgaacgtggcccaggatacgaagatcatcaccgcaaccagcgcggccatgggaatgacggagacgacgccgccaagggccaccaccaggatcagcaggaacacgccggccaggaaggtggagatccgggtgcgggcgccggatgctttgacgttgatcatggtctgcccgatcatggcgcagccgcccatcccgccggtgaaaccggtgacaatgttcgccacgccctgcccccaggcctcgcggctcttgtgggagcgtgtatcggtgatgtcatccacgagcttggcggtcatgagggactcaaggagccccacaaacgccacggccaggccgaaggggaagatgatctgcagggtctccatggtgaacggaacgttcgggatgaacagtgatggcagcgagtccggcagctcgcccttgtcccccaccgtgggaacggcgatggacgccaggacggtgctaagcgtgaggacgacgatcgcgaccagcggggcgggaacaacgttcgtgagcttggggaggccgaacacgatcagcagggccagcgccgccagcgggtacaccagccagggaacgcccagcagctcgggcacctgggacatgaagatcaggatggccagggcgttgacgaagcccaccatcacagaccgcggaatgaaacgcatcagcttcgccacgccggacaggcccaggatgacctggaaaataccgcccaggatgacggcggcgatgaagtagtccacgccgtgggacttcaccagcggggcgatcaccagggccaccgcgccggtggcggccgaaatcatcgccggccgcccgccgacaaaggcgatggtgacggccatggtgaaggaggcgaagaggcccaggcggggatcgacgccggcgatgatcgagaaggcgattgcttcagggatcagccgccagcgcgaccaccagtccggcgaggacttcggtcttgagccgtcgcggggacttcaacgtttcccggacagactggagctgttccggtgtgtaggcgggggcatccgctgtggttttaacggccattgctggctccgttcatggtcaggaaggcgcagagagccgcgcttcgctttttcgaagaatgaagggggcgcagcgccgcgccggggacgccgggagtccgctcaggcgtctctccgaccggacacaaccctaccctaacgtgatggtagagttgcacgcggacattacggaggcccacgcatgacagcacgaaccggaacttccaccatgcatatcggcgaattggcggagcggacaggtttgtccctgcgcaccatccgccattacgacgacgtggggctgcttccagccgcggcccgcaccgacggcggcttccgggtgtattcagaggacgacgtcgagcgcctcatggtgatcaagcagatgaagcccctggggttctccctggaggagatggccgacatcctcgagctcttctcctcgcaggaagcagggccctccgctgacgcgcaggccagactcaccgcgtaccaggagaaggccgtggctgagcgcgccaaaatggcccgcaacctggcccaggccgatctgctcatcgaacggctcagcggccgcggctgacaatcgacgtcctgcagccccgaaccacagtactgaaccgccgcggcccggctgccctcggcgcccccaatagcagcgccaaggacagtccggccgttggacaggggccggtcagccctccctgtggtcgaagctgaacccgcacgcgcaccggtaggtgagcaggccgccgtcgtgattttcttcccttacctccgctggcggaacctgccccgcgctgaccaggcgcatcggctcaccacagtggacgtgcgtggccagcatccgccgcaactgcgggtcttccgcccgcccggcgtgcgccgcgtccctgcggcgggtgcgtcgaacggccagcgggctctgtgaatgtgtcatagccgccaccccactcaagccagcgaggcgaggaggtcggagcaggcctgctcacagtggcggcacgcgtctgcgcacacttcgcagtgctggtgcatggaggcgtgctggccgcactcttccgcgcaggcacggcaggcagtgcggcatgcttccagcactgccccggtgatgccgacgtcgtagttgccgtggcgggagaggatctttccggtggcggcgcagatgtccacgcagtcgaggttggtgcggatgcacttggtgagctcagccaccatgtcctcgttcaggcatgcgtcggcgcacgcggtgcatgtttgcgcgcagtcgaaacatgcctgcatgcattccacgagcttggctttgtcaatgcccgccacgtccttggggtaggcgtccagcatggactgtacatgtgtcattggtttctctttccaggtctttacagcaggtctgatggcgtgaaacggcgaaccgctcttacgtcctgctgatggaaaggtccactaccgtgagcacccgcagttcaggcgcccgcggtacgtcactggaagggagggtaaccccgggcagccgctgggtcagcgacggcgggtccacggctccggtccgcacaggtaccggttcgccgcggggagccttgctccgctcgccttccttctcgagtcccgctggctcagcggacgggccggcctcgtggataacgcggacgaactgcgacgctgctactgaaggtcctgcctgaccggctgcggtttccgcctgcggcggcactcccccgctggcctgtccgccctctgactgcaccgggccgtaaccgggaaccagggcgtaccgggtgccggccgtgtaggaggccgcaccggcaatgagcaggaccaggagcagccacacgaaaacgcttcgcagcgcagcgaggcagcgaagcagtccaagcgcagacgaacccagtgtggccatcaccacttcctgtaaggggctttttatcagcctagcttcggatccctgttacgcagatcacatgagtattacttttgcgatggaatcagccaggtccatcagggttttccgttccggggttgaatagtgcgcggagccgatggcgttgcgcatcctgccaaggtggtccatgatctccgcccgatagcggcccttccggtcacaccacgcaagctcgtggaggagctggaggaggcgggccgcgacggcagggtccgccgcgccgtactgccggggctggtccatcgccaggctgaggaagtcccgcagtccaggaagggacagcaccaccctgacccgcccgtcgtcgtcgaccaggtgctccggtccggggttccgctcccccagcctgcacaggagcgccgaaaggtgcccgatgacgtgcactgccgtggtgggatcgttgatgcccggggagagcgcccgcacagcaacatccacgagctgccggaacccgaatccgatgtcctgaacgttggtgcgttcataccccgttgcaaccgcggcgttggtgtcattagccagcttctcccgcacctcggcactgaatgttgtaccagctacggaccaggcggtggcaaacgggacgccctgcaccaatgagctgccgggttcccggtctatgcggagaacagcaccggcatccttcgcagcgttcaggagtgcgccttggtcatatgaggtcaggaagccggaggaactggagcggatggggaagctgcccggcgccggaaagggctgaggcgggggtgcgggccggtcctggggaaagacgcggtcgatggtttcctgggtttccacgttgacccggcgcagcatggtttccacccggatttcccgcgtgaggtgcgccaggaagagcaccagcccgaggacgctggccatggcgagcgcataggcaaccgtgacggagatttcaggtacgaaggccgtattgccgtttccctcgtcccgcacactgcgcaggactgtcagtgagaaggcgaaggcggccaggaacagcgccagcgttccgtggacaaaccggtccgaggtgaaggtccgcagcaggcggggcgagaactggctgctggccagctgcagcgttaccaccgtgagcgagaacgtcagcgaggtcaccgtgatgagcgaacctgaaatggcctgcaggacggcccgggcagcctccggccctccgctgaagaggaaaaccgtgacgctgtccggcagatcgccgtcaacggccgaatccagcgcgggcagcgccatgccaaggacgacggccaaggcaacagccaatgccggcagcggccagagctgcgtccgcagggcatcgagccagtgtgcactgcgcgtagcggtgttcaactattcctcggttccctggcccgcgccgttttgggatgccaccggttcccgcgaagggtggcccgtgaccgcggaggcgccggacagctggccgtgggcaccccgggcggtctcctgctcggcttttgcaacatcctccgccgtgatttgatcgtccgatttttcgttccatgctttgatcgcagcccagatgacggccgccaggggaacggagaggatggcgccgataatacccgccaggatggtaccggccgtgagcgccagcaaaatgacgagggcgtgcacgctgagcgtacgccccatgaccaccggctgcaggaagttgccttcaagctggttcacaacgaccacgacgacgatcacgatcagggccgtgacaggcccgttggccaccagtgccacaagggcagcaagcacgccggcgagggtggctcccaccagcgggataaaggcgccgatgaatacgatggcggccagcggcagggctagcggaactccgaggacaaccagggccagcccgatgaagaacgcgtctacaatggccacgattgccgttccccgaacatacccgccaagtaccgcaaggctgtcctgccccacgcgcctcgccttgaccagccgcgtgcccgtgaaggcgcgcaggatgaacgcccagatgcgctctccgtccttgaggaagaagaaaaggatcacggccatgagcagggcaccggtgatgaacgtccctgccgcgctgaggccggtgacaacaccggcgcccgcggtgctgctggtgacgaagtccagcacggcgtcccgtgcctgctggatctgttggtcatcgaccggaatcgggccgttccggacgaagccgtagacctggtcgaatccctcggtcgcgctgcgtgcaagttcgcctgcttggccgattacggcgaaaacaatggccgtgaccaggccacccagggtcagcaggagcaacaaaaaggagaagccggtggcggccgcactgggccagcctttccttctgagccagttcaccagcggcgcgatggcagcggccaggatcagggccagcagcagggggacgactaccagccgcacttggatgagcccgtagatgagtacagcggaaagggccaggagcagcagcatctggcctgccctgatgctcacccggccgagaccgtcctgccacgggtttgcctgtttttgagtctgcattcagttgtctccctggatcggcaagcgctggagctgcgaaaaggtggcatcggagacgccgcgcaggctacctaaacctctcacgaactctcctgggtgaatcaacggacggcatctgctcggacctcagttaaaaacaaagggtgcggctccaatggaaccgcaccctttactgatggaccggaagtcagtccttcttgaaagcgtccttgaccttttcgccggcctgcttcaggtcgcccttggcctggtcgccctggccttcggccttcaggcgatcgtcaccggttgcttctccggcggcctctttacccttgccgccaagcttctcggctgcgttaccaatcttgtcgtccaaacccatggtatttctccctacggtcggctcccgccggcgtaccgccagcggcttaccttcccatcgtaaccacaaatcactaagggtgctgatcattttgggcggtgagctgcggcacgagcccttttgaagcgtcaaccgtgggtgggttcgccggtgatgcggtggtccgcatggttgatggtttcgcggatgagccgcaccaggtgcccgtcgcgcagggaatagatcacgtggcggccgtccttgcgtgtgtccaccaacccgctgaggcggagtttggccaggtgctggcttgccactgtccgcggcactccgacggcggccgtcagttcggtcacggttttggggccctgcgacaattgccagagcaggtgcaggcgcgtgggttcggccatcatccggagggtcgcggacgctgcctccagcagttccgggcccggtgttacctggtggaccagggacgggacatcagcggcgggctcggcttcgctgcggggctggctggccactgtcctgctcctcccgcgtacggtccatggctcctgcggcatcatgccggggccaggacaggaatgctcctgcactgcctatcatcgcaacaattgtcagccccgccgcggcccagcccaaaccggccacggctcctacccagcctgccagcggataggccaggatgtagcaggcgtgcgagagcgagaactgcgccgtgaaaacatacggccgggtgtcctccgtggaggcgtggcgcagcagtctcgacgacggcgtgaggatggtggagttcgccgcacccaggaggaaccacagggtgagcagcagccaccatccgctgccgggcgcggcccaggagatggcgacggtgccggccaggaccaagggaacgacggcggccccggtgagcatcaccgtccggtcacccagccgttccagcagccgcggagcggacatggcaacgatcatggatcccaccccaaagctggccagcgccagggcaaggtccgtgtccggccgctgcaggtcatcgcggacatagaccacggtgttcaccagcaccagggcggttggcgccgccaccaccaggttcagcgccagcagtgaccggagcctggggttgcgccagaagatcctggcgccgagggtggtccggtgccagagcgaggcctgcggcgccccggcagcggggacctgcggcaggacggagatggccaccatgacggcggagaacaggaaccctgccacagtcccgaggaacaagttgttatagctcacaacggtcagcagcagcgcggccagcgccgggctggccagggcctccatgtcgtacgccagccgggacagggacaacgcgcgcgtatagtcccgctcatccggaaggatggtggggatcagcgactggaacgccggggtgaacgtggcggaggctgactgcagcaggaaaatcaccacgtagatctgccaggtttcggtgatgaacggcagcgacagggccattgccgcgcgcaccaggtcggcaccaatcaggaccggtttcttcggccagcgggccagcagcgcgttgatcaccggcgccaggcccacataggcaagcatcttgatggtcagcgctgtgccaagcaccgcgccggcattgccggcggccaggtcataggccagcagccccagggccacggtgagcaggcccgtgccgatcagcgccacgatttgggcggcgaaaagcctccggtacgttgcgttccgcagaaccgagaacatccagcccactcctttgggtgcatatgtgcacgtacatgcacccattataggcccgcgctgccactgtgggcctgcccagttgggcccgcccgcaaacggcggaaggcgccgctccgtgacggagcggcgccttcgtggctgcggcgtagcagtgtggtgcagaagccgtggcccagcgggcgttatacagccggcgtgtcaggcgctggtggcgtcctggacctcgcccaccagttcctcgatgatgtcctccaggaacaggacaccggtggtgttgccctgcgcgtcgaacaccctggcaacgtgggcgccggtgcggcgcatcgtggccagcgcgtcctcaagctcgctgccgctgaaggcggaggcgaggcggcggatccgcttggcaggcacccgctgggtgaacttctcctgcgtggtcaggtccatgacgtccttgaggtgcaggtagccggagggctcgccgtcgtcgttggtgaggatgtaccgcgagtacccgtgcccggccacggcgcgctggatgtcagccggcgtggcggactccggcaggagcaccatttcggagatgggcacctcaacgtccgccacggtcttggccgtgaattcgaacgcggcgctcagggttccggtggtgtccgtcagcatgccgtcgcgggtggactgctccacgatgttggccacctcatccagcgtgtaggcgctggtggcctcatccttcggctccaccttgaacaggcgcaggatggagttggcgatgccgttcagcgtccagatcaccggcttgaagatgcgcgccaccatcaccagcggcggggccaggatcagggctgcccgcgtgggaacggagaaggagatgttcttcgggaccatctccccgagcaccacgtgcaggaacgtaaccagcagcagcgcggtgatgaaggcaatgatgctgatcgcctcgtaggacagggaggtcaggcccagcgggatttccagcaggtggtggatggcaggttcggagacgttcaggatcaccagggaacagacggtgatgcccagctggctggtggccagcatcagcgtggcgtgctccatggcccacagcgtggtcttggcggccttgctgccggcctccgccttgggctcaatctgggagcggcgtgccgaaatgacggcaaactccgcaccgacgaagaaggcgttgaccaccaggagcaccaccagccagatgatgccgggaaggtattcactcatgggtcagctcctgcgtgaggtcgtcgatgatgcggtcatgggtgctcttcggcgcgtcctcggaggcgtcgggagtgaagcggatccgctccacgtgcgtgcccaggacgcgctccacccggagcgtcccgccgtcgatccctacttcatcccccagttccgggatgcggtccagctgatccgtgacaaacccggccagggtgtcgtactcctcgccgtcaggcacggtgatgcccgtccggtccagcagctcatccggccgcagggaagcgtcaaaggtggtggaacgcccggtccgcaccacgcccgtgcgggcgcggtcgtgctcgtcctcaagctcccccacgatttcctccaccaggtcctcgagcgtcacgatgccggcggttccgccgtgctcgtccgagacgatggccacttgcagcccctgcttccgcagcagaacaaggagggtgtccacgcccatagactcaggcacccggagcggctcaatcatcagctccgaggcgatcacccgtgaccggtccgcgaggtccacggcgaaggcctgcttcacgtggagcaggccttgcacgtcgtcgcggtcctccccaatgacggggaaccgggagtagccggtggtcgtggcaagcgcgacgatctcttcggctgtgtcgtcggcgttgactgccgtcatgcgcacgcggggagtcatgacgtccgcggcggagtgctccgagaaccggagggtccggtgcagcagaaccgcatggtcggcgtccaagagaccttcgagggctgaccggcggaccagggagctgagttcctcggcactgcgggcgccggagagctcttccttcggctcgatgccgaaggacctgatgatcttgttggcggtgttgttgaacagcaggatcacgggcttgaacaccgcggtgaagacggcctggaaagggaccaccactttggccgtggccagcgggagggccagcgcgaagttcttgggaacaagctcgccgatcaccatggagaaaaccgtggcgatgaagatgccgattactgcgccaacaccgggaaccacggcctccggaatgccggcggactgcagcggcccgctcagcatggagctgatcgcgggctcgaacgtgtaaccggtaaggagcgtggtgagcgtgatgcccagctgcgcgccggagaggtgcgtcgaggtgatcttgagggcattgatggtggtgcccaggcgcttctccccgcgggcctggcgggcttcaaggtcattgcggtccagattgaccagcgcgaactcggaagcaacaaagaaaccggtaccgaccgtcaggacgaggccgataccgagcatgatccattcatacattcaggcgcccctctcccgtggtggccggcgaaccggtcagaaggcggaggggcttgggcatatgtgaaggagggtcatccataatgcattccatcttaccggcacggccccggaaggaccttacgcgtacgcccacagcagagccgcatcggggccctgttcagcgtgccttctgtccggcgcccggtcctcctggccttcctggtgtctgactcctccgatacacaagccaacccgccgcaaccaggagcacactgacggccaggaagcccacgtcccaggcgggagggccaccaagatcgtcccggacgtggtggatctgcagcagctggtggttgaccagcccttcgatgatgttgaagattccccagcccgccatggccagtcccgtgtgaaagcgccaactcccggacagccgctcctgccgccgggcgcggacggccagcgcagcggcggcaaccaccagcacccacatggcgccgtggaacaggccatcggccagggtgttcagctccaggcccgccaccgtcttcgggttgccgctttccgtatggctgagcatgtggtgccactgcagcagctggtgcagcacgatgccgtccacgaacccgccgatccccatgccgaagaggaaggccggtgcccgtgccggcaggcggacgcttaccgcaccgtgagagcccgcggacgacgacgtggcgctggtttcccgaggcaattcccgttcctcatttcttccggggcatcctttcacctgccccgtacccgcggccttatccttcaaaccccgggcacggccaagcggatgccaccgacgccgggcccgcgcatggtcacagaaaaaacaccaaattgaaacaattcagcaacctggccacggcatgctgtctcttacggggacacaacagcaggaggcgcatcatggaggcacagggagttctcaccggccagcttcggatcggcgaccagatcgaggcatggcacaacggcaaacttttccaccgggggcgggtaatggacgtcgttccggcactggaactgttctggatcctggacgcgaggaccggcacgcggaagctgctggacccggaggcactggagatccggcacgtggaggaacaggctaagccgctcgccccggcctgaggagaagcaggcgtacgacggcggcctgccgggcttccggcgttcaggcgcccggccgggcgtgcatagaatgaatccattgcggcaccgctgcggcagtacgggcgtcatccgcccgcaaccaccactaaggagcacaccgtgattggattcatcgttgccggcctggtcattggcgcgcttgcccgcctgatcaagccgggcaagcagaacctcagcctcttggccactctcctgctgggcctcgttggctcggtcatcggcggagtggtcgcatcattgctgggcaccggaaatatcttcgagctgaacttcttgggcttcatcgtggctgtcatcgccgctgtgctgctggtaggtacggccgaggctgttgccggacgcaggaactccgtgcgccgctaggcgccctggcgtgccgtgccaaacggtccacggctaaaccaaacgcggggtcattccgcgccgttccggttattcggaacaggcgcggagtggccccgcgttgctgttggaaaaagcgtcagttccgttcctggtagacgtccgggatgccgtcctggtccgcgtccaccttctccagctcctcggcctcccggtattgccggttcctggtcttcaggactgcggtggccagcagtgccgcgatcactgacgcggccagaatgcccaccttggcatggtcatcgtgcaggctgccctgtccgaagctgagctctgccaccagcagggacaccgtgaaccctatgccggccaggagtgccacaccgaagacatctatccatttgaaagacttgtccagctccgcccgggtggctttggtcaggagccaggtgacgcccaggatgccgatcggtttgcccaccactaggcccacgatgatgcccagtgctaccggatccgcgagggctgaccccagcccttccaagccgccaacggccacgccggcggagaagaacgcgaagatgggaacggccacaccggccgagatgggccggaagcggtgttcgaagatttccgcgaggccgggccctgcatccggaccgccggaagcctgggagcggaggacggggacggcgaagcccagcagcactccggccacggtggcgtggatgccggacgcgtggacaagggcccaggcgagcatgccaagcggcagcaggatgaaccaggcagcggaggccttcatgccaaagaagtggcggtacttgtgcgccaggaaggcgtagagggccagcggaatgagggccaggagcagtggcgtgacgtccaggtcgctggtgtagaaaaacgcgatgatggtgatcgcgatgaggtcgtccaccaccgcgagcgtcagcaggaagatgcgcagggcgctgggcaggtgggatccgatgatggccaggaccgccaccgcgaacgcgatgtccgtggcagtggggatggcccagccgcgcagggtttcggggctggtgaggttgatggccacgtagatcagcgccggaaccactacaccgcccgcggccgcagcaacggggacgatcgacttgctgatctggcgcaggtcccctgccacgaactcacgtttgagctcaaggccaaccaggaagaaaaagatggccagcagcccgtccgccgcccacgcgccaaggctgagttcaaggtgccagggctcgtagccgatcttgagatcccggagggcaaaatagctgtccgacgccggcgagttggcccagatgagggcgatgaccgcagctgccaccagcagggcgccgccgacggtttccttgcggaggatctcgccgatcctcagcgcctcggcgtaactgcccctggagagaacagtggatttcccctgccggggcggcggtgttgaaggcgtggtctggttcatggagtctcctggcatttggggtctacaagactatgccgaccagacttcccggcgcaccttcgttccatcctacagggggcgcttccccttgtttcctccggggtttcgaaattgctcccaaaagaccttgtgccccagttcacttttttcccatccgtaacggcagtggcgccgaagtacttctgtccctcatctgggacaccaccgttacttgtatgaggagactgctttccgatgaacaagacactccgccttttggccgtaccaaccctcgcactgggcgcccttgccctctctggcagccccgccatggccgccgaccagtcgtaccagtccaccttgggccagatcaacggcagctcggcctccggcaccatcactgttgatgtcacaggcaaccaggcccacgccgtcctcaaggtctccggcctggccgcaaccttcatggacgccccctacccccacgtccagcacatccacggcggcgcccagggtgtatgcccggcaccgtcagccgacaaggacggtgaccaggttgtctccaccaccgagggcgcaccgggctacggcggcattgtcaccaccctgtccaccagcggcgataccagccctgccgccgggcttgacctcaaggtcgccggccagggtgcaagctacaccgttgaccgcaccttcgaactgaacgcagaaacgaaggccgccctggaagcaggaaccgccgtcgttgtagtccacggccttgacccggcaacgttgagcgcagctggccaggcagccaagagcgatcttgtccccgaactcccgctggccgccacctcccccgccctctgcggaaccctgaccgccggacagatgaagatgcccgcgggcggagctgacaccggcatcacccaggaaaccggcaccgacaccggcgcccttgccctcggtggcggcctggccctggcggctcttgccggcggcgcttacgttgttcgccgccgcagcgccggatccgcggcctaagcctgggctgactggaccatcactgtgacaatcatgaaatccggccgccgcgggggcccctgggccaccacggcggccgggcttctgctcgtgctggctttgggcggctgcggtaccgcagattccaaaacgtccgacgccggagccccaccttccgcttccgccgcagcttccgcggcgcccgccccggctgctgccagtcctgcgatgccggcccccgccccttctgctcccgcgcctgcggccccggaaccggcagtcctgtcccggtccgagccggtggtcctggaaattcccgccatcggcgtgcggaccgacctcctcaagctgggcctgcgggataacggctcgctcgaagtaccgcaggacaacggcaacggcgcgccggccagctggtacaacgcttcccccacccccggcgaacgtggaccgtccgtcatgctgggccacgtcaactctcccagcggccgtggcggtgtgttcgcggacctccgcaaactcacccctgggaccgagatcaacgtctcacgaaccgacggcagcatcgccgtgttcatcgttgaccgcggagccctttacagcaaaaacgacttccccacgctggaggtttacgggaacacggcgggctccgaactccggctgatcacctgtgacggctacgaccccgccaccgggctctttgatgacaactacgtcatctacgccaagctcaaagcctgatccgttccccaccagagcccgaccccgcaagaaccgagcaaacggccgccaatcccggagaggggcggggccaggacggatacgtcatgacacaccgcaccccactgctggcttcgctggctgtctccaccctcctgctctccggctgcgctgctgcggcgggttccgtgggagcggcccaggcgccgccgtcggactcttccgccccggcagccccggcagccgcatccccgtccaccgcatccccgtccacgcagggcggccacgcgggacatcacggcggcggctccccttcccagcgcgctgccgtcagtggacccagcgaagcagccaagatggtgtgcggcgaacagccgatggacaggctgaccgcgatcctggacctggagcaggatccgcacaccgtgaacagctgggcggacagcaccttcacgtgcacgtaccacctggacgagggtgcgctggacatttccgtcagggaagcgccggaccaggccgcggcgctgacgtactttgacgccatgcaggcgctggccgtggacgcgacgccgattgaggggctcgccaacctcggccttcccgcctacgaaaccgcggacggatcggcagtgttccagaaagacagcttcgtgctgcacgtggacgcctcgggtctgccggaggccatgggtccggatggaatcagccgcaatgcgctggcctaccagttatccaccaccatcctggcgtgctgggtggagcaccactagccggccctagacagcccgtttccgctgcgccgcattcccctggccgtccatcttgatggctttgacagcggcctccaggtacttgcgcgactctgcggagttggccagctgcaccagctcggcggccaccaccaccagcttgacgttgcggtggctgctggtgctcacgagcatctggaatgcatcctccgagcccatcaacagctggcccatgagaatgccgcgggcctggtctatgacggtgcgggtggaggtggctccgatgacagcgtcacgggcggtctgctcggtttcgcgctggagtgttgaggtgaggtcgatcatgacgccttccagggcggtgaccctcccgccgtccagaatggcgtcaccggttgtcaggacgcgccgggtccgcccgtgggcatcgatgatgcggtggtacatgcagaaatagccgccggtccggacaacctgcgcaacaatctcctcgcaccggggcctgtcctccggatgcttgtgggagaagagcagctccagggtgggcaccacgtcgccccgctggtatccgtgcagctggaacatggcctcggaccagtggatcctccccgtggcgacgtccgcgtggaacgtcccggcaacgcactggttgtcccccagtgcgctcgaataggtataagggccggtcagctctgacacagggccacctccatgtagcgtccaacacgtccccggccgttggcacagtccgcacttatcccaattatggccgcgtaaggccccgggcgtaagggactatggccctttctgaagcgcagggcccccgggcggcaacagggcttgacgcctataccccctaggggtatattcaaggtgttgtcagtgaagtggtatgtccaggccggtgccccgcaccgccgtcacagccgttcaaccccagcacctgcccagcaaggaattctccttcaccaaggaatggaactgacatgtttgatagcgaaaaccgcaccgagcttcccctggcctccagcgccggctgcagctgctgctcccccgcaggccacgcgcaaaaggcgccggccgccgtcgtaaattccgacgccgttgccccctcccggcggaccttcgccgtcgagggcctcacctgcgggcattgcgtccagacggtggagaaggccgtctccgcccttgatggcgtcgagtcggcgtccgtggacctggtagccggcggccgttccggcctgaccgttgccggctctgtttcagacgcggcggtccgccaggccgtcacctcagccgggtactccctggctgccaactgattttccgcgccggggctgctgccccgggttgcggcgccctccaaggaggaaccgatgcaggaccaccagcaccaccaacacgacgacgagcgccccttacgcagcaccctcaccgaaccggcggctgcttcaggcagcggacacggcgggcacgggcacgacggccacggccccgccgcgcgccatgacgacgaccacgccgtccacacacacgggcagcacgccggacacagcacggccatgttcaagaacaggttctggctgacgctcgccctgtccatccccgtggtctatttcagccccatggtgggacacatcctgggctacatggctcccatgttccctggctccacctggatcccgcctgtcctgggcacggtgatcttcctctacggcggccagccattcctcaagggcggcctgcaggagctgaaggaccgccggccgggcatgatgctgctgatcgccatggccatcaccgtggcgttcgccgcgtcctgggtcaccagcctgggcctgggcggcttcgatctggacttctggtgggagctcgcgctgctggtggccatcatgctgctgggccactggattgagatgcgggccctgggttcggcgcagggcgccctggatgccctcgccgcgctgctgcctgatgaagccgaacgcattacggacaccggcacggaaaccgttcccgtctccgaactccagccagacgacctggtcctggtccgttccggcgcccggatgcccgccgacggaacggtggtggaggggcaggcggaagtcgacgaatcgatgatcaccggcgaatccaagaccgtgccgcgcggccctggagacaccgtggtggccggaaccgtcgccacggacaccagcgtccgcgtccgcgtgacggcggtgggcgacgacaccgccgtggccggcatccagcggctggtggccgaggcacagcagtcctcctcacgggcccaggccctggccgaccgcgccgcagccttcctgttctactttgccgccggcgcaggtgtcctcacgttcatcgcctggaccctgctgggcagcatcccggaagccgtcacgcgcaccgtgaccgtcctggtcatcgcctgcccccatgccctgggcctggccatcccgctggtcatcgccatctccaccgagcaggccgcccgggccggggtactgatcaagaaccggatggcgctggagcgcatgcgcaccatcgacgtggtcctcttcgacaagaccggcacgctcaccacgggcgcacccgagctgaaggacgtggccgccgccgagggagtggaccccgatgagctgctggccctggccgccgcggttgagtcggacagcgagcaccccgtggcccgggcaatcgtccgcgcggcacgggaacgcaacctcacccttcctgccgccaccggctccacctccctgacgggccgcggcgtcaaagccagcgtggacggacgcaccgtgcacgtgggcgggcccgcgctcctgcgcgagctcggcgccgtcgaaccttccgcgctggcgcaatccacccaggggtggatggaccgcggcgctgccgtcctgcatgtgattgaccacgacggccgcgtactgggcgccgtcagcctggaagacgcggtacgggctgagtcgcgccaggccgtggcggccctgcagaaccgcggcgtcaaggtgggcatgatcaccggcgacgcccggcaggtggcccaggccgtggccgaggacctgaacattgacgaggtgttcgccgaagtcctgcccgcggacaaggacaagaaggtggccgaactgcaggcccgcgggctgaaggtggccatggtgggcgacggcgtcaacgactctccggcgctggcccgcgccgaggtgggcattgcgatcggggccggcacggacgtggccatggagtccgccggggtggtgctggccggaaacgatccgcgcgcggtgctgtccatggtggacctctcccgggcgagctaccggaagatgtggcagaacctggtgtgggccaccggctacaacgtcctggccgtgccgctggccgccggtgtcctggcgttcgccggggtggtgctctcgccggcagccggagccgtcctgatgtccctgtccactattgtggtggccctgaacgcccaactgctgcggcgggtgaaactcaacccgtccgaggtacgttgaaggtactgaacccggtccgtcccattccagctctgtcccgcctgatccaatcccgtcccgcctgatccagcccagccccgcgaaggaggaaccagcatgaccgcacgcgccagcgtcctgccggcagccctcctccgcgcggggctgctggctgcggtgatggccatcgtggccggaatcttcggcatgcacgtcatgaccgcggaccattcctcgcacgccgcccacgcggatgtcgccctcgctgccggggacaccgccgtcgggcattctcccgttgcgcacaccgccgcggaacacgccgccgtcgaacattccgccgggcactcggccgggaacaccgccgtcgaacactccgatgccggacacgcagcgatcctgacggacgcggcgggcgcgcccttcactgcctccgaatcctgcggcgcaggctgcccggatgtacgggaaggcagctcgtcctgcacgccgctggccaaggccggatcgctcgcggccgtcccgccgcaggccggacaaaccgcacttttggcaccggcggccagcacccgcggggccgccggttactccttcgtcccgccaagcaaaacgccctgcgaactgtccatcagccgaacgtaatcggactgcgccgcgtggccctccacgcctccataggcccagttcacctacttcctcgaaggaccatcacacaatgaacagcaagatcaaagccctgtccgtcgccgctgcactggcagcctcactcggcctagccgggtgcgccgccgattccggaagctccggcggaagcaccatgcccatgaaccacggcagctccggccccgcgtccagcatgatgccggatgccaatgccggccataacccggcggacatcgccttttcccagatgatgattccgcaccacgcgcaggccgtggagatgagcgacatgatcctggcgaaaccggacatgcccgcggacgtcaccgccctggctaccaagatcaaggacgcgcaggcgccggagatcgacaccatgaccgggtggctggaggactggaacgtgcccaccatgatgtcggaccactccgggcacggcatgaccggcatggttgattctgagggcatggaaaagctgaaggatgcccagggaacggacgccgtccggctcttcctggagcacatgatcggacaccatgaaggcgccatcgacatggcgcagcaggaaatcggcgccggcaagcaccccgaaagcatccagctcgcccgcgacatcgccacgtcccaggaagcggagatcgcggagatgaaggagatgctggccgggctctgaccctctccccccggacgctctctcacttaatgtcggttctgcacggacgctctttcactcacggcagcaaatcggccaacgctctatcacttaatgccccaattcggccaacgctctgtcacttccctcacgaacttgaaagagcgcccgcccgggaaccgcgttatgtgagagagcgtccggctggccggcggcgcctggatcgaggtgccgccggcttcacgtgctcgggccggattccgacgccgataaaccgtgcagtgaagcggcgcagcagcggtgaggcgatccggatcagcgcaaccacccagcgcggcgcgaagctgtgacctgtggctgccctggagatggccttgtgcccgttgcgctggatcagctgcatgatctttaccggcagctcgcggcgccgctgcacggccgcgagcttctccacgggggccgcaccggcggccaggtcccccgaaatggcgttgaacagcgctaccgcgtcctggatggcgaagttcactccgacgccgaacaccggggacattgcgtgggcggcatcgccgatcgccatgaacccgggccggtgccagcgccggagccggtttatctggacggagagaagcttgacctgctcccaatcctgcagggtgccgaccaccggctccagcacgggagccgcacgcgtgagccgttcacggagggcgcccagccctgccccttggagctcgtccagtccccctttctggatggccatgcccgactggtacctgtcgcccctgtcaagagtgaggaccatcccgcgggaggagatatacccgagggtcacgggcggcggcgagggcggtttgggaaggttgaaccacagcacgtcgatgggcacgccgaactcatccggtaccagcccggccgcggcgcgcagcaccgacgcccgcccgtccgcggccacggtcagcgtggcacgaatctcgcgttcgccgtcgggcgtttgaacccgcacgccccgcgcctggtcctgctccatgatcagtgcggtggcctctgtgttcatgagcagctcaaaggtggggaaggctgccgcctcgcgggccaggaagttcaggaagtcccactgcggggccaggaccaggaagttgtcggggccccggagggtgcggaagtcggccatggtgatgcgctgcccttccacaacggcgtccagggttggcaggcgggtgaggggcagctgcaggaatttttcacgcagcccgagctcgccgagcagggtcacggtggacggatgcaccgtgtcgccgcggaagtcccgcaggaagtccgcgtgcttctccagaacggtgactttcaggccggcgcgcgccagcaggtagccaagcaccatgccggccgggccgccgccggcaataacgcagtcgcgtccgggctggtctcctggactcatggtgccactcctccgcattggtgcctgcctccatggtggacgcagtgccgctggattggtagtaacgcgcaccggtttcgccgcagggagtgagagagcatccagggaaaagcagcgtcaagtgagagagcgtccgggtgttgcgtgttaagttgaaacgtgcgggccggacggtccgcgcaccggctggaaagagaagatccccttggacacatccgcaccagtacgaatcctcaccgtctgcaccggcaacatctgccgctctccggtggccgaaaggctgctgcaggcaggcctcaaccaggcggtgccgggcggtttcgtggtcaccagcgcaggaacgcgtgccatggtgggcgagcccatgcagcccatctcagctgacatcgtgcgcaccttcggcggggacccggacaacttcgcggcccgccagctgacaccggcgatcctgcgcggcgtggacctggtgctcaccatgaccaccggacaccgcggcgaggtgctccagctggacgcctcactcctcaaacgcaccttcaccatccgcgagttcgcccgcatgctcgacgtcctggaccagcgcgcggcagcaacggacgggagcgcgcctcctgcaggagcggccgacgacggcgaccggctggctgccaacaccgccttctggaagagcctggcagcgcgggccgcgggggtccggcatttgtccctgcctcccaacgcaggggacaacgacatcatcgacccctaccggcggtcgcccgaggtatacaggcagatggaggacgagctggcaccggccatcgtctccatccttcgccacgcacgcctgaacgttcccgcctgagccggcctccgccgtcgttatccaacctgtggttttctctgcggtttttctgcggattcccccgatgtaatgaatttttgccggtgctaattttcccaaatgggcatccagctgcacgatccaagcacccagccgaccgacgcacccgagcctggcaaacgcggcaggcgccaccggttgcggaccatcctgctggtgctcctggccgtcgcaatcatcattcctgcctccgccggggcctacctgtacagcctgggacaggtctacgagtccgagatcaccaccatcgactcgccctggccggcggaatccacccggccccagcgccagcaggcgggcgctgccgcgggagaagccgcacccggagaagcagcaccgggtgaagccggcggatcggccggaagccagcccggcgtcggaacagcggagggctcccaaagtgccgtccccgacggaatgctgaacatcctggtgatgggcagcgacagccgcggcgccaccacggaagaggccctgtccggcggcaactccaaccagcgcgccgacaccctgatgctggtccacgttcccgcggacaggtcgaagattttcaccgtctccctgatgagggacctgtgggtcgacattccgggcaacggccaggccaagatcaacgcagccctcgcctacggtggcgtcccgctgatggtgcagacggtggaatccatgttcaaccagcggatcgaccatgtggccatgatcgacttcgaagggttcgtgggcatgaccgacgccctgggcggggtggaagtgaacgtcacccagccgttcgtgtcgccgcacagcagcaggaagtacgccaagggccctacggtcctggacgggaagggcgccctggacttcgtccgcgagcgctacgcctacgcggacggcgactaccagcgggtgcgcaaccagcaggccttcctgcaggcgctgctggccaagaacctcagccgggacacgctcctgaatcccttgaagatccacaacgtcatcagcgccatggccccgttcgtcagcgccgacagcgggctcaacgccggaacgctggcgcggctggggctggagctccggaacgtccggtccgacgacatggaaatgttcaccctcccaacgctcggaacaggaacttcggcggacggccagtccatcgtgatcccggaccgcaacgccatcgcggggctttcgagggccctggcagatgacagtttggacaagtttgtagccagcaggggccttgcgggctgacactgatcccacctacccacaacgaggtgagacatcgtgagcacgcctggcggtcctgattcatccggcccctctggtcccggcccctctggacccggttcgtccgggcccggaggtaacggcccaaccgatccccccgcatccggtccgcatggcggcagctgggtggcgcacggccgccggcgctggatcgcggcgctgctggccctcgccctggtggcggtggccgtcgtcgccgtcatgagcctcaaccgtcccgcccccgaggcccagcccgcagcaacgcagagcgaagcgccgtcgccgtcgccgtcggagactccgtccccctctgaaaccccttctgagacgccccctcctgcccctgctccaccgccgcctccggagcccatcccggacctgccggccgtgcccatgaacgtactggtgatcggcagtgacatgcgcggcgttgcgaaggacgcggcggcacacacggcagcaaccggcgaggcgatggaccaccgatcggacaccctgatggtggtgcacgtcccggccgaccgcaggaccctgtacatcgtgtccatcaaccgggatacctgggtggatatcccgggcttcggcggcgcgaagatcaacgccgggctgcagtacggcgggatcgacatgaccacccagacggtgcagcagctgctcggaatcaccatcgaccacaccctgatgctggacttcggcggcctgaaggtcctggtggacgggctgggcgggatcgacgtcaacgtccccattcccttccagtccacgcacgacacgggccacgtcttcggccccggagtcaaccacctggacggacaggcggcgctcgagttttcccgcgagcggtacgccttcgcggacggcgacttccagcgggtccgcaaccagcaggtcctgctcaaggctgtcctggcccggctgaccacgggtggcggcctgaacgacgtcaatgccgtccgcgggctggtggactttgcttcctgctgccttaccgtggacaagggcttcgaccccgtccaggccgccatcctggcttacagcctgcggaacctcgacaccaacgccatcggcaccatgaccctgccaaccgccggatccgggttcgtggccggccagtccgtgctgtttccggattacggcgccatcaacgccgtgggggcagcgctgcgggaggggcggatcggcgagttcgcggttccgtaagaggtgtgtggggcgtctggagcggcgtccctgcgggccgctcatgcctgatatgagttcccgctgttcatcaccgaatcaccccgcgttcacccgcgggccagcgtccatgcgcccggcggcggcagcctgagggcatgacttccatttcaccggccgacgtatcgcgccgcaccatcgtcaagggatccgtcttcgccgccgcactggcggccgtgcccgcgtccgcccaggccggcaccggccaggctgccccgcgccaggcccccgccggtgtcgctctggtgcggaaccggctcacgctgcccagcggcatcgccaccggagacgtcacgtcggactcggcggtgctgtggtcgcgtgcgtcggggtccgggcggatgacggcaatcctgccgggccgttgacgacggcggcgaggtgctgcgcggccgcggtgccttcgagcgcgtcatgcggggccccgcgccacccaggcctccgacttcaccgccaagatccacgccggcaacctgccgtccaacacccgtttcgcgctggagatcagcttcgaggacgacggcggcgcgtccggtgagagcgtgcgcggcaccttccgcacggctccggacgccgggacgtacaacggcaggggccgcaccggcgggacgggaaacgcaagcgacgcgccgtcgtcgtccgcccaaagctttgtatggaccggcgacacggccgggcagggctggggtatcaacgaggagatcggcggcatgcgcggctaccgggccatgcaccagacgcggccggacttcttcatccattcgggcgatactgtgtacgcagacggtccgctcactcaaacggtggtggagaaggacgggcaggtgtggcggaaccttgtcaccgaggaggtgtccaaggtggcagaaaccctcaccgagttccgcggccggcaccgctacaactcgatggacgccaacatgcgcgccatgttcgccgacgtcccggttatcgccaactgggacgaccacgaaaccaccaacaactggtaccccggcgaaatccttgaggacccccgctacaccgtccgcgacgtcaacaccctcgctgcccgcggccgccaggcgtggcaggagaacatgcccatcgccgattccgctgcgctgtggcggccgggcacgttcgacgacgccggccagtaccagcccgcccgcatctaccggaagatctcccgtggcccgcagctggacatcttctgcctggacatgcgcaccttcaagtccccgaacacggacggcaaggagccctacgccactgccctcctgggccaggagcaggtggactggctgatccgcgaggtctcacagtcgaaggcgacgtggaaggtgatcgcagccgacctgccgctggggatcatcgtgcccgacggcgccgtgaaccaggagagcctggccaaccgtgatcccggcgcacctttgggccgcgagctcgagattgccggggtgctgagcgccttcaagcggaaccgggtgaagaacgtggtgtggctgaccgcggacgtgcattactgcgccgcgcaccactactcccccgagcgggcggcgttcaccgacttcgatcccttctgggagttcgtggccgggccgattgccgcggggtcgttcggcccgaatgccatggacggtacgtttggtccggaggtggtgttctcgaaagccgggcgcttccccggggagtcaccgcgcgacggcgaaaatcagttcttcggtcacgtccagttggatgacgggtcctttaccgtgagcctgcggaacgccaacggcgccacggtgttctcaaaggtgctgacgccggagcggtagagatgtccggttttaccgcggggccgggaggcgcctgtccatccgctggccggccacgatcagggcagccgtgacagccaccaccgcaccaaaataggtgagcgttccggagataccgaagctgacgtcgaaggtcccccgaaggaccaggtacgcagcgagcgtcacgatgacaacaagcccggccaggctccccacccgggcgcccctcgaggtggttgtgcctgcggggaatgaagcggcgtactcttttggctgcccgaaggccgcttcgccactctcgccgctctcggccaggtggctgctgacttcctgcagcgtgctgccgatcatgtcttcgttgtgtttccgctggcgcagctcgtaggccagggccttcaggtattcctgtgacgacattcagtgtgccttcttttcctctagcaggtccttgatgagcgcagagaaccgattccagtccagggccgactcctgcagccgctgccggccttcaggggtcagggagtagaacttcttacccggaccggcgtccccctggcgccattccgagctgacaaatccatccgtctccagccggttcagcgccgggtagagcgttccgccgctcagcccgtcgaaaccggcagccttcagtgcctggatgatctgatatccataggcctcgccgctcccggcgacggcctgcaaaatgcaggtagggagcacagctctcacccaatcgctgggccatcgcttgtctggggtcatggctagatagtgtcacagactaagttgtcacacaacccaatgcggcaccgaaggtgacgccgccgcattgcccggccggacgccgtcgtccgttattttcccggccccgtgggtacgccgctggtagtgttcctgcattcggcaaggcacgcggacggagtgattctttgtgaaagacgacggactgacagaggctgtgcaggaagccggggcggtggagctgctgctgatccgccacggtgaaagcgaaggcaacgtggctgccaccgatgcccggatggccggggcggaagtcatcgccgtacctgcccgggacgccgatgtgaacctctcgggcaccggccaggaacaggccaaggcgctcggagcggcgctggcccggatcgccgaggaattccggccggacgctgtggtctcctccccctacgcgcgggccttccagacggccgagatcgcggtggaggccgcaggctggccggtaaaggtccagctggatgaacggctgcgggaccgtgaacttggcatcctggacaggctgacccggcttggcgtggagaagcgctacccggaagaggccgagcgccgcgagtggctgggcaagatgtactaccggccgccgggcggtgaatcctgggcggacgttgcgctccggctgcgctccgtcctggacgaattgaacaatctcggcagcgggcaccgggtgatgctggtgtgccacgacgccctgatcatgctcttccggtacgtgctggagggaatgacggagaaggagctcctggacctggccgccagcacctccgtactcaacgcctccattacccgcttcgtgcggcctgccggcgagggcccctggaccctggaaagcttcaacgtggccgaccacctgaccgaacagggcgtcacggtcaccgagcacggaggggattccagtgtccacccgaagtgaatccggttcgccaaccctcgtgacgccgtcgctgctgcgcgactggccgcttccggcgcccggggaggacaagtattcgcgcggctcggtcctggtgatcggcggcgcgcgggccaccccgggggcggcgctgctcgccggcgcggccgcactgcgcgctggcgccgggaagctcaccctggccgtggcggaatccgtagcggtccaggtgggcgtggcgctgcctgagtgcggggccatggggctgcccgaaacctccagcggatccgtcaccggtgagggactggacctgatctcgtcgtaccttgacagcgctgacgccatcctggtgggcccgggcctggacgatccggacctcgccgaggacctgctccaggccctcctggagcgggaggccgccgccggggagaagaacgacggcggaggtcccgccgtcgtcctcgatgccttcgctctgggtgccttggtgaacgtggagggccggtgtgacccgtggaagggccgcctgatgctgacgcccaatcccaaggaggcggagatcctgctggggcgggacctgaaggacctgcaggcagatgttgcggagatcgccgacaggtaccaggctgtggtgagctgccaggggctcatcgcccgcccgtccggcttagatgcgcccgaggaatcagagctctggaagattaccaccggctacggcgggctgggcacatccggcagcggggacgttctggccggggcgatcgccggcctccgcgcccggggaacgacaggcccgcaggcggcctgttggggaacccacctccatgcagctgccgcggaccggctggccagcaggctgggaccccttggattcctggcccgcgaactggccgacgagctgcccgccctgatgctggagctgaatacgtgattcagggtctttggctttaaagccggcctgggtccgggcatgggacgacccccggccgaagccgggggccaccgtctcgggaagttcaggcgcaacctgccgatgcgcgggaagcgctgtggcgtgctcagaatggccatccgccctaagaggcagtacacaatcagtgcccgacgtcccgatcctgtgttgaaactaggcggcgatttcctgcttcgcccccttcgtctcaatgtcgatcttccgcggcttggccttttcggcgacaggaatccgcagtgtcaggacaccggcgtcgtacgttgccttcacgttctcagcatccagggtgtccccgaggatcagctggcggctgaatacgccgcgcggccgctcggaggcgatcaactcggtgtccctgcccgcaggatcaggccgctcggccttgaccgtgaggacgttccgttccacatcaagttccactgaatccacatcgacgccgggcagatcaaaggcgacgacaaattcctggtcctcacgccatgcgtccatcggcatagctgccgggcgcgctgcggtgccgaggacctgctgggccagcctgtccagctcgcggaacggatcggttcgcatcaacatggcttccctcctcgtaagagacggtccaacacttttgctctcagccgatctgtagtggctgatatagattttttatcactggtgaggcaggtccgcaagcatcgcaccgaagattttttggacgttcttagggtgccgggatgtgggtcgaaaggcgggaaaagggggccttccgcgtggtgcggaaggcccccttttgagagacgggtcttgggttgaatgctgcgacgtttccccggtgccggcctagtcccgggtcgggtccggccgcagcggtgcgggaccggggtccggtacgggaagcggccctggaggttctggggcagggaacggattgggcgccggcgggccggggtgcccggggtggtccggatcaggctgggtggggcccggttccggcgggaacggctcgggctcgtgcactggcgggatggtcatgaatttcccctctcacgctgggcggatgtgccttggcgtgaacaggatacgcctgccacctcaagcccactaggagccgccgagtgggagagggtcccagggaaacccgcatcaagtgagagagcgtcttagggaaaccggcgtcaagtgagagagcgtccggggtgggaggaggcgggtttggcggtgtaatcccccggtagcgaacggcggcaaaattgtcggggcggctctatatattgaaggcatgacccagactccgctgcaggactcctccgctaccgccattcccaccccgccggcggccaagaaaatcccgtccgaacgcctccaccacggggacaccttcgtggacaactacgagtggctgcgggacaaggaatccgcagaggtggtggagcacctgaaggccgagaatgcctaccaggaggcagtcaccgcccaccaggagccactgcgggaggccatcttccaggaaatcaagggccgcacgcaggaaaccgatctctccgtaccgcaccgcaaggacggctggtggtacttcagccgctcggccgagggcaaggaatacggcatccagtgccgggtcagggccgcggacaccggggacaagatcgccgactggaccccgccggcggtgcagcccggcgtcgggatccccggcgaagagatcctcctggacggcaacatcgaggccgagggcaagccgttcttctcggtgggaggttcggccgtaacggtcgacggcaacctctacgcctatgcggtggacaactccggtgatgaacgcttcaccctccgcatcaaggacctccgcacaggagagctgctgcctgacgtcatcgagaacatcttctacggcgtcgccttctcgccggacggcacccggattttctacaccgtggtggacgattcctggcgcccctaccaggtgaaggcgcacaccctgggaacgcccgtggccgacgacgtcgtcatctaccaggaggacgacgccgccatgtggctgggcttcgagctttcctccgaccgccggtacctggtgctgggcatcggatgctcggaatacagcgagacgcgcctgctccgctttgacgatcccgcccaggaactgaccaccgtcatctcccgcaacgagcgggtgctctacgaggccgagccgttcctcctcaccggcccggacggcaccgtcagcgaacgcattttgctcacgcacaaccgcggcgccatcaactccatggtgtccctcgcggacccggccgagctcaccaggccgctgtccgagcaggactgggtcaccgtcgtcgggcattccgacgacgtccgcgtcaacggggccggcgtcacctccacgcacctcatcgtgtccatccgcaaggacaccatcgaacgggtacaggtcatcgggctggacgggctgggtactcccgcgcaggaggcaccggttgaacccgccttcgacgaagagctctacaccgcgggcgttggcggctccgactacgaggcacccgtgatccggctgggctacacgtcctacttcacgccgtcgcgcatctatgactttgtgctgcccacccccgaagtgccggcaggggaactgctcctgcggaaggaaagcccggtccttggcggttatgacggcgacgactatgtggccacccgtgaatgggccaccgctgccgacggcacccgcatcccgctgtccgtgctgcggcacaaggccgtgaagcaggattcgacggcggcgggcctggtgtacggctacggctcctacgagatgagcatggacccgggcttcggcattgcgcggctctcgctgctggaccgcggcgtggtgttcgtgatcgcgcacatccgcggcggcggcgagcttggccggcactggtacgagaacggcaagaagctcaccaagaagaacacgttcaccgacttcgtggacgccaccgactggctggcggcctcgggctgggcggacccgtcacggatcgccgccctgggcggttcggccggaggcctgctgatgggtgccgtggcgaacatggcaccagagaagtacgccgccattgtggcccaggtgccgttcgtggacccgctgaccagcatcctggatccggaactgccgctgtccgccctggagtgggaggagtggggcaaccccatcacggacccccacgtctacgagtacatgaagtcctactccccctacgagaacgtgcgcccggccgcctaccccaagatcgccgccgtcacgtccttcaacgacacccgggtcctttatgttgaaccggcgaagtgggtgcaggagctgcgcaacaagaccaccggaaccgagccgatcgtgatgaagatcgagatggacggcggccacgggggcgcctccggccggtacgtgcagtggcgcgagcgggcctgggactacgcgttcatcgcggattccctcggggccactgagttgttgccgggcgccggcctgaagtaggacgaaaacggcgtacgccatcgactgctccgatattgccgtttagagccccgagaacggcgttttcggagcaatcgatggggacgtccgggacctcaggcctgcgggtgctccaccagccactccgccagggtttcgaggttggcgcggacggtgcggccctgggcccgctcaacgagggggtcggccagcttgccgaaaacgccgccgaggccggtcgcagcgtcgatccgctgcgtgaggcgggtgccgccgtcggccggttcaagggtaaaggtgatggtgaagtcgagcttgccctcgacggaccgggacaccatgcgccggggcggatcgaactcggtgacctccacggtccagtcgaactgccggcccatgaccttgctggtgccgcgcccgcgggtgccgacgccgaggggcccgtcacccacctgctccgaggaggtgacggaggaatcgaagaccgcgacgttctggaacttcgacacgaagtcaaagacctcctgcggcggccgggcaataacaacactttcttctacaacaggcatgggagcctccttcacagggcacctgatgccggctcggctctgccggcacgataggcaggcacagcgccagagtggaccgctagccagcccctgtcaagatccttctgaccggccgattatttctccacacgatggtctataacggcggtttttacttaggtgaggcttagctaataccatcgtcggatgaccacgcagcttgatgtcgcgcgggtacctttcgctgccgatctttcgagctacggaaacaggcctgccatcctcgccgacggactgaccctcacctacagcgaccttgccaaccgggtggacagcttcgcccggaggctgggcaccgaacgccgcctgatcgcgctcgctgcctccaacgacgtcgaatccgtcgtcgcatacctggcagccctcgcctccggccacccgctgatcctcctcccggaggacaagccggcggcccttgagtccctggtggcagcctacgatcccgacgtggtggtgcgctcggccaacgggcagtgcgtcctggacgaacgccggcccgggacccggcacaccctgcatccggaccttgccctgctcctcagcacctccgggtccacgggctcccccaagctggtgaggctttcccacgccaacctccaggccaacgccgaatccattgccacttacctgcagatcacccaggacgaccgcgccgccactacgctgcccatgtcctactgctacgggctctcagtgatcaacagccacctgctgcgcggcgcaggcctggtcctcaccggcctgtccgtcgtcgatccgtgcttctgggagctgttccggcgggaggaagccacagccttcgccgccgttccctacaccttcgagctgctggagcgcgtgggcttcgccgacatggacctgcccagcctgcgctacatcactcaggccggcggccggcttgccccggactccgtacggcactacgccgaactgggccgggaacggggctgggacctgttcgtcatgtacggccagacagaagcgaccgcccgcatggcctacctgccgccggacctcgcaaccgactatcccggcgccatcggtgttcccgttcccggcggaaccttccggatcgagcccgtcccgggacttgccgacggcgaactggtatacagcggcccgaatgtgatgctgggctatgcagagagcccgggcgacctggccttgggccgcacggtcaccgaactgcgcaccggcgacctcgcccggaagaacagcgccggcctctacgaggtgcgcgggcgccgcagccggttcgtcaagatcgttggactgcgggtggacctgggccaggtggaacgtctcctggccgacctcggcgtggacgcagccagcgccggaacggaccagcggctcgtcgtcgccgtcgaaggggaccacgacacccacctgctcaccaaggtcctggcccaggggctgggattgccgcgggccgccgtcgacctccatgccgtggaggagctcccccgcctggggacgggaaaagtggactatccggccgtggctgccctgccggcggcacaccctgcccgtccggccgcagccactgaatccacggcggacgcttccggtgccgcaggccggcacagcagcgccacgcagccggacactgtcaggcggatcttcgaggacacgctggaactgccggacattgccgacgacgacacgttcgtttcgctcggcggtgactcgctgtccttcgtggccgcctctgtccggctggagcaggtgttggggcacctgccggcggactggcacgtgacacccgtccgggacctcaaaccgcggccggacagtcgaacggacgagcgccaggacgggccccaaggtgaaaagccggcccgcccgtggaccgcgcgcctgctggccccgatggacaccagcatcgtcctccgtgccgtcgggatcttcctcattgccagcacccacatcggcctcttcagctggcagggcatggcgcacgtgctgttcgccgcagccggattcaacttcgcccgcttccagctctccggcgacaggatgccccgcctgcggcgccagctcaccagcgtggcccggatcgcggtgcccagcatggtgttcatagccttcgcctacctggtcacggaccggtacagcctgctaaacatcgtgctcctgaacgccgtcctcggccctgagcaggtgaccacgcagtatcacttctggttcatcgaggtgatggtctacatcctgctggcaatgacggccctgctcagcatcccctggctccaccgtgcggaacgccgtttcccgttcgtcttcccgctggtcctgttcggtgtcggcctgctcacccgctttgagcttgtagagcccggtgtcccccataccgtccccgccttctggctgttcgccctcgggtgggcggtggcccgctcccgcaccctcccccagcgctgtgccgtcaccgccctcacgctcctcaccgtcccgggattcttcgagaacccctaccgggacctcaccgtgatggccggaatcctcatgctcgcctggctgcccaccctcccggtgccgcgggccgtgagccggctggtagtcctgctggccagcgcctcgatgcacatctacctggtccactggctggtctaccccctgttcaccggcatcagcgttcccctggccgtggcagcctcgctggctgccggggtggcctactgggccctgtgcaacagggctgccggggcagcagcccgccacctggcacggaggtgaggtgacgacggcggccgcctcccgccgtcgtcacctcaccttcagtccgcggcagtacccggaaaagctaaccgtgcttactattgtggagcacccgtattccggccggagacctccacggcccggaccccaccaaaggagcaggcatgccgctacgcaagggaacgtccgtcgaatggaacacgtcgcagggcatgacccacggaaagatcgttgagaagaagaccagcgactttgagctggacgggcacacgcaccgggcgagcgaggacgagccgcagtacgtggtggaatccgccaggaccggcgcccgggccgcgcacaaggcttctgccctgaccgaaaagaagtagcgctgtggccgcccagcatgaagtggtgatcatcggcgggggcaacgccggcgtttccctggccgcccgcctggaacgctacggggtcaaggacgtggccgtcatcgagcccaaggaccaccacctctaccagccgctgttctcccacattgccggcggccgggcccaggcccaggaggccgtccgctcccaggagtcggtgatgccccagggcgtgacgtggatccgggacggtgccgtgggcgtggacacggacacaaataccgtcagcctggcctcgggctcgtccgtgtcctatgggcagctggtggtgtgccccggcctgcagtatgactgggacgaggtgccgggccttgcggcggccgtgcattcgctgcacggggcgtcgcattacgagttcgagctggcacccaaggcctggaccctgctgagcgggctcacgtccggaaccgccgtcttcaccatgccggccggtcccatcaaatgcggcggcgccagccagaagcccatgtaccttgcctgcgactactggcgcgaacagggcgtgctggaccagatccgcgtggtgatggtccagccctatcccacagtctttggggtgcccgagatcgaccgggaacttgaccgcaagatcgccgaatacggcatcgaactgcggaccaacagcgaactggtttccgtggacgcggcaagccggaatgccaccattcgggacatctccacgggcgccgaagacaccatccactacgacgtgctgaacgctgttccgccgcagtcggcaccggactggctcaaagccacggacctgcctgcctccggagacgccggcgggttcgtggaggtagaccgccagacgctccgccacatccggttcccgaacgtctggtccctgggggacgcggcagggaccaccaactcaaaatccggcggcgccctccggaagcagaccaaggtactggcccagaaccttgtcgccgcgcggaaggggaagccgctgcccgcgaagtacaacggctactccgtctgcccgttcacggtgtcgcgggacaccgtggtgttcgccgaattcgacgaccgctaccggcccatgcccaccattccccgggtgcccacgtggaacgagagcaagctgtcctgggtggtggaccgggacattttcccgcaggtctattggaacctgatcctcaagggccgggcgtgagtgagagagcgtccggggaaaaccaaccttaagtgagagagcatcccgggaaaaccgcccctaagtgagagagcgtcccgggaaccccatcgagtgctccgataatgccgttttgcgcgctgaaaacggcacctacggagcaaccgatgaggagacgacggcggccgtcgcctccgcgatggcgcgctcctcgtcggtgggaaccaccaggacaggaatggcggacccggccgtggaaatgacgcggggttccttggaccgctcggcgttcaggccggcgtcgagctctacgccaagcgcgcccagccggtccgccaccagcgcacggaactggtgcgagttctcgccgatgccggccgtgaacaccagggccttcgccccgcccacggccacgtggtatcccccgatgtacttggccagccggtaggacgtgaccgcgagcgccgtagcagccctggcatcgcctgactcggacgcctccaccaccgagcgcatgtcattgttgccagccaggcctttcagcccggactcgcggttgagcatggtgtccaggtcctccggggtccagcccgcccggcccaggaacaccaggatggaggggtccaggtcgcccgagcgggtccccatcaccaggccctcaagcggggtgaagcccatggacgtgtccacagagtggccgccccggatggccgtgacggaggcgccgttgcccaggtgggcgatgacgccgtcaaactcttcaacgggcaggtccagcagcgcggcggcgcgccgggtcacgtactcgtgggacgtgccgtggaagccgtagcggcggatgccgtggttggtgtagagctcgtccgggacggcgtagcgccaggcgtgctcgggcagcgtgcggtggaatgcggtgtcgaacacggcaacctggggcatgtccggccactttttggtgatggcccggatccccaggacgttggcggggttgtggagcggcgccagcgggttcaggcgctcgatggcgcgggtgatctcgttgtcgatcagcacgggctccgcgaagcgctccccgccgtgcaccacccggtgtccaactgcggccagctccaggccgccaagttcctggtggatggcggcatccacctgttccagcgcctcggcgtggtcccgtgggccctctatctcgccgtccccgccgccgccgttgcccatgccgatcttctcgatcagcccctcggtcaggacgctcccggcggcgacgtcgcgcacctggtacttgagcgaggacgagccggagttgatgacgagcacgagcatgtggggcctcctgagccttgcttctgcggttcaaaccccactataggcgggccggggcacgggtttcttgcggacaggcgaggctggggcctagagtcggcacacgagctggaccacgcccgagaggacactttcatgacgaacgagccgaattcgatcgacgagaacgaccccaccaacacgggttccagcagcacggcgcccctgaacgcgcaggcggattcggataccggttcccgttccggaaagaaagaccccacggtggtggaaggcgccaaccctgccctggacgacaccggcgccctgaaagctaaggaaaccggcgaggcacccgaagccccggagaacaccgaggacctggacctcaccccgcagggactgtccgatgagccagccaaacaggaggacccggccagcctggcgaagccggacaacagctgacgcggcgctaagcaccccgacgcaaagtaacacagcgctaagggcgacggcggcacccacggaggtgccgccgtcgccctttgtcggtttgcttggctgtggcccggaagcgggccctgggaagcaggtcctggtacgtaggtcctaggaagcgggggcctgggcctggatggccgtgatggccacggtgttgacgatgtcctccacggtgcagccgcgggagaggtcgttgaccggcttccgcagcccctgcaggacgggcccgacggccaccgcccctgagctctgctgcaccgccttgtacgtgttgttgccggtgttgaggtccgggaagatgaacaccgtggcctgcccggccaccgacgagcccggcatcttggactcagcgatggaggcgtccacggcggcgtcgtactggatggggccctcgacggcgaggtccgggcggcgccggcggaccagttcggtggcctgccgcactgcgtccacggcctccccggagccggaaccgccggttgagtaggacagcatggccacccgcggctccaccccgaactgcgccgcggtctccgccgaggccagtgcgatgtccgccagctgctccacattcgggtccgggttcacggcgcagtcgccgtacaccagcacccggtccggcatcagcatcaggaacacggaggacacgatcttcacgccctcgcgcgttttcacgaactccagggccggccggatggtgtgggcggtggtgtgcgccgcaccggacaccatgccatccaccacgcccagctggaccatcatggtgccgaagtagctgacgtcctgcatgatctccagcgccttcgccaggtccacacccttgtgcgcccgcagttccgcgtacttttcggcgaacttctggcgcaggtccgaggtggccgggtcaacgatgttgatgccggacaggtcgatgccgcgggcggccgccagttcgcggacctccgattcggggcccagcacggtgaggtcgcagacgtcgcggcggtgcaggatctcggcagcccggaggatccgcacgtcggtcccttccggcagcaccacgtgccggcgctgcgacctggcgcgttcgatgaggtcgtgcaggaagcgcagcggggtcatccgctcggcccggggcaggtggaggcgctccaccagctcggtctcgtccacccggcgggaccagaggcccagcgcggacgccaccttgcggcggtgcccggaccagatctcgctgcggacctccgaaacccggcgggccgtggtgtaggtgtcctccctggcggcgaacacggggaacggggcctgcgccaggagcgggtagatgttggcgtccggagcgagcccgccggtgaggatgagcgcggaggccaccgggaactcgggcgagaaggacgccgcgaggcacgccaccatcacgtccgcccggtcgccggggacgatcaccagggcaccctcgtccagcacgttcaggaagttgcccacgttcatggcggccaccttgatgtccttcacgtcgcgttccatgtccggccgtccggcgatctggcggacgcccagtgccgcggcaacctcgccggtggtgggccgcgcgatcgcctccagctccggcaggatgtacacgggccgcttggaggcgccgggcttcacggcggcggcgattgcgtccaggtcctccggatctgcacggttcaccatgatggccagcagggtgcacctttcggcggcgagctccttccgggcaacctcgacggcggccgcggcttcggcgacggtccgccccttggcgcccaccaccgccacgatgggggcggccaggttgttggccaggcgggcgttgaggtcgaattcgacggcggagtcctggcccaccaggtccgttccctccacgatcaccacatcgcagtgccgcgagatctcggcgaagatttccacgcagcgggcgtcaatctctgcccggttcccctcggccagcagggaccggacttcctcgtgggtgagaccgccgcggcagcgctcgtcctccagcgcgaaacgggatttcatcagcgcgaccatcggatcggccgcagcgtccggaccatggaccacgggcttgaaaaagccgatcctgtccgcatgccggtggagggtgtccgccagacccagggccacaagtgacttgcccgatccgggggtggttgcgctgacgtagatgcctttggccatggtccgccctttgctgtgctggtgccggttactccatccttgcacttcggcacgggctttcggcagcgttggagttcgccgggcctgtggtgatgggcacgggatgctgtggcggcgggcacgggggcggtggcactgcacatcaggcgggccggcggcggccggtgcgtgccgccgtcgtacattccagcccaggtgcttctcccaaccccatccggcgcgccaggcacgacggcgtgtcccggctccggcgcgcggtcccgccggagaaagtgggcaggaacggccggccgcggacgccccggcccttgacaccggacccctccatgggattacctaatgaacattcggtaaataaagctggaggcaatgacgcatggctgaaaccaccctttccgggcccacacaccagatcctggagaacgactacgcctccgagtggatgggcatcgaagtcctcgccatcagcgacggccacgcgaccatccggatgaccctccggcaggaaatgctcaacggcttcggaatggcccacggcggaatgatcttcgccttcggggacaccgcattcgccctcgcctgcaaccccgccgtccaggcacccggcgaggaaaacagcatcaccgtggcctccggcgtcgacatcaatttcctcaagcccgccttccgcggccaggtgctgaccgcggtggcggaccgccgctccagcgccggacgcagcggcctgtacgacatccagattttcgccacggatgctgcaccctcccccacgggccagcccgcaccggcccagcccaatccagcccagcccagttcagcccagcccggcgagctcattgccgagttccgcggacgcagccgcaccatccccaagaagtaggaaaatcatgaccctgcatgcccccgaaaccccctccgctgccgcagcaacggccgcaggcactaacgtcatcctggaccgcgaggagaccatgtcccgcgacgagctcgaggccctgcaactcagccgcctgcagcacaccgtggcctacgcctacgaacgcgtgcccctctacaagcgcaagttcgacgacgccggcatccacccgaacgacctccgggaactcagcgacctgggcaacttccccttcaccaccaaggacgatctgcgcgaggaatacccgttcggcatgttcgccgtgccgcagcacgaagtagcccgcgtccacgccagctcgggcaccaccggccggcccacggtggtcgggtacaccaaaaaggacctggcggactgggcgaaactcgtggcccgcagcttccgcgcctccggcatccgcccgggcatgaaagtccacaacgcgtatgggtatggcctgttcaccggcggcctgggcgcgcacgccggcgccgaagccctcggctgcacggtcatccccatctccggcgggcagaccgaacgccagatccagctgatccaggacttcaagccggacgccatcctggccacccccacgtacctgctcaccatcgcggacgccatggcgcacatgggcatcgaccccgcctccacctcgctgaagtacgcggtgctgggcgccgagccgtggaccgaggaaatgcggcacgaacttgaggtcaccatgaacctcaaggcctgcgacatctacgggctctccgaggtgatgggcccgggcgtggccggcgaggccgtggagacccaggacggcagccacatctgggaggaccacttccggcccgaaatcatcgacgccttcaacccggtggtgggcaaggagaatgtgctgcgcgacggcgagcacggcgaactggtgttcacgtcgctcaccaaggaagcgctgcccatcatccggtaccgcaccaaggacctcacccgcctgctccccggcaccgcccgccccgcgcaccgccggatgggacgcatcaccggccgcagcgacgacatgatcatcctccgcggcgtgaacgtgttcccgtcccagatcgaggagatcgccctccgcatccccgagctcagcccgcacttccagcttgaactcacccgccccgaaggccagcggatggaccagatgacggtgaagatcgagcgccgggagaccgtcaccatcgagcaggtttcgacggcggcgcgcaccttgaaggagcagatcaagatccatgtgggttcttcctgcacggttgacgtggtggaccccggctccctggagcggtccaacggcaagctgcgccggatttacgacatgcggcccaaggcgtagcggctaagcatcactaggcggagcccgggacctggcgtcccgggctcttccgtcatgtttccgcccggctcttcccttccgcgatcaggacgaggtttccgacgacgtcccctccttccagccggatgtgggcccgcttcgcctcgagcaagggaaaccggccggcgatcacgggagtgatcttccgcgcctccagcagctcgtacaaggtggtccaggcgtccatcaatggctgccggtccagccgccaggatgtggtcccgtagaggcggatccttgtgccctccgggaccaggttgtgcctgatggcgcgtgccaggagacgcagggtggaggccgggctgccagggttggcgtactccacgagcaccccgcctggccgaagcacggcgagtccgatgtccgtccagcctccgcccgttccgtccaatacggcgtcgacaccggaaggctccagcaggcgcagggcaccaatgacttcttcgcctttgacatccagtggaaccacgccgtggtccctgagccaagggtgcttggcgggaacatccacgccgtacatcctcaactccagcaggcgcccgagttgcacgagcgccgttccgatcccgcccgccgctccggtgacaaggatggcctggccgggccggatccgggcaaccctggagagcgtctggtgggccaccagatagttcagggccacggccaccacatcgcccgcgtcaagtgcggaagagattcgcatcatggggtgggtggtcacgaagatgtactctgcatacccgcccttctccgtcatgaccaccacccggtccccaggggttgcggccttgacccccggccccaccgcatcgacaacacccgccacggcatagccgggcacaaagggaaacgcgggcgggtacgtggagagcccgttgcgggcctgaacatcaacggcgctcacactgcacgcctccacccgcaccctcgcctcgccccgccgcggtgacctcagccgccgtcgtacaacctccagcacctccggaccgcccatacgggttgcggcaacacttccgtactcaatgggcggcagctgcagggcagccgccgcgtctgcgccggcaccaactgtcgccgcgtactcttccagctggcgcgcggcagtcggaccagacattgcgcggccgtgtccactcgccagcacgcggggacggagcccggccagcactgcgacggaggccatggccagggcccagtcccaggtggcaatccacggcgggccactgaccctggtggctccgctgaatagaccggacagggagttcaggtcggtggtcagcacggcgtccccggtgagcagcacgccgtcggactcgcggaaaagggcaatgtggcccggtgtatgtcccggggtttccacgcaggtccagtcctgcagcccgggaaccccggcggctggatcgaaggggcgcacaaggtccgtcatgtcggcggcgcgcatactcccctccggcagcaccttcagcaaagggcgcaggacccggcggtccagcgggctggcatactcgtccagcagcgtcccggcagcctgcggcagctcggcggggtgcacgtagacaggaacactccaccgccgggccaaagcaggggcgcagcccgcgtggtcaggatggatatgggtcagcacaatcgccgcgggccgcgtacctgaaccaaaaagggattccgccgccgccacaatggactgctctgcactgggccagccggcatccaccagcacccacccctggcccgagcgcaccaggtaaacatgggaggccatctgtttcctgccggtgggcagttggtagacgccgcgcgcgacgacggctggctggggcattctggacgtcatcctcgccggccttcctgggtcacgcggcggcactccgcctcctaccagcgtggtccctccggatgaacgggccacagggtccaaagtcctgcgaagtcttatgccctgattaccgaacgttcatgagaaaatggccgttatgtccccaactgatgcacccaccaagcgcggccgccccggatacgaccagcaatcggtgctgcgcatcgccgtcgacgtcttcaaccggcacggttacgacgccacgtccatgggcatccttgcggacaacctgggcatctccaagtccgccatttaccaccacgtgccgtccaagggtgacctcctgaagctcgcccttgagcacgccctcggcgggctcgaggccattctggaagaacccgcagccacgtccggcgcggccgacgcccgcctggagttcgtgctccgccagaccgtggccgtcctggtggaccggctgccgttcgtcacgctgctcctgcgcctgcgcgggaacacggagatcgagcgggacgccctggagcgccgccgcgccttcgaccacaaggtggccgggttgatctccgcagcacgcgacgaaggctccctgcgccaggacatcgatccgcggaccgtcaccaggctgctgttcggcatgatcaactcgatcgtggaatggtacaagccgggcgggcccctctcccccgaacggctcgccgacgacgtgatcaccatggccttcgacggactgcactccacccagcactgagccaaatactaagggtgcttggtatttccccggatccccggctacggtggaagaaaccagccagaacccggaggaggccgtccataaataccgtcacccgccgggcgctgccgcgtccggaccgcttccggaccgccgcgggagttgcactgctcacggcatccctggccctcaccggctgcaccggctccacgcctcccccggttcccagcggctcctccagccccgggtccgcgtcaacagctacgcctaacagcaccgcggccccggcccccgcgccggccgcggaaggcgatatcccccagctggtggagaacctcgctccgtccgtggtcaccatcttcacggacggcggcctgggcagcggcgtggtctactccgaagacggcctgatcctcaccaacgagcacgtagtccggggcaacacccgcgtggaggtcgccttcgctgacggccagcgggtggagggaaccgtcaaggccaccgaccccgtgacggacctcgccctggtgcaggccaaccgcaccggcctgcccaaacccgtgtaccaggccaacctcccgcgggtgggtgaaggggctgtggtgctcggctcgccgctcggcttcgagaacaccgccaccgccgggatcatctcagggctgcaccggtccattcccggttccgcctccaacagcctctccctggtggacctgatccagaccgatgcgcccatcagcccgggcaactccggcggggccgtcatcaacatgcgcggcgaaatcatcggcatcagcgaggcctacattcccccgtcagccggcgccgtggccctcggattcgcgatccccgccgccaccgcagtggaggtcgccgaggaactgctggcggacggcactgccgagcacgcctacctgggcctcaccccgggggaactgaccccgcagatcgcgggccagttgggcatagacgcaagcaccggcgtcgtggttctggcagtggacgacgacggcccggccgcacgcgccggcatccgcccgggtgacgtcctggagtccctggagggcgcggacctcaccgctccggaaaagctcctggcggaactccggaaccgcaaccccggcgataccgtaggcttcaaggtcaagcggcaggaccagagccttgacctcaaggcggacctcaccgcgcggcccacaagtaacacccgataggaaggtaagaaaatgagccaccccaaagacgaagcagacgccggatacatcattccggacccctcaaaggtccgtgaggacgtccccggcgacgccggcgatgaagccaacgtgatccgcttcagcgaagagcaggccctgatcgaggaacagtcccacggcatccgcccggacacctacagcatcccctccggcggccccaccatggctgaggcccggggcaacatggacctctcggaccaaagcgaaagcgggcacggcaccggccgcgaggatgacagcagcgacgacagcctgcacggcggcgccgagtcctgatctcacggctgccggcacggctggctgcaagcacggcagaaggggcggtcccggtatcccgggaccgccccttcgtgtatcaccggtgcgtggctagagttcgtattcggcctggacgccgagcttctcgtggacacacaggatgttgtgctccgtgtccataaaccacgcgcacttctccgagtcggtggtgcagatgtggttctctgtcttcaggtcgggcaggtcgtagtcctggaacgcgacaccccttgcccccatgtcacggaccgtccgctcaatgtccgtcacctcgaagctcagggcggtgtgctcggagtgtttgccgtccgagaccggcatcaactgcagcatggggccgccgtcgccgccgagcaattcgcttccgtcatctgtcatgccgcggtgcgggagtccgagcttttccgtgtagaaccttcgggcgcgcgctgcatcatcgactggcaggacggttgtggctgtattcattcttagattcatgtggccacctcctacgggcagaattttacgcttccgcccaccaaaaagaaccgcccgctgcagccccagacgctcctcccccacttgatgcaggaaatcccccaacgctctctcacttgatgcaggaaatcccccaacgctctcccacttgatgcaggaaatcccccaacgctctctcacttgatgcccttaaatcgccaacgctctatcggagagtgatagagcgttggccaaaatgatgcaggaagtgagagagcgtcacgctaaaacgcacatcaagtgagcgagcgtcacagaaaaacgggcgttaagtgagagagcgtgccgggtgggggttacttggctacgagggtgaggacgtcgtaggtggccacgatctcgtcgttctggttggtcaggacggcatcccaggccacctcgccatactcgtcggtttcacgcggggtgatcttcttggcggtgagcgtcacccggatggaatcgcctgccgccacgggggtgatgaaccggaggttttccagcccgtagttggccagcaccggacccggagcaggttcaacgaacaggccggcaccccaggccagcaggaggtagccgtgcgccacgatgcccgggaagaacgggttggcttccgcggcctcgtggttggtgtgggcgtagaaggtgtcgccggtggagttggcgaaggccgaaatgtcctccagggtgacctggcgcagctcggaccggacggcgtcgccaatcctcagggtctccagcggcttccggaacgggtgggtcccctccgtctcaaccgtgaagttccggctggcacccgcgtgccacacacccgtgacggcggtgagcatgttcggtgaaccctgaatggcggtgcgctgcatgtggtgcatcaccgaacggatgccgcccagttcctcaccgccgccggcccggccgggcccgccgtggaccaggtgcggcacaggcgaaccgtggcccgtcgacgaacgtgcgtcctcgcggttgagcatcagcacacggccgtggtgcgccgcgatgccggtcaccagttcgcgggccaccgcgggatcgttggtgcagaccgaggccaccagggagccgccgccgcgggcggcgaggcggacggcgtcgggtatgtccttgtacccgatcaccgaggagacggggccgaacgcctccagggaatggacttcctccgcctccgggtcctgccagttcagcagcacgggcgccatgaaggcgccgccgtccaccacgcccgtggatccgtccgcggacgtgaccgacggcgaatcgagcgttccgtaggccagctcaccgccgttgtccagcatcgtctggacggcggcccggacatccttgagctgctccaccgaggcgagcgcgcccatggtgacgccctcggcccgcggatcgccaaggacaacgcgctcggagatacgcttgccgacggcggcagagacggcggcaaccaactcctgcggcacgatggcgcggcggatggcggtgcacttctgaccggccttggccgtcatttccgtgaccacggagcggacgaaggcgtcgaattccggggttccctccacggcatccgggccgaggatggcggcgttgagggagtcggtctcggatgtgaagcggacgccaccttgcaccacattggggtgcgatttcaaggacagggccgtggaagcggagccggtgaaagccacgaggtcgcggtagtccaggacatccagcaggccgcggacggagccggaaatgagctgcagcgagcccttggggaggatgttcgattcaacgatggccttgaccaccgcggcggccacgtacccggtgggagtggcgggcttgacgatggtggggacgccggcgaggaaggccggggcgaacttctccaacatgccccagacggggaagttgaaggcgttgatctgcacggccacgccggggatgcgggtgtagatgtgttcaccggcgaaggaaccgtccttggacagcacttccatgggcccgtccaccaccacctgggagttgggaagctcgcggcggcccttggacccgaacgtgaaaaggacaccgatgccgccgtcgatgtcgatcatcgagtccaccttggtggcgccgctctgggcggagaaggcgtagaagtgctcgcgccgggcgttgaggtactgcgccagctccttgagcttgagggcgcgctggtggaaggtgaactggccgagttccttctggccggtggtgcggccatagtcaacgacggcggccaggtccagcccctcggtgctcaccttggccaggatctcccccgtgctcgcgtcccggacaggcgtcgcggaagctgccgctccggcgtcgggcgtccaccacgaatccatgatgaagctgggcactgtctccacggtgtcgaccgtggcctggggagctgtggctgtggtggtcatcgttgacgggtccttccaacaaaggggcaggcaaacaggacgagtcattactgaccgtccgttcggtaatatattcaccatacatgaagtgccgtgctgcacactagaaggccaggacggttttcggccaccaaaaggagaacttatgagcgccccatcacccatggatgctgccgagagcaagccttcggcgcacgaactgtggaagatcaccctcggcgaactggacgagaagatgggcgtcaagatcctcgaggagtccgtccagcgcgtggtggcaaccatgcctgtggaggggaacaggcagtctttcgggctgctccacggcggggcgtcactggctgtgggtgaagcggtgggttcctgggcggccgtgatccacgcgagcacgctgggcaagacggcggtgggagtggacgtttcagccacccaccaccgctccgcgcgggaagggcagatcaccattacggctacgcccatccacctgggcggcacgctcaccacccacgaggtgctcatcaccaacgaggccggtcagcggctctgcaccctccgcatcaccaacctgctgatgcggcgccacaagtagcctgctggcctgtgagttggcgtcgttattccggcgtgtgctgcctccggcggcggacgagtgccatcaacaaggttccgacggcgatcgccccagcggccccgcccgctgcggggaccccgctggcacccgtgtacgccaggccgccgtagtcgcggtcccgggaggacgcgtctgacggttccgcgggagtggtgcccgcaggcgcaggcacgacgacggcgtcctggtcagccggggaagaatccgccggggccggggccgggtcagccggggccgggtttgccggcacgggcgccggggccgggtcaacgggctggcggggggctcttccggctccggcggcaccggcggggccggtccttccggggcagcggcggcgaactcgaagtccgcagcaccggaggcactgaacccgttgacggtctgcgcggtaaaccggagtgtctccttgccctgcggcgccgggaagctccaggttccgtccgcgttgacggggacctcaaaggtgtcctgccccgggatggtgatccggacgtttgagtcggcagctacggcagtggcaggggccgcagggacggtgccgctgatgacctgccccggttcataggtggtgccgggcgcgggagaggacaccgcaggcgtgttgaggaagagttccagctggtagccgggcagcacggccaggctgtccgccagggtggccccgaccgcgaaattctccaccacgttgccctgttcatcaggcgtgtctccggcggcatgggtgcccacggcgtagttgccgctgacatacgggccgccggaatcaccgccgctggactggacgccgtaggacaggaagccgttgaacgcccgcaggtcgttagggtccgccgcgtagcctggcccgggaaccacaaagatccccaccgcatccaccgtgccgcaggaccaggccgaagtccggcccgatcggcacacccgcgtccccgccacgggctcggccgtgccaatgatcttgacgtcgggttccggctgggacacgtcgccccaggtgctcgctgccggcagcggatccaggtccgcgggtagggattcgaccaccgcaatatcggttcccacatttcccgggtcgtccggctggagcgggtcattcacgctcccgggccgcaggaccgggctgttcccagggccgccgaattggctgaaaccgaacttcccgagcggccctgtccggttgaactggaattccagctctgccgtttccgctgccccgtccgaggcacagtggccagccgtgaggacggccgggaggccggccgggtcaaaggccgaaaagcccgcggagcagatccagccggtgtcggcgatgtagcccactcccccgggaacgtcggcctccggcgctagcggcgtgccgtcgtcgagctccacgttggcgaaccgggcaacaaactccgccggcgatttcctgccggtgcccgccgcttcggagctcccggcctcggcagctgcggcaccggtaccgtccggggcggcttcgggcgcgttgacgccaccggtacggataacgaactttcctcctgaggtgaccaccgcctgcagtccgtggatccccacctcggccacgtatgcctggaacagctgctccgtgctcagcgccagctcggagccagggttcggcgcggcggggctcggcgtggcagggtccggcgaggcaggcatcgcggcgccggctgaagccgcctccatcacaaggcccgggatgccggcggcgagcgccgccaccgcgtccgggagttcgccacctgttccggttaccacgatctgcccgtcctggaggcgggtgcccgcataaccggggacagccctgagctgcccggcggcggctgcggcccgggcaccgatttccccggcggcggcgaactgctccggggtgaggccgaggtcccgctgcacggcctcgaccagggcggcgtccgacaggaaggaactgtccgagcccgggacagccccggcatccgcgccgtcgcccggaggaaccacagcccagcccggcgcagccacagcagaggatgcgaggattcccgcggccgcgccgagggaaaggaaccggcggacgctgcgcccgctcaccgggacacccccgctccgcacagggcccggacggcgtctagctccgcggggctgagtccgttgtccagcaggaacgcccgggtatccaggctccgcacgaactccgcaactgtgtttccgcgggcctcgagcagcgggaccagttccgcctcgctgaggtagcgttcgcgcgcatggggcgggccgtgggtgcggtagcgctcgttgatgccgcgggccgcgcgccggtagccgtcggcgatgtcctgcccggagtcccctgcaaggtcctggaccatggccgccaccatgccgctgcggtcacggccggccgcgcagtgcagcaccacggcaccgcgggctgaggctgccgcaagctcgcggaagacgcccaccagcttgtccgggaacagccgcgcgttctccggatagtgggcaggatcgttgaggtaggggccggtcactgcggtaaagcgggggtggccaggctcctcggtaggcgctgaaaccaccaccatcccggaccaggctgcaacccccaccacgggatcggagtcccggcgctgcgcttccgcagcgttacggaggtcgatcaccgtgcggatgccgtcttcgtacacctgccgccagcccgcctcggtgagccattcgcgcctgcccatgcggtagacgccgccggccacatgccaggcgttgacagcaccgtcccagtccatggtcctgcccggtctcttcatccgcacagctaatcacaccggccacaggaggcgcacgtcacagccaagtagtacggtggctcgtacttgccttcttccacccgttcaaggagagccacttgggaaacatcaccgtacgacgccgtcgctcggcttttgcagcaggcctcgccaccctcgctatggcggcagggctggccaccgtgccggcgcaggctgcggacaagaccaagtacattgcgctgggagactccttcgctgccgggcaaggggccgggccgtacctggatgactgctaccgcagcgataacacctactccgagctcgccgacgaggcaaaggcgatcaaactggttgccaacgaggcctgcagcgggaagacaacccaggatgtggtggacttccagcttgggcagctgaacaagagcaccgaactggtgaccatcaccgccggcggcaacaacctcggtttcggggacattattaactattgcggcgtcgtcctaatgaacctccccccagctccggaatgtggcggcgcgatcacccacgcggaggaacagctccagagcggccagttgaaaagtgacctggttatgatgatccagagcgtgcaggccgccgcgcccaatgccaggatcgtggtcacggggtacccgtatctcctggaccccatcccggccggcctgaccgacccgccagcgcagttcatctaccaggccactgacttggccgaccggctgaaccagacgatcgccgccgctgtcaccgccgttggcgaccccaaagtgcagtacgtcgacgtgcggtccgcgttcctcggccacggcgccttgtcgccagacccatggatcaaccttggcggcgcgcccgatggcttccacccgaacgccacaggctaccaggcgtacttcagggcactcagccaggccggcacttacgcggctccctagccccgccgggccagccggtactccaggcccgcccggaccatgggccactcgtgctccaggatggagaacaccacggtgtccctgaggagcccgtcgcgggtcctggagtggttgcgcaggacgccgtcctgcttggcgcccagccgggcgatggcctcgcgcgactggtggttgagccagtgcgtccggaactccacggccgggcagcccagcgtctcgaacgcgtgccgcagcagcaggagcttggaatcggggttggtcccggttccctggacggaggcggcgttccaggtggagccgatctccacccggggcgtgccggcgtcgatattcatgtaggtggtcatgccggtgatccggccgggcgctccggtgccggggtcgatcagccgggtggtgaacggcagcatggatccctgctcctgcaggtcgaggcggcgcccgatctcagcggccatctcctcgggggctggcaccgaggtgtaccaaagccgccacagctcgccgtcacgcgccgcgtccaccagtccgtcgtggtgctccctggacaacggttccagggttacatacctgcccgtgagggtaaggggttctaggaaagtcacggcaccagcctaggtgcaaccaccagggccggttacgctggggacagcaccaggacggcgagcgagggagtttacgtgtcaggaaccaatccggacccgcaggatgacaagatcacaggcctggagcccggcggcggggtgccgcccggcgaaacgcctcccggtgaagggtcggtggcaggcacccaggagccccggcagaagggctcagggaagggccagcagatcttctggataggcgccatcggggctggcgtcctgctgttcctgctctacttcatcggctacatcgtcggtttcttcgactgacccgcgttcctagccgggccattcgaaaaagcccttgccggttttccgtcccagctcgccccgggccaccttgtccttgaggatctgcggcggagcgaaccgctcgcccagggtggagtgcaggtattccgcgatgccgagccgcacgtccagccccacaatgtccgtggtcctcagcggcccggtggggtgcttgtaacccaggaccatggcggcgtcgatatcttcggcggacgcaaccccttcctcaaccatgcgcatcgcctccagggcgatggccacgcccagcctggaggacgcgaaccccggggcgtcattaaccacgacggcggtcttgccgagtgcctccacccacgccttcgcggcggcggcgagttcgggagacgtgcgctcccccagcaccacctcgatgagcgtggatgccggaacagggttgaagaagtgcaggcccaggaagttttccggccgcttcagttcaccggcgagtccgttcacggacagcgatgacgtgttcgaggccaggtaggcatcatcggccagccgctcctcgatgccgcgcagtgacgtgactttcaggttccagtcctccggcactgcttccaccaccagctggcggtccgcgaagtcgtcgtagtcaacggtgactgacagccgggacaccatttcgtccaggttggcgtccgtcatgccgcgttcgatgctcttggccgcggccgactccacgcgctcacgggcagcttccgatgactggtcgtcgcgctccaccacgagcacgtccgcgcccttgaccagaaaggcatgggcgattccggcgcccatgcggccgccgcccaggacgcccacccgtgagggcaggccgggggaaagttcgggtgtgctcatcggttctgctctccgctctcggtgccggcaggggttccggcggtggcagcactgccgccgtccttcttctcggttttcttgccggttttcttgtcggttttcctgtccaggaactgctgcatccggtcgaatttggcctcggattcaaacaggatgccttgtgccagctggtcaatgacgggatgcgcttccgcaggggcgtggaacacggacttggtaatccggactgccagcggatcctgccggccgatcctgtccgccaggctgtgcgccgcgtccatcagttccggtgcgtcgtggatttcggtgatgaggtttacggccagcgcttcttcggctgtgaggatctttccggccaggaggacctgcttggccacgggctcccccaccagttccttcagccgccagctggcgccggcggcggcgaggatgcccagcccggtttcggggttgccgatgcggacgctggacgtcccgatccggaaatccgccgcataggccagctccgccccgccgcccaggcagtacccgtcgagcgcggcaatgaccggcatgggcagcttggcgatgcggacaaagatggtggaattgatgccctgcagggcgtcatcccggcgccgttcgcgcagttgcgcaatatccgcaccggaggcgaacacgccatccacgccggcgatgatcagcaccttggggttctgttccagcgcggtgcagaccacgtgcagctcgtccaccatctgctggtcgatggcgttgcgcacctcgggccggttcagcagcaccaccacccggtcggtgcgctcctccacgaggagcgtgtggaacttctctgcggccaggtccacggggcccgccatcagaccttctccaacagcatggccgtaccctggcccacgccgatgcacatggtggcgaggcccctcctggcgtcctcgcgctccatccggcccaacagggtgatcgcgatccgtgccccgctggaacccagcgggtgccccagtgagatcgcgccgccgtcgttgttcacgatgtccggatccaggccaaggcgccggatgctggcgagggattgcgtggcaaaagcttcgttaagttcgacggcgtccaggtcacctgctctgaggccgctccgcttgagcaccttctgggtggccgggacggggccgatgcccatgatttccggctcgcagccggcagaggcgccgtcaatgatgcgtgcccggggcgtcaacccgagcctttcgatggcggcttcggaggccacgatgatggcggatgcgccgtcgttcagtgtggaggagttgcctgcggtgaccacggaacccccgtgcgtcacgggcttcagtccggcgaggacctccatggtggtgccttcacgcgggccttcatccgtgtccaccacggtctcggatttgcgggtcctgacggtcaccgggacgatctcgtccttgaaccgcccggcagcgatggcgtcgagggcgcgccggtgggaccggacggcaaaggcgtcggcgtcctcgcgggagatgttgtccacgcgggccacttcctcggcggtctccggcatggagtaggtcattttgccgtcgcgggaaagctcgcccttctggaacagcgggttggcgaaccgccagccgatggacgtgtcaaaaatggccccgggcttcgcgaaggccgtggcgggcttttcctgcacccagggcgcccggctcatggattcgacgccgccggctatcacgatgtccgcagcacccgacttgatcatgtggctggccatgatgatggcgctcagccctgatgagcacagcctgttgacggtaattccggggatgtggaggggcagtccggccaggagggtggccatccgggccacgttgcggttttcttcaccggccccgttggcgttgcccaggatgacctcgtcgatgctgtccgggtccaggccggcccggctgaccgcttcacggagcaccagggcggccaggtcatcgggacggacagcggagaggctcccgccgtacctgcccaccggcgttcgtaccccgccaacaaggaaagcctgtggacctgcggttacagccatggaaacacccttcacgcgataaacagcactgtcatcagcggccggcagatacccacttaccgaccgttcgttctgtaaatagtacacgggagggtgtgccgtggatacgggaacccctcagcgcaccggggtcctggacgctaatcagaggacagtgagccccagatgcgctgccagcaggggcgccaggaggccaagctgggagtcgtcaatgaccacgccgccaaggctgccgagtccgctgatccccctgagctccgtgccgcgcaggtcaaagtccttgagcctggccccactgaggtccagggagccgatggtgcagtccttcagggccaccctcgttccggtggccgagccgaggtccagttcgttgatgatgcagccgctgatcacgacgtcggtgagtttggcaccccggaggttgaggaaatcgagtttgccgccgtcaatgcggaccgactgccagccgctctcgtacagttcggcagaaccaaggcgggcattccggatctcaacctcccgccacgtggaacgggccgccagaaggaccggcgcgtacagctcctccaggatgcagtcgcggaaggtggaaccgcgcaactgcgcttcattaaaggccgcgccccggaattcacactcgatgaaatccgcgccgcccaggtccatcccctcggcagccacgcggctgtaccgcgcgccgtcgtaccgcccgccgcgctggaagtgcggctcggcgacgtcggtcaggttttcgagccggacaggcgtcaggcgcggtgccgcgacgccggaaggtgctgcccgcggggtgcgcgcggccatcagacggattccgccttggccgatatgtccgcgaggtccttgcggagcgctttccgggtggccgccattgccaccttgccgaagatcgccatcatgatgcgggttgcggcggtgggcttgtgcaccgctcccccgaacgtcacgctgaggtccgttccgccgtcgcgcggggcaaggttgaaccgcgtgctgtaatcagtgccgccctggacggccttcacggtggtgctgcgctgcggctcagcctgcgccacccacatctccaccgtctcggatttgcccatcatcttccgggtctccttccagcgcgttccttcgccgtacgggccgtccgtcagcatctgaacggactccaccccgctcagcgtggtggccgagccggggatgtccgtaatgacggaccagactttttccggcgacgcgtggatgtgctggctgaggctgaggctgatgctgtggtccatggcttcgagcctagccgcggcccccctcaatcgacagaacccggcgccttgaggggacttgaattagtaagcatgcttcgtgttagtgtgaaaatgttcgatcaccggaaacgaaaggacgccatcatcatgggcctcggagacaagatcagcaacgcagcggaagacatgggcggcaaggccaaggaagcggccggcaacgccacgaacaatgaccggctgaaggccgaaggccaggcggaccaggtcaaggccgacgcgaagaaggtcggcgaaagcgtcaaggacgagttcaagcgcgattagcttttcctgcaccgtccggctgggccggacggcctgaagcagggcggaacggcggcggatccctgtggatccgccgccgttccgcatgttcgggggtgtccccaccaacacttcatcgattgcttcaatactgccgttttgggacgccaaaacggcaattacgcagcaatcgatggaggccgtcaccatccgctgcgggtcggagtatgcccctgccgggattcctcgggcatcgtcatttcggcgcgcagcccgaggagccggatgggccggcctggctcgatcttcgccgcaaggtcgagggcgcgcgccagcacttccgcggggtccgaggtttgcgggatcttccgggcgtacgtcttggtcaggaacggcgcgtatcggaccttcagcgtcagcccgaccaccggccgcccttcggcagcgacatcgtccaggacgtgcgccgccagctccctcacggcgccgtcaatctccccggacccggtcagatcctgctggaaggtggtttcgcggctgtgcccgcgcgccacccagggcgtgtcgtcaactatccgcgagccgtcgccccgccccaactgcgcgtaccaaggccccatcttcgggccgaactcggggaccaggtcatctggattggacgctgccagctcggcaaccgtcccgatgccgagcttggccaggcgggcagataccttcgtccccacgccccacagctcgatggtcggccggctccccatgacctcaagccaattgccctccgtgagccggaagaccccggccggcttgccgaaggtcgttgccaccttggcgcggaccagggtgtcgccgatgcccacgctgcagtgcagccgggtctcctccaggacgtcgtgctgcagccggcgggcataggcttccggatcatccgtcaggacgccaacaaaggcttcgtcccagccgagcacctggaccgtggcgccgggctgtgagcgcagcaccgccatgaccttttcggaggcttcaaggtaggcctcgtggtccacgggcaggatgacggcgtctggcactttccgtgcggcaatgcgcagcggcatcccggagcccacgccgtacgccctggcttcgtaggacgccgtggacaccaccgcccgctccctgggatcgccgcggccgccaacaatcaccgctttccccgcgagctcgggccgtcggagcacttcgacggcggcgatgaactggtcaaggtccacatgcagcacccacggttcgtccacacgcccagtctgcccccgccggccgctccgcaccaccgttcccggccctccgccgtcgtaatcgccggaacggtgcccggacgctgaaccgctccggaggctggacaccgttccagcgactggaaagctttccacataacgacgacggcacctggccagggcgttacccgcaccggaggctgggcggatgacacaagtcccagctcctttgccgcagctgccggccagtggaaacctctggcgcactgaccagctgcatgccagcgggctcaactcgcgggccatccggcgtttggtcagtcgcggcggcctggtgcgcctcaggtacggctgctatgtccgggcctccctgtgggagaagcagtctcccacagtccgcggcctgcaactgatccatgcgcacgcccatggcacgctgaccacgtcaacggggaacttcgtctacagccacacctcagccgcccgccttcacggtctgttcctgtggaacgcggacaaccagatccatgtgctgctccgggtaaggccctctggcgagcgactcgggaaggatgtccgcggccatacccggccatataccgaggtggacgtgacaaccctcggacggctgagggtcacagcccttgagcggacagtggtggactgcgccatgatgctcgattaccgccaggcgctgatactcgtggaccatgcgctcaggctgggcgccaatcccgagctgatgcatgccatggctggcgatctttccggccgcagcggaatacggaaccttcgccgggcgctggccaacgcggatatccgcgccgagtcggccggagaaacgctgacccgggagctcttggttcggttgaagcttcccctgcccgaggcccaggtggaggtccaaagccgtctgggccggcatcgtcttgacttcgcgtggagggaggagaaagtggcccttgaattcgacgggaaggtcaagtatttcgactacaatccaactgctgaagtcctcttccaggagcggcgcagggagaaggcactcactgaagacgggtggctcttcgtgcgtgtggaatggagcgacctgttccgggagcacgagttcaagaaccggatcctcgcagcccttcggcgctgagtccgctccccacggaagcgacagcatccaaatcgccggaacggtgcccgcacgctggagcgttcgggcgaccggggagcgttccggcgattcagccgatgcggcggcaggaaaacccgggaaacgccgacggcgggactcccctcccaaggggcttcccgccgtcgtgcgtcatgctctgtgcgctagttgtagagcgcgtgcttcggttcgttggccttgaccttctgccagccgagccacaggagcagcgcgaagaacgggatggtggccagggtccacaggcccaggtggaacacatcaccggtcttgctggtcatggtgtcgaagccgatcagtaccgtgatggccaagagggcaatcaggccggcccagctgctggcagcgccgcccggcgcgggcagggatgagacattgcccttcttcttgcgcagcgcgatctggctggcgaagatggcgccccaggtgaagattacgccgatggatgctgagttcagcgcgaggtcgaaggcgtgcgagccgcccagccagatgttgagcatgatgcccacgaggtagaccgctccgatggccaggatggcggcgtacggcacgtggttcttggacatcctggtcagccatgccggtgcatgcccgttgttggccatggtccggaagatacggccgatggagtacaggccggagttgcaggaggacagcgcggcggtaatgacgatcatgttcatggcatcgcccatccagccgaggcccatctggccgaacacggtaacgaacggcgaggtgccggccacgtactggtccgagggcagcagcatggccaggagggtcacggagccgacgtagaacaccacaatgcggaagacgacggcgcggatcgccttgggcacttccttggccgggtcctgcatttcgccggccgtgatgcccaccagctcaatgccgttgtaggcgaagatcacggcgttgaggaccaggatcatcaccagggcacccttggggaacattccgccttcggctgcgaagaggttgctgaccgatgcgttgccgtcgcccacctgggcgttggtgatgaccatgaaggtgcccacggccaggaagatcacaatggcgcccaccttgaggcaggaggcccagaattcgaactcgccgaacgccttgacgctcatgaggttgacgcccaccagcagcagcagcgcggcgatggcggacagttcaaccggcacgttggggaagaagaactggaagtacaggccgatggcgatcagctctgcaatgccggtcatggcccagttgatgaagtacatccagccggacaggtacgcgccctttttgccgaacatttcgccggcgtagctcacgaacgaacccgatgtctggcggtacatgatgagttcgcccagggcgcgcatcagcaggtaggcgatgacaccggcgatggcgtaggagaagatcagggccgggcctgtggaggccaggcggccgccggcacccatgaagaggccgacgccgatggcgccgcccatggcgatcatggtgacctggcgcccgctcagggattttttgtagccctcggcgctgagggtggggtcgacggcggcggatggtgccgtgcggttctggagatctgtgggggtactttgaggcacaactgttccttgtgggttggggggttggccgcatccggagcacgcatgattccgcccacaaattcgggtatctgcctcatgggcatccgaatgtgagcggaatctctcgtggcgccgaagcttcgcgcggcttgtctatcttacaagacccgctggagtgctacgtgacccgcactacacctgcccgttctcgagcaccaggttccgctcatcgtccacgctcacgcggtaggcccgcagcggttcggcgccggtggtggagcagccgctggtgaggtcgaacgcgtgctggtgcagcgggcagatcacctgctggcggtcgatggtgccgtccgcgatggggccgccacggtgcgggcaggccgctgcgagcgcccgcacggtgccatcccggagccggaacacggccacctgttcaccgcccaccgcgaaggcccggccctcgcccagtgggatctggtccacggggccaaggatgcgggacgttgtgcctggtcccgggacgctcattggaccggcacctgcggaaggaccgtcagcggcagcgaagtcctgaactggccgggcgtctgcggatccgcgcgttcgctccacggatccacgtagctgtccacggacgcctgcatcgcggcatccagctgcgccgcgattccctgggcgtcctccacgatcaccgcgcggaggtgctcgatgcccacccggggcacaaacgcgtaggtccgctccagccagttcgcgtgttcgcggtagtactgcatgaagcgtccggtgaggaccgtcacctcttccggatcgtcaacggtggccaggaggtcgcccttgcggatgtgggcaccggccgctccgcccacgtagatttcccagcggccgccctccacggccaccacgcccacgtccttcaccagggattccgcgcagttacgggggcagccggagacggcgagctttagcttcgccggcgactcgatgccctggaaccgggattcgatctcgatgcccagcttggtggagtcccccgtgccgtaacggcagaagtccttgccaacacaggtcttcacggtgcggaagcttttgccgtaggcgtacccggacggcatgtccagatcggcccagacctgcggcaggtcctctttggggatgcccagcaggtcgatccgctggccgccggtgagcttgatcagcggcacgttgtgcttctcggccacatccgcgatccggcgcagctgctgcacggaggtgaccccgcccttcatctgcggcaccacggagaacgtgccgtcccgctgaatgttggcgtgcaccctgtcattgatgaagcgggcatcgcgttcgtcgatgtactggtccgcgagcatcatcttgagcagggacgccaggcccattttggacttcgcgtcctcggcgccgcccggggccagcgcctggaatacggccgaaacggaacggagcccgcgtttgcggatctctgccatcaacgcggccttgtccaggggaatgcccggtacgtagtaggtggcggcagggtcctcttccacggccccgtccgccgcccactccaccacctgcttcaccaggagcttgcacgagccgcagcccttcccggcccgggtggcgtccatggcgccggacaccgaggtgcagccgcccttcacggccgcggccaggtccttcttgctgacaccgttgcagttgcagacctgggcgtcgtcatccagttctgccacgcctacttccgccccgggcgtgccgagatcgaacatgaggctcagccgttcctcgggcaagggcaggccgcggtcaaaagcctgggtcaggaaggccaccttccggctgtcgcccaggagggtggcgcccaccatcttgttgtctcggaccacgatggacttgaagaccccgcggctgggttcggagaagacgatgtgctcgtcggtgtcgagctccggcccctgcaggcccatggaggcgacctccacccctgccaccttgagtttggtggcggtccgcgaccccaggtacgcggcgctggtatccgcgccggtcacatggcttgccagcaccaccgcctgttcccacagcggtgccaccagaccgtacacctcaccgcggtgctggacgcactcccccacggcgtagatgtggtcctcgtcctgcacgcgcagccggtcatccaccacgatggcccgctccaccggcagtccgctgaggacggccagatccacgttgggccggatcccggctgccaccaccaccatgtcgcactggatgtcggggcggtcgcggaggctgacgccggccaccctgtccctgccgagcactgccgtggtccggcagcccgtcagtaccccgatgcccaggccctccacgctccggcggagcaccgcaccgccgtcgggccccatctgcgcgctcatcaggtggctgcccgagtggaccacgtccacccccagcccgaagctgcgcagcccggcggcggcctccagccccaggaggcccccgccgaccaccacggcatgccggtggtggtcgtgccgggcgtgctcggccatcttgcgggtgtcatcgatggtgcggaagccgaagacgcccggcttgaccgagccgcctggcgtgtagaggccgtccatcgggggcaggtgcggccggctgcccgtggcgatgatcagggtgtcgtagggcgttacccggccgtcgctggaaaacacgtgcttggcgaaccggtcgaccctgtccgcacggacccccgcgtggagcgtgatgccgttgtcctcataccaggacagcgggttgaggaagatgtccttatcgctttcctcgccggagaggacatggctgagcatgatccggttgtagttgccgtagggctcgtccccgaacatggtgatgctgaactgctcggccccgcccctggccaggatttcctccacggcgcgggctccggccatcccgttcccgatgaccaccaggcgccggcggctgtcctggctgcgtgcccggcggcccggccgggtttgggcccgttcggccacgctggtcatcagtgctccaccatgcccaggtcgatcaccacggtgccggtgacgccctccggcgccgccaggtacagctcgatggccgagccgccctcgatgtcctccaccacccgcagcgggacgtggacgtcgcccttggcgccgatggggaaataccgcatgggcacgccattgcgcatcagcaccacagcgatcagttcgccgctggagttgccgccgcggaagtacagcgcctggttgacgacgccgtccgggacatagtgcgagagctcgctgtgcaggggcacaggtttctccatccccacaccctggaagtggtagatgccctgcatgaaaaggttcctggtgatcacgggcagatcctttcggccggcggaacgacgagcatggccctatcttccgccgccgatgtttccgcctgccggtcccccggtaaagactgcttaacgcaaacctcaccggttcccaggcttcctcctaaacgggcgcgagcacgcccttgtccatggagtacctggtccaatgtccgacggcggtgttcccggcacgggtgccttccgggccggcctcaccacggctccgccgcgcgcacgcggcgaaccattcccgcagggcacggtcgtggctgaccatcaccaaggtcccggcgaatccagcgagcgccgcctccagctgttccaccagcacgggcgccaggtggttggtgggttcatccacgatcagggtgccgtagccgcccagcagcagccgggccagggccagccttcgctgctggccggcggacaggctgcccacgggcacgtggaactcgctggtgcggaagaggccgaggcggaggagggcctcggcgtgctcgtcaatgttgccgccgaggcctgcggcgaaggccggcagcaggcgcagggagggccgttgcggcagctccagttcctgctgcaggtagccgacgcgttcgggccgcgtgatggagccggcagccggttccagggttccggcaaggatggagagcagcgtggatttacccgcgccgttgggcccggtgatcaggatcttctcgccggcgcccgccttgaagtcggtgattcccagccggccgggcacgctcaccccgcgcacagccagcactggcgcaccatcctgcgctgccccggaaggcgcaacgccggacgcggcagccctggactctccagcatccgggtccgcggccagatcgacgttcagccgcaagggcaccggcggccggtccaccgggctggcttcgagccggcgcaggcgttcctgtgcgttccggacctggctgctggcggccttctgccaggtgcccgccttgaagtcgaagcccatcttgtcgccgtcgcgcttgcggccgtaccccatggtccccgcaacagtctctgcctgccgcttttcggactccatcgaatcaatccaggtgtggtactgctggacccagcgcgcgcgttcggctgccttctcccggaggtagccgtcgtagccgttgccgtagcgggtcacggcgcggcgctcggcatcaacttcgatgatggtgctggccaccttgcgcaggagcaccctgtcatgggacaccaccaccacggtgccgcggtgggccgccagccggtcctccagccaggccgttccgcgggcgtccaggtggttggtgggttcgtccaggagcaggatgtccgcagggtcggccaggacacaggccaaggccacccgctcctgctccccgccggacagcgatcccagcacccggttccggtccaggccgcccaggcccagccggtccagcgcagcctccacccgggactcggctgcgtagccttcgcgaagctggtactccgtctggagcctgccgtaggtttccagctcgtcgtcgtcggcgtcggccagccctgcctccagccggtcgagctccgcttcgatggcgcgcagggcggccagggaagcgtcgacggcggcacccacggtgaaggattccggcaggccatgggcctgggcgaggtagcccacccggccctggagtgccgccgtaccgtcgtcgggggtttcgaggccggccaggaggcgcagcagggtggatttgccggctccgttttcgccgacaacggccacgtgttcgccgggggtgatggccagggtgatgccgtccagcagcaggcggtcgccatagccgtgggagacgccggaaagggtcaggtgttcagtcaagggaagtcctcgcaaagttccgcagtgtggccgcggggtggaccggatttttccggtccccaacggcggccctggattcgggaaggcagcccggcatggccggctgctggctaggacttcatcgctccagcctgcccgccgcgggtggccgagtcaagcggtggcgagtcaagcggaaaccgggtcaggcggcggcgagcacggcggccctcctgcgccgcgccttggccagccgggtaccgatcagtccctgccgcggactgaagaggtagacgacggcgaagaccacgccctgcgtgagcaccaccatggcgccggaggctgtgtccaggtaatagctgaggtagatgccggcgatggagcagaccgccgagaccaccggtgcgatgaccagcatccgcgagaaccggtccgtcagcaggtaggccgtggcaccggggatgatcagcatggccaccaccagcaccacgcccacggtctgcagcgccaccacggaagtcagggcaagcaggcccagcagcagtgcccccagcctttggggcgacaacccgatggcgtgcgcgtgggtggggtcgaacgcgtagagcgtgaggtcccgccgcttgaggatcaggatggcgaaggccacgacgcccagcaccaggacctggatcaggtccggaatgctgacgcccagaaggttgccgaagatgatgtggttcaggtccgtctggctgggggtgacggagatcagcaccaggcccagggcgaagagggaggagaacacgatgccgatcgcggcgtcctccttcacccggctggtgttgcggaccactccgatcagggtcacggcaatcagggcgaacaccagcgcgcccagggcgaagggggcgcccacgatgtacgccagcacgacgccgggcaggacggcatgcgagacggcgtcacccatcagggaccagccgatcagcaccagccagcagctgagcactgcgcagacgacggcggcgagcgcggtggtgacgatggcccggaccatgaagtcatagccgaggggttcgaggagcagttccatcgtcagcccgcatccttccggttgagcacgtccaggccgaacgccatggcgaggttttccggctgcagcacccgctccggagggccgtgcatgaggaccttgtgcatcagcagcacggcttcgtcgcacagttgcgggagggcatggagatcgtgggtggacaccaggatggtgcagccgtccgaggcgagctcgcgcagcaggcgggtgatggtggcctcggaccgcttgtccacgcccgcgaagggctcgtccagcagcatgatggtggcgccctgcgcgatgccgcgggccacgaacgcacgctttttctggccgccggacagctggccgatctgcctgccggcgtaatccccgagctccacccggtccagcgcctcgtcaacggcagcccggtcggccttggatgcccggcgggtgaacccctggtggccgtaccggcccatcatcaccacatcgcgcacggagagcgggaactgccagtccacttcctcgctttgcggaacgtagccgatccccccttcccggcgtgccttggaaggcggctgccctccaatccgcaccgtgccggcgtcgggcttgaccattcccataatcaccttgaacagggtggatttcccggagccgttcatgcccaccaggccgcagatccgtgccgggtccaccgtcagggaggcggcatcgagggccaggacttcgccgtagtgcaccgtgacgttgtcaacggcgatggccggggtgctcatgaccctgcaccggcggtgagggccttggtaatgacctcggcgtcgtgccggatcaggtccaggtacgtggggaccggtccgtccgcttccgagagcgagtccacgtagagcgtgccgccaaagctggcgcccgtggcttccaccacctgctgcatgggggcatcggacaccgtggattcgcagaataccgcggggacgttgttggtttttacgtattcgatggcccgcgtgatctgctgcggggtggcctgctgttcggcgttgaccgcccagatgtagacctcctttagcccggcgtcgcgggccaggtaggagaacgcgccttcacacgtgacaagtgcccgctggttttccgggacaccggccaggctggaggtcatctggtcctgcacagcctggagctcggccttgtaggcgtcgccgttcgctgcgaaggcagccgcgttgtccgggtccagctcgctgaaggcccggaccatattgtccacgtaggtctgcacattcaccggcgacatccaggcatgcgggttgggtttgccctggtacgagtcctcgctgatggacatcacttccacgccctcgctcaccacagcgtgcggtacgtccagcccctcaacgaactgcccgaaccaggcttccaggttgagtccgttgtccaggatgaggtcagccttggaggccttcctgatgtcgccgggcgtgggctcgtagccgtggatttcagcgccggccttggtgatggactccaccgtgagcttgtcccccgcaacattccgggcgacgtccgccagcacggtgaaggtggtcaggaccacgggtttgccgtctccgttacccgaagctcccccgccgcaggcggtcagcagaagggaaagcacgacggcggccacggctgcggcgcggagacgcaccgtccgcccggggcgggtccgggcggctactttggcgcaccgaaacagaaatttaggcataccgaagattctacgggaagcacgtttcggccagcaacgggaggctaggctgaagctatggctaccgcccaccgaattccacccgcaccgcagccggagctgtaccgcttcaagcccctggacttcgccaccctcgtcacctacgtggccatcgccgggttttttgcggcggccggtgagctgctggctccgttcctgcgccaaatagctcccagcccggcggcagcctcctatgcggtcaacctgctcttttatgcctccgtgggcatactcgcgttcttagcagcctggaaagtcgtcggccgcgacctgagggtcctggccacccggccctggttcacgctgctgatggttccggccgcggtgattgccatgatgatcctgaccgccgtggtggtggccctcagcggccaggccgaaacatcgcagaaccaggcgggactgcaggaactggcccagcagatccctgcctggctgatggtgccgctgctggtggtggtgggaccgttcgtggaggagtacatcttccgccacctgctgatcggcaagctgagccggcgggtgaacatctggatctgctgcgcactgtccgtggtgctcttcgcggcccttcacatcgtgggccaggaggcggtcaccttcaccgcactgcttccctacctggccatgggcgcaacgctggtgttcgtctacgtgtggaccgggaagaacctggtgttcgcctactttgtgcacgccgcaaagaacctgctggccgtggtgttcatctacgccatcccgccggaggtcttcgaacagctccagcaggtccagccctaggaactccggtgcaggccgcgcagcgtgaaacggtggctgccgcgggtgcgcccggtgatgtagactttcacgccgccggtcgcgttggtccccgccaggtagcggtagctttcgccggggttgtaggccgccggggtgtccgggccggcaggtaaaccgggcccgaactcgatggcgtcggcgcccacccggtagcggcccatcccctccaccagctggaaggcgccggtcccacccagcggggtgacgccgtcgagcgttccgcccggccggaacgtcagctcaagggcgaaggctgtgtcagcgccctcgaaactgatatccagcacggcctgtccgccatcagcctgcacggcaacgtccgtggcaagccgatggaccgcggtgggccggctgctgaagtccatgcccgcgctgaaccggccctcgtgctccagcgtgtagatgccgtccgcccgccgcttctgtgccggcagcggcaggtagaagttggcctccagctcctcggacagggtcacggcggttccgttcgccaccgtgtgctggctgcggaagggccccaggtcaaagaagctgcgggacaaccgcacgtccgtgagtaccgccgctccatgcgcaaagcgcaggaaggtgggattcgcggcaagcccggacaccacaccgggaaccagcgcgtcacagccgccgaacacggtggtcaccgatccggcgtcccggaaccggtacacgccgcagctctccagcgcagcgcccgccggcgccatggcggcgtggattgacgtgtccgacgacggcggcgcgccttcggccgggcggcttccgggcagcgcctcccgcagccaggggtccagccgggacaaagccagtagcttggccggctcgtgcaggggcagcacctccagccatgcggccgcggcggcgaagtcctgccgcccgtcctggttggccagccgccggtacagatgcaggaaaggtgcggcgtcaaaggtcatccactggtcctggcggcgggagaacaccgactccacgctgccgtccggactgaaccacggcaggaacgcggtgaggttccggcggacatggtccagcagttccggccgtccagagctgtccgcgatggtgagcagggacgggttggtgacggcggtggcgtacagcggactgcgctcggagtacatcccgtccggcaactggtcgatcccctcggccagccactccgagatccgctccgcaatgcccggccgcggctgcagccggtccatctgcgccagcgccgcgcacagctcccaccggtggttgggagtgtggaccccgcccgtgaccatggcgtccgtggcgcgggaaacaatgcctctgagccgggcatccaccccggcaagcaccgggtccggcggggtgtccagggcccggatcaggctcagcgcaaggcacacgtcattgagcgtgaaggccgagtccggcggtgagcacaggttggtgccgtcaaacaggccggtggggccctggagctgttccagccggtccagacacacggccatcggctcccgcagcccgtccgagccgtaaaaggtggagccgggctcggtgaagaccgtgaccagcgccagcagcctgcccatggcgggccggtgcgccagggccgccacgtcggcgtcgtgcgtttccagcatcgcctgcacggcctggtccgccgcctccgccacacggttgaggaatactgcgtccacggaagctgtctgcaatgtgtgcctttcatgggtctgcccggggtccggtcccggagcaggctggggggtggcgcgtcggggacgtgcgctagtccttcaggcccgcgctgacgtcggcattgagcacgtacttctggaacacaaagaacaccaggaccagcggcaggatggagatgaccgaggcgcccagcagcaccggccagtcgatgttttccgcacccacgatgctgcgcagggccacctggagcgtgtaccacttgggatcgttgaggacgatcagcggccagatgtagtcgttccaccgccactggaacgagaaaatggcgagcgtgaacaggatgggccgggacagcggcagcatgatccggaagaagatgtccagttcgctggcgccgtcgatccgggccgagtgcagcaggtcatccgggacagtgaggaagaactgccggaacatgaacacgcccgtggccgtgaggacggacggcacgatgatgccggccagggagttgtagagtcccaggtcgcggatcaccgtgaacgtggggttcaggatcacctcggtgggaagcatggtggtggccaggatgcacacgaagaacagccgggtgcccttgttgttgtacttggccagcgcgtagcccgtgcaggcgctgaagaacacggtgagcactgtggtgacaatggccaccgtggccgtgttcaggaagtactgcgcgaagtccacccgttcccaggcatccacgaagccctggaacgtccattcccgcggaatcatggacagcgggtagctgaacagttcgctgcccggcttgaatgagctgaggaggaaccagagcagcggcagtgcgtagatcgcggcgatgacccacataagcacggtgaggggtacggacagcctggcccggccttcacggttgcttcgggggccccgcctgcccttggcggagtccaccttctcagctccgagcgcggattcctccgcaatggcgggagggaggtttgctgctgtcgccatggtcaggccttcttccggttgaagcgcagctggatgagggcgatcgccagcaggaccgccatcagcaccatggaggcggcactcgcgtaccccaccttggactgctcgaagccggtcttgtagatgtactgcacgatcagggtgttctccgttccggggccaccgttggtcagggcctggatcatggcgaattccttcatggcatggatggtggagagcaggatgaccatgaacgacgtcggcgcgatgcctgggagggtgacgttcaggaagcgctgccatgcgttggcgccatccagttccgctgcctccagcagggcttccgggatgttcttcagggccgcgacgaagagcagcatgttgaaggccgtcccgccccacgcggaggcaaaaatgaccaccgcgagggccaggttgccgttgctggaccatgggaccgcgctgccgccggcgctggtgatcaggaagttcacgaacccgaagtcctggccgaacatccacttccagatgacgcccaccacgatgggtgaaatcagccagggcaggaaaatgacgatcttggccgcggtgcgtccccggacagccttgctgaccagcagcgcggctaccccaagggagcagacgtacaccagcggcacggacaggaccgtgtacacaaaggtcctgcccagcgcggcgtagaaggtgccgtccgcgaagagcttctggaagttggccaggccgatgaagttcagcttgcccacgccgcggtagtccgtgaaggaatacagcagccccagcgctccgggccaaacaaagaagaccaggaagagcaccacgttgacgccgatgaggaccagcggtgcgatgacgtagcggttccggcgcttctgctgggacttgctccggaccgcgcccggcccgggcgcggtcggcgccaccgtggtgctcatggttgggttggccacggatcaggctccgttgtagagcttcacgatgttgtccaccgtggtctttgcatcctggctgccggagagcatcttgacggtctcttcgcgcagggggtccccggagaacggggtttccgcgtaggcctcggccaccacgcgtttgatggcgttgtcccccttggcctcgttgccggcgatctgcttctggtacagctcgaaggaggcctgctggaacgggtattccacctgcaggtccttcaccggcaggtagccgcccagcttggcgaactcggtgtagttggcgtcctcgtagaaccagtcgatgaacttcttggcttcctcgtcggcgccggtgtccttgaacgcgaccatgaagccgccgccgaggttggtggcgctgacttccttcttgggcagcggcacggagagccactcgaagtccttgatgttcttgttgaagtccgccacctgccagctgccggagtagtacgcggcaacctggccgctcttgaacatcgcgttgccgtcctcgccgctgagccagaccgatttgggcatggtctggtcatcgttgatcttctggaagtactcgagggtttccacggcctcctcgtcggcagcgtacttgtcgccttccttggcgaaggcggtgctgccgaactcgtacatcatggcgcgcaggcggtggccggagcggtccatcacaaagccgtatttggcgccggccttctcgcggacctcattgaccgcggccacgaactcatcccaggtccaggcctgcgcaatgtcggtggggtagctgacgccggctttgtcgaacaggctcttgttgacgaacaggcccacggcggtgaggtcggaggggatggcggggatgatgccgtccggggatttctcaaggaaattctggtcgattccccgggacgcggcgatgtccgagaggtcctggagctggttgacccacagcggatcgatgctggtcacgcgggccagggccgggaggtcgttggccgttgcggcgttcttgagcttggtggtgatgtccgctgtggggacgtccaccacctcaatggtgatgccggttatttccttgtacttctcggcggcagcggcaaaggcgccgccctggttggtgtcaccggagaggaccagctgcagggtcttggcgccgccctccgacccgcctccgccactgctgccgcaagcggtaagccccgtagccagggccgagagtccgaacgccgtgagtccgaactggcggcggctgatgctggagattcttgtcttctctgacaatggtctgtcctgtctctcgctgggctccgggcctggattggcggccctggatgaaagtggtggcgctgcccgccggtcaacaaccggggagggaaaagcctttccgcccaactgtgacttatgtcatgacaatgtgtcaagagcactttctatcgttatacaatccctgccggaccttccccggcagcacgtgccgccgtaccttggtgggatgggactgaacatccagatagtcatcgactgcacccgtccgcacgagcttgccgactggtgggctgaaaccctcgggtggtccgtggagccccaggacgccgccttcatccgctccatgatcgagcagggctttgccacggaggacatgaccatgacccaccggggcaacctggtgtggcgtgagggctgcgcgatccgccccacggaggaactggagtccaaggcgccggcacggcgcctcctcttccagacggcgccggaggccaaaacggtgaaaaaccgcgtgcactgggacatcaacctggccggtcgggacaaggacgaggtccgccgggaacttgaggaccggggtgccgcgttcctgtggacggccagccagggaccgcactcctggcacaccatggctgaccccgagggcaacgagttctgcatcagctgaggccgattactagacttggacggtgagcaaacagattcccgcccaggtgtccgacgtcttcgacccctcccgctggcgcaccgtgtccggcttcgaggacttccaggacatgacctaccaccggcaggtggagcgggattccgacggcgcctgggtgcgtgacctgcccacggtccggattgcgttcaaccggcccgaggtgcgcaacgcgttccggccgggcaccgtggacgagctgtaccgggccatggaccacgcccggatgtccccggacgtcgccaccgtcctgctcaccggcaacggcccctccgcgaaggacggcgggcactcgttctgctcgggtggagaccagcggatccggggccgggacggctaccggtacgtagtacaagacacagcagatggcgagacgcaggaaaccatcgaccccgctcgggccggcaggctccacatcctggaggtccagcggctcatgcggaccatgcccaaggtggtcatcgccgtcgtcaacggctgggcggccggtggcgggcactccctgcatgtggtggccgacctcaccatcgcctcccgccagcacggcaagttcaagcagacggacgccaccgtcggcagtttcgacgccggttacggctcggccctgctggcccgccagatcgggcagaaggccgcccgcgaaatcttcttccttgcccgcgaatattccgctgaggacatggttcggatgggtgccgtcaacgaggccgtggaccacgaacgcctcgaagaggtggccctggaatacgcggcggacatcgcgcgccagtcgccgcaggccatccgcatgctgaagttcgccttcaaccttgccgacgacggcctggccgggcagcaggtgttcgccggcgaagccacgcggctggcgtacatgacggatgaggcggtggagggcaaggaggccttcctgcaaaaacgcgagcccgactggtccaccttcccgcactacttctaggcaggagcggaacatgaatactccagcgaaagccgccggccccctcaacatcgagccggccctgactgcccttgcggccgccctccatggcgagggacccgccgtcgaactctccatcagcgaggaaggcgccctggtggtgggacacctcgaaaccccgggctgcgacgacgccgtggccgtggtgcgcacgtccggctccaccggcgcacccaaagccaccgtgctgaccgtggaatcgctggcggcgtcctcgatggccacggccctggcactcaagggcgaaggccagtggctcctggcgctgcccgtgcagtacgttgcgggcatccaggtcctggtgcgctccctgttcgcgggcacccgcccctgggtcatggacatgtcccacggttttacgcccgaggccttcaccgccgcggcccaggagctgacggacaaaatccggttcacctcgctggtccccacccagctgcagcggctcctcgacgcaccgtcgccggagaccctggccgcgctccgccgcttcaacgccgtcctgctgggcggcgcccccgcaccggcatccctgctggccgccgcccgcgaggccggagtgcgggtgatcaccacctacggttccgccgaaacctgcggcgggtgcgtctacgacggctttccgctggagggcgtctcggtccgggtcgaggaggacggccgcatcctgctgggcggggacaccatcgccgccggctacctcgagtcaccggagagcacggacacgtttttcgaggaggacggcgtgcgctggtaccgcaccggcgacctcggcagcattgacgacgacggccggctgaccgtgctgggcagggccgacgacgtgatcatcaccggcggcgtgaaggtttccgccgcgcacgtgcaggaagagctggagaagtccggcggcgttgcggcggctttcgtggcaggggtgccttccgccgagtggggccaggccgtggcggcctacgttgctttgacggaccctgcgccggacgcggccccgggcgcggaagccggggacaccgccgtcgtccttgaacagcactggcaccggacgctggggatccatgcgcccaaaaccgtcctggcggcctcccggctgctgatgcttcccaacggcaagccggaccgcctggccatgaccgccgaactcaaagcccggcaccagggaaagtaaagtagacctgcaccacccggcaggaccctcctgccgcccccaacacacgcgaggtacttaacgtggctacagccgcacaatggatccaaggcgcccggctccggacgctgcccgccgcgattgcgccggtgctgatcggctccgccgcagcctacgagatgggttcgttcctcctgttcaacgccgtcctcgcgtcgctggtggcccttctgctccaggtgggcgtgaactttgccaacgactactcggacggcatccgggggaccgatgatgaccgcgtgggcccgctgcgcctggtcggctccggggcggcaagccccgagcacgtgaaacgggcggcgttcgctgcgttcgcggccgccatggtgttcgggctggtcctggtgatcatcacgcagagctggtggctgatcctggtggggctgggctgcgtcatggccgcctggggctataccgggggaaaaaacccttacggctacatgggcctgggcgacgtgttcgtgtttgtgttcttcgggctggtggcaaccctgggcaccacctacacgcaggccgggcagatcaacctgcccgcgatcattggtgcgatcggcaccgggctgatcgccaccgccctcctcatggccaacaacgtgcgggacatccccacggacatgcaggccggcaagaagaccctcgctgtccggctgggcgacaagcatgcgcgcgaaagctacgtgctgatgctggccgtggccatcctgctggtggtgatcctggctcccggccggccgtggatgctgatagtgctgctgctgattccagcctgcctcatgcccgcgtggctgatgatcaacgggcgcaagcgcaagagcctcatcccggtcctcaagcagaccggactgatcaacctcggctacagcctgctgttctcactgggactggtgctcagccgcggcttctagcggaccaaagcttgcagagcgtgaaggggattacgggcgcttgcggcccttcgcgtcattgttgatggttacgtcggggttggcgtccaggagcgcatcctcggcgtgcgcgtcctggacttcgccggcggagcgcagcggcttggccttgccggaaaagcggtgctgcagggccgctgcggcttcgtcccgctgcttctggaagaagaggtagctcacggcaaaagcgatcagggccgcgcagatgacggacatgagggcgcccagctccaggaaggtgaagagcacgaacaggggcacgaagagagccaggcggatcagggaatatttcaaaaaggccactattcaagtttagccgcctcccgcccgcggccactgcgcctcctgacgatagacttaatgcatgctcctccgtgtggctttggccgtcgcaatcctcgccatcttcgtgtatggcctcgtcgacgtgatccggaccgacgggcgcctcacccgcggaatttccaaacccgcctggatcgtggtcatgatcgtcctgccggtactgggcgcgatcctctggctcctgatcggccggccgcgcggcactcccccgcagcggcaggactaccgccatcccaccgccccggacgatgatccggacttcctccgcaacctggaggtccgccgtcgccaggaggcggaagccgcccgcctcaagaagctcaaggacgagctggacgccaaggcaaaggacgtcgacggcgggaaagacaagcacgagaccgacgagcacgataacgacggattgaaataggtctccgccggaagagcactcctccggccgtccttcaggccggttggcgctggcgggcaaacgattccgccagcaaaccctcgcagctgcggaccacaacccggcacgcatcaagcgccggcccgtctgtcagcgggttctccgccaccgcgcgccagcgcagcaggtagcggcgggcttcgtcagccatgtcgctgggagccgtgtccgcatccagccccagcctcacatgcggcgcagcgccccggccgccgatcaggccctcggcttccgctgccagttcagggctgagcggcacgcccgtggtccgcaggacggccagcagccgcagttcacggaactcatgcgcgttggcctgcagccgctccagggctgcggccaggtgcccggttccggggcggggcgaggtgcgcagcagggactccaccgccaccaaagccgttcgcgccttcagggcctcggcccgcgcctggaactggcggcccagcaggtccagcaacggatgcaggccgctgcgccgggccagctcgtgggccagcggggtgggttcattgaatccgttagagaccaggaccacggccagccggatcccgaacaggccaaaccttgccagcagcgacgccctggcctccgccgtcagcccttccgggatggtggaccggaggaacctgtccgctgagagcagtgccttctcgcggtcgccgcggtccaggcccgccagcagctggaaggcagcgaattcctgttggcgcagggtccgggcgctctgggcaaggagccctgccaccggcaccacgcccagggcgagcttccgcaggttatggtcccggcggtacctgtccgcgatctctcccgcggagagcagcgaatcgatgcggccgccaccaacctcgtccgccctggaaagtaccgcgatggcgttgactgtgcccgagcggcccgcttccgtgtcccggaaggattcgaggaagcgcacgtccgctgcgtgcatgtggcgcatcaggtagatgatggcatccgcttccgactccgtgtccgccggggccaggaaggcggtggagcgggcagacacctcgcgggacagcgaagcgatgccgggggtatcgatcagggtcatgttccgcagtgccggcgacggccactccacctccagccggtccacgtccgccgcgtcgacatcccccagcacgaacaccaggcggccgtccacgcgtttgagcggcagcgccctcggctcaccgccggttgggtggagggtgatgcggggagtgtgcccgtgccggtaccaggtgatgatccgggtgcactcccccgtgtccgtgggcgctatctcctcgccgagaatcgcattcagcagggtggacttgccggccttgaccatgcccgcaatggccacgcgcagcggctccgcgagcctccgggcaataccctggagggcggccacggtggccggatcatccccgtaggtttccagcgcctcctggaccagggcggcggctccggcaacggttgaaccagtcatcgggggccgcccgcaggcatcatggttccggcgccggatacttcggcggcaacggcctgcgcggcccggtggagtgcgtccaccttcttgagctcggccttgatgtccctgatgcgggcgtccttttccagggcgtaggtattggcggctttctgggcagcggacaccgagtcggccagggagcggtggtgctcgtccgctatctcggtgaagtggtcgcggatggagcgctgcaccagccgcagccggtccttcaattgtttgcccacctggaaggtcacgtcgtcgagctgccgcctgacgagggccttggcctccccctgccggcgcttaagccgcgcttccttgtcttcccggtatgccttgcgtcccagcaggagaccggcacccagggagagcgggttgatcagcgccatgccgaagatgccggtcaggagcccgaacatgagcacccctccgtaggagccccgcatgccgatcagcactttttgcacggggttgacgtgcccggcgtccatccccggcatcgcgtccacgggatccagcacgtcggcggaatgggacacctgcatcaccggcaacgggttttcgtcctcggcgaagtggtcagccacctgcccggccagccactgcgcccgctcactggtgaggacgaaggtttcagagatggcggccgcggtggatacttccagccacttggaaaaatcaggccaggcaggacccgggtcctcctggtcaatggcggcttcagcttcccgctggatgtggcggagccggttgcggaggtcgtactccatatcggcgatgaggtcgctgatgccgtcgctgagggtgacctgccagcgcgcagaccgtttccgaaggtcgtcagcctctgcccgggccgcctccagttccgaaatcatctggggtgtgccgccagggttttcgagtgcttcaagctccgattgcagggagaggcggaggttctcggtgacggcgagcaggtcctggctcacggagcggccatggaggcgctgcgccccttccacgattccgctgcggaggtgggcaatcagtgccgggaagccggattcctcattcagctcgctgtcctgcaggcgtgctgcctccaggcggaggtcggaggagacgggaaacagcggaatcccaggcgctacgtttccgagatgggatcggtccatctcctccacccgccgccagtccgggtagaggtcggtcttggtcaggacgcccacaacgttcggggtaatccgcatcgcctgccgcaggaagcgcagctccggttcggtgtattcctgggaggcgtccgagaccaggagcatcgcatcagcggtgggcagggccgtgagggtggccagggtgtgcgcggacccgaggccccccaccccgggtgaatcgatgacgatgagcccgccggccaaaatccttcggggcaggaatacctcggcggccaccagtttcttgctgttgccgggattaccctgttcggaaacataagccgggaggtcggcaacgggaatcggttggcggtcaacggcagcctcatcgccggagtccgcatcggaggtggggaccaggatcgctgccgaggccgggtccccgtagcggacaaccgtgggaacggatgtagctacgtcgtcgtcgacggggcaggccggcgcacccaccagggcgttgatgagtttgcttttgccctgcttgaactcacccaccacgatgacccggatgctgggatccctcaacctccccaatgtcaggtttaggcgtttccggaggtcctcccggtctccggttcccacgagctggagtccatgctccacgagttggatcagctggccggccgttaccggagttgctgggtgtgccggtcctgcttctgccacagcctgtcctctgtactacgcctcaaatatcgtttcgggaccggggtccggctgctaggcaccaaagtccatggagtctgccgcctccccagcgccagcgtcgtcgatgtcattgtcgatgtcaatggtggccgcgtcgtcctccgtgaactcaagcccggcaccggcggcagcgacatccacctcgacgaatgtcagctgctcttctgtggaggattcctcgatcaaggtggccgggtggacggcctcgcctgcgcccaccgtcgcggtgtcgctgtccgcgtcgaggtcgaaaaggccgtcgatccggatgtcagcgaaacccatcccggttccggcacctatggcggggtcgtcgaaagccggcacggagtcgttgtcgaaccacagctccacgtcgccgtcggcccagatgttaggggccggggattggtccgccatggcgccgcggtcatccggcgtggaggtgaaagagtagccggccacgacgtgggtgagctgctccaccgccagtccatggtcgtcgtcgtaggctgcgccggaaggaagcgggctccagccgctcccggcgtggccagtgccggtgccggcgcttacgtcccggtcaacagtggaggccgtgacgctcaggggggcgtagtccaggacaaccggcatggcggcgtcaacatctgcggagctgacaccggccaggccgtgcttctccaggacgccttcggggtcatccaggaagtcctgggccgcctggcggtctccgaagatgtccatcaggaactggaccacttcctttgcgactgtcatgtgctggtcctcagttcgtcttattatcggtgcgccggccctgatgccttggatcaaacgtattgttcctgcggggaaccggcatcgggccggtcccccttaccggtggtccccctggcggggatccgtggacgtccccgttaggggtgttagggggaccggtcctgggcctggttctccgggcccagcgcaagacgcagcttggccatcaggtccgaccggttttccgcgccgagccggcgccgcatccgggcaatgtggtgctctgcggtgcggggggagatgtagatggcttcgccaatttcccggtaggtcttgccgtcaagtaccaggcgggctacttccttttcccgctcgctcagccctgcgccgtctggatgcatgccattacctgcctcggtggggggaacgttgcgggactcgggtgacgctggcgctcccgggcctgccggactggactgtggatggaggtcccgggcacaggagagcaggcgcaccatgtccttgcgctcgtccgcccgggctgcggcgtggccggcaagccgcgccccctcccacggcattcccaccagccccaggccccttgccgccgcctcgacgtcatcaggacggaacctctcagccagaaccgttacccaggctttgccggccgccgcgagtacggccgccaggtggctttgccctgcggcccgggcgagcgctgctgcatgcggtgccaggtcggccgggctttcgttcaacagggcggcctggactgcggaccagtgcagcggtacggcccagagcggcggattgcccaggcgctccagcaggttccatgcgtcattgaggtatggggcaaccctgcggccctcccgaaggcgggccgctgcgatcatgagttcgccccagggcaggagactgtacaggtccacggaggtgtggagcgtcgcttcgcgggcccgttcccaggccttgatgagctcggggaaatcgccgttgcgccgggcgaggcccacttccagggccgaacagaggaactcgtcccgcggcaccagcggccagtggttcgctttcgatgcctcattgatggcgagccgggcgtcgtcgagcctgtcctgcatcatcgctgaccacgcctgcagcaggaagaggcgaggcttggcggtatcgcctccctgcccggcggcggcagcagaccggcaaattgtttccgccagggtcggctctccgctgtgcagcgccaccagtgccgccagtgccgccggagtctccggcaggggaagcgcagcacccgcggcgttcagcatgtctgaggcgtggataagagcctggagtccctgctgcgggtctcccgccagcgactggaggatgccttttccaaggtgggcgagggtggcggcaagcagcgttggggacgcgggcggcgcgtcggccccgaaaatgttttccgcaccggaccggtcgccactgccgatcagggtaacggcggcaaggggcgcggattggcctgtgcgggcggggcccagccaactgtagacatcggctccgcgggccagcatgccccgctgggcccacactgaggctgccacatccgcggcgcggcggacgtccggtggaccgtcctgccccaacagggtgtccacgatgcgggtggccgtgtcaaggtcgccgttggccgctgcggcctgggcacgccgggccgctgtggctttctcgtcggtgccggccagcagggcctcatcgtagagctggtacgccagcccgggatcgcgctccagtgccttgtccgccgcttgctccagctcggttgccacccgcggatcggcaagtccggcgcgtgccagttcccgggcgagatcccccagcggctggccgttggccgcatagacgcccaccagctcccgctggagcgcgtgcactttagtggtgggggcgacggcaagcagcgcgtgccgggccgggccgacgacggccccgtcttgagtcaacaggcctgacgactctgccctgtgcaccagggcgtcaaggctctccaccccgttcccgtcgatcttgcgctgcaggtcggacggcagcggtcccggcagggcaaaacccacggacaacgccagcagcagttcccggactgctgcgttctcacccttgagcttgcttgccatgagttctgcgctctgcagcgccggcccctgatggtccggctccggatggcggaaagctgtcttttgcgtgtgcggctggtagctgaccatgtcaggccgccggagttgtcgtcgtggccgtgtccgtggaagtggccgtcgctgtgccggaagaaccggagcccagcgactcctccgctgtggacgtggacccgctggcaggtgacgccgatacctggaccgtcggcgaaggggaagccgtgagatcccgcgacttcgaacccttcgccggtttaagccatcggccaggttcgctcggtgtggccgtcgtgtccgtcggcgtgggcgccgccgtgccggagaagcgggtaggctccggcgtgctggattccgttgcgggaggggtcggtgtcccggactcgctgcccgactccgtggtcgacgggctcgacgtgcccggctccgtggcatctgtagtcgttggatctacggtgggagtcgcctccccagtggtcggcgtcccggtggacgtggctgtatccgttgctgcatcagaagttaccggatcccctggtgccgtggtgccggtaacctcacctgccgctacggcgctggcggagggcccttcggaggcgcccttctcgatggacctgatggacgatacctggccggtcggcttcccgtccgccacggggccgggcgcctgggaggcagcggcccgctccatgccggaatcgatgcctgccaccgggacctggacatctcccgcagccccggctgcggcgtcggccccactgccgccgcccgcggcggcagtgggggacggcgctccccggtcgttggaagccccggccggcgggacgaacacagaggtcaggctgttgaatcctgccgggctctgggcggccgtggcggtaagaacagtgaacaggacggcggtggctgctacagcagtgaggcgcacccgcggtttcggcgcgtgtactccgcccctgtccccatggctttggctgagcgctgctgccgccagggaatgcggaaccggcgtggggttccgggaccagctcgccagcctcagcggcgcctgcgcagcatccggtgccgggctggaaacagcctcaccgggagcttcgaccggactcgactccgccgcggcggcagcggccatagccgcccggcccagcaccgcggatacggctgcgcccatgcagatggaggacttcggatcggcgtccacggcgatgggacggtcaagctgttccgagatcagctgtgcaacgaggggaatccgggaggacccgccaatcagcagcacggcggtgaggtctgcaggctccagcccgagctggcccagcgattgttccagggcatccacggtgtcccggacggggtcttcgatcatggactcgaattcggggcggaccaggcggatttgctgctggatgccgggcaggagcacggagatgttggcttcactgtcactggagagcgcttccttggcttccacgcactcccgccgcaaccgggaaaccgcggcgagcactccgggggctgccgggtccagccgggccagggcgccgtccgtatgttcagccacaaagcggaaaagggcggcatcgaaatcggcgccgcccatgtgttcaaagccttccggtttcccgagcagttcaaaccggttgctggtctctttgcgcaggacagcggtatcgaaggttccgccgccgagatcatagacagcgatgatgctgccgtcctccacccgcacctgtgatgcgtaatggagggccgcggcttccggttccgtcagcagcgtgacgttgccaagccccttggcggcgagtgctcctttgatgagggacgtgcggtggaagccccaggcggcggggtacgtcaggataatttccgacggcggcgccccctggcgttcttccgcgcggtctgccacccagcgggccatggtggcgaacacgtcctcggcggccagggacagcgtgcccacggagatcggcacggcgtcgcccacgcggcgcttgaattcccgcacaacccgccctggggaatccaggccgcggcgttcagcggcttcccccaccaggacgggtccgttgtcggggtaaaaaagaacagagggtaccgaggttgcacggagtcccagcggcaggcactcgggggaggaagcgccctggtcaaaacgggcgatggcagcagctgtgaagctggttcccacatcaacggcgagaacatagctcatgggtacctcaggaaaaactgttgttccgccagcaaacttcatcacgggcgcacgaaaccaacgtagcattaccggctgaccgggaacagccctattgctacatcgattttatatgtcccctggtacctggggaccccaaagaacccctgctcagaggcctgaatacgagtggagcccgttgaagaactggttcacgatggtgaagttgaaaaccacgcagaggtagcccacgatcgacagccaggcggcccgggtgccggtccagccacgggttgcccgtgcgtggaggtatccggcgtagacaacccagatcacgaacgtccacacttccttggtgtcccagccccagaaccgcccccaggccttttcagcccagatggcaccgaacatgagggtgaacgtccagccgatgaaggcgatggcgttgatgcggtaggacaggttttccaggctcagagcggacggcaccaggcgcatgaagcccagtttgtccgccccgccggcagccaccgtcttctggcggtgggactggaccagctgcagcgcggacatcgcgaaggtcagggtgaagagggctgaggacagcacggcgatggacacgtggatgatcagccagtagctctggagggcgggaaccaggtgcccgacgggggtccagtaggccacggaggcggccaccagcatgatgatggccaggcccaccacgaaggttcccaggaagcggaggtcgcggtggaccagcaccagcaggaacaccgccaccgccacgaaagctccggtggtgaggaactcgtacatgttgccccacggcacgcggccggcgcccagcgcacgggtcaccacaccggcggcgtggatcaggacgccgaggatggtcagggccaccgccacccgcgcgggcgcgcggcgttccgtggcgtagcgcatgtcggcgtcggcggtgatgactcccccagcccccgtgcgcgctgccttggtagcggacgacgacggccgctcggcccggccggccggcccgcccaggtgcgccccggcggagtcggaacgggagccttcagctgacgcagcgcgttcccccacccctgctgccaccggaaccttggacccgtcctgggcctggcccgcttccgaggcctgagccgccttgaggtcgatcgcgcgcagggccctgctgctcttggccaggtcccaggcgaaagcgatgaaggcaacggtgtacgtgccggccgccagcagcataaagagctcgctgtactggcccatggtctcgttgattccgtacggcattactggtccttttcgggcccggtggggccggctggggtggtgactgagcctgtggttgcggcagctccggtgctattgtcccccgggctgccgggagtttcctgtgaagtccggggcggcccctggtccggatcaagctgccactcttctatcagcagcttccggagggcttccgcttcgccggcaagccggtggtcctcgccgcgggccaggagcccgtactcaaccatggtgcggccgtcctcgtgggtgcccgtgcggagccacacgcggcggcggttgatgtagagcgacaggatcaggcccgccacggccagcagcgcgaagatcagggcgtagagctggccggggttgtggtggatgtccacgccgatgtaccgcttgacgccgtcgaagctgatggtgcccttcccgtcagggagtgtgtagctggtccccggcgagagggtgatgccgccggcgtccaggttgcgggcgttcagcggggtcaggtccttgacgtccagctcaaagacgttctgtggcgctccgtcatccaggccaaggtcgccgtagtaggagttgagcgtgagctgcgggttgaaaagttccgggtcaccgctgaaggaaaccccctcatcagtgacgaaggcggtgggcaggaagaagccggcgaatcccagctggtcgggcgcggcgtccggaaccttgatcaccacggaggagtagtagttgtccccctgcagcttggccaccacggggccctgcatggccacgttgccggcgccgtcccggatggtcaccacgggggcgtagccgttgccggtgaggtagatgctggtgccgcccagggtgacggggtcgttgaccttcagggtttcctgctgcgcgggcgcgtccgggttttccctggtggtcactgcggccgagaagtcgatgggctggccgaacttgccctcggactcgcggtcgaaggtgatgtcgaacttgtccagctggatggaatagggctgcagctggctggactggaaattggtgccgggcgtgaactggtcgtaacccaccagggtgttcacgaacgtgtccccctccaccaggatccgctggccgctgtagccgaacaggcccccgatggccacggacaccaggacgccaatgagggatgtgtggaagacgaggttgcctacttccttcaggaagccgcgctcggcacccaaagacggccgcgcgccgtcgtcgtcccttacctcaacgcggtagccgcgcttcttcagcagtccggcggcgctgtggatggcgtccgacgccgggatcccggcccgggcgggtatcaccagggtcccgtactcggggaggcgggagagccgtttgggggtgcgcggcggctgggagcgcatcgccttgtaatgggcgatggcgcgcggcaccacgcagccgatcagggagatgaacagcagcaggtagatggccgagaaccaggccgaggagtagacgtcgtacagctgcagggtgtccagcagcttgccgtagtccgggttgtccttgatgtactgggtgacgatggacgggttggcggggcgctgcgggaacagggaaccgggaaccgcggcaactgccagcagcaggagcaggaaaagcgccgtgcgcatgctggtcagctgggtccaggcccagcgcagcatctccttgggacccagggctggcagcgcggcgtcagccttggccgctgacgccgcgctgcccgtcgccggggtggaggatttcttctctacgttcacgtgctcgctcatcagatcggcaacttcacatcggtttggaaccagtactggagctcggtcacccaggtgccccagacgccgctggccatcagcaggcccagcaccaccaggatgcccccgccggtgcgctggatggccaggcggtgcttgcggaagaacgccatcacacccatcccccggcggaccgccagtgcgatcagcaggaacggtattcccaggcccaggctgtagacgaaggccaggaaggcgcccttggcggcggacgatcccccggagaggctcagcagctgcacggccgagtaggtggggccgatgcacggcgcccagcccagcccgaaggtcaggcccagcagcggcgccccccagagcccggccggcggcttggcctggatcttcgcgtcacgctggagccagctgaagccgcccatgaacacgacgcccatcacaatcaccaggatgcccaggagctgggtgatccaggcgttctgcgaaccggtgatcagggttcccagctggccgaaagccccgccgaggaggacgaaaatgaccgagaaaccgagaacgaacagcccgatgcccaccagcatccggccgcgcttctgcttctgcaggtccacgccgctgagcccggtgacgtagcccaggtatcccgggaccaggggcagcacgcacggagagaggaaggagaccagtccggccagcagggccaccgggatggcaagcaggagcgagccgttcaggatggcttcggcaaaggggctgttcacggtccggaccgccgctactctgccacggcggcagcgatgagggctttcagggtgcccttttggacttcccccaggacacgcgaggccacgcggccctgcttgtccagcaccagggtggtggggaccgcgcccggcggaaccagcccggagacagccaggaggacgccgccgtccttgtcgtcaaagctggggtaggtcaggttgaaggtcttttcgaaggcctcggcggtggctttctcgtcccgcaggttgacgccgtagaactgcacgccctggtccttgaactcctggtggagctcttccaggatgggggcctccacgcggcacggtgcgcaggcggcgaaccagaagttcagcaccgtcaccttgccctggaaatcggcgggcgcaacggtggtgccgttgaacagcgtgccgttgacctggatggcggacttgcggtccccggctgcaaactccgtcacggagccgtcaccggcaacatagttcttgttgtcccctgccttggcctgctgggccagggcatcctcctgggcgcagccggacaggccaagggtcacagcggtcagggccaggccgccggcagccagcaggctgcggcgggaggtcacgggattgcggtgggtcacagctaggctccaggggtgctggacgcacccggaagaagggaggccgccggttcgctgtactgcacgcgcaggagcgtgccggcgtcgtcgaacaccagggaggtgatggaggtcagggtgcattcgcgtttccgcgggtcatgccacagcggttttccctcggcgctgaggcgggtggcccagatggggagctggtggctgaccatgatggcttcaggcccctccgtcccgaagtcaccggctgccagttcgatggctcgcaaccgcgcgtcctggaccgcttccatcacccgggaagcctggttcttgtacggttcgccccaggagggccgcagggggttgaccagtcgcggccagtgcttcgggcggcgcagctcagccttggtgaccctcatgccctcgaagtagttctccgcctcgatgatccgctcgtccgtgtggatctgcaggcgcagggcgtccgacgtcggccgtgcagtttcctgcgcacggtccagcggggaggctgccaggtaggtgatccgggcaccgccggcagcgcggcggctgaagtgttcggcgagcgtgcgcgccatctcctgccccagttcggagaggtggaattcaggcagccgcccgtagagaacgccgtcgggattgtggacctcgccgtggcggagcaaatggacagtggcttggggcatgtttaccagtttctcaaagatggcgtgcgatccgaaatctcccgcacaagctttctacagagagtagaactgaagtttttgaagaaatgttccgaaggcgggaacaaaacatgcaaatgcatgtttatactggatgcagcagttagttgagacttcaacagatgaaggttcaacggcaaacccgacagcacacacacaaggagcatcaccatggcacttcccgcagacgtcaccaccggcacctggaccctcgacaactcacacagcgagatcggcttcacggtccgccacgcaggcatcagcaaggtccgcggccagttcaccgaagccgccgccacccttaacctccccgaggacgtcaccggcgccagcatcaacgccaccatcaacaccgccagcttcgattccggcgacgtcaaccgcgacggccacgtcaagggcgaggacttcttcgacgtggagaagttccccgaaatctccttcgtctcgaacggcctcgtggccaagggcaacagctacgaactgaccggcgacctgaccatcaagggcgtcacccgccccgtcaccctggacaccgagttcaacggtgtggctgttgaccccttcggcaacacccgtgcaggcgtttccgcggagaccaccatcagccgcaaggacttcggcctgacctggaacgccatcctcgagaccggcggcgtcctggtgagtgacaaggttgccatcaaccttgagcttgccttcatcgctcccgcggcataattccttccgctccggcaccccggccctggactcccgcagtccggcgccggggtgccgtcctttaagcacaccgccccttccgagtcccggcggggtttacagtgagggccatgagcaactcacccagcgcgccgcggaacgtttttacccgaatgttcctggtaacgggcctgcccaccgaactcaaggtttccttctggatctggtttgtgggcggcatcctgggcttgctgggtggcatgctcggcatgctggcatcgctggtgctctttgccgcggcgccgggggcggccacgctggtgctgttgctcatgctgctggcggccgcggtgggcgctgcgcagatcgtcttcgcccttgccatgaaggacggaaaacgctgggcccgggtaggcctgacggccctcaccggcgccaccctggtcctggcggtggccaacgccatgatgggtgtgggccagggcggcaactgggcaacgttcctcatcagcctggtggcaacggtcctgttgtggctgcccaattcccaggccttcttcgcggcagcccgctccgggaatacctcttccgaatgacccccaaggcgcctgcccgggggtacggtggacgtaagtgttgctgggggtaggggacaggaccgatcccggcgatttacctggaacccgacacgcaaaaggaccgcccatgagcactccccccgtcccgcctcccgttccgaacgaacccgagcctggctccgagtctggcaggcaggctccgcgctacggccagaacgcaccccagtacggccaaaaccagccccagtacggccagcagtccggaacaccgcagtatggacagaacgccccgcagcacgggcagaacccgccgcagcatggccagtccggcgctccccagttcgggcagaatgcaccgcagtacggccagaacccgccgcagttcgggcagaatccgccggcagcccccggctatggccagcagccgtacggccagtccccgtacgcgcagtatccgtcggagcagccccagccctccggcagcacgggtgttccccagatggtcaacatctccttctggctgctgattgcatccgccgccatcttcgtcatctcgatgctgaccggcctgaccacgctggacgatcccatgttccgcgacgccttcgaaacccagatcgagggcagcggcgctggagtcacctacgaggatatgaagggcgtgatcgccggaaccctggtggtgttcgcaatcatcggcctggccctctacctgctggtggcgttcttcgtccgcaagggcaagaactgggcacggatcctgggcaccgtctttgcggcgctgtccatcttcggactcttcggcccgcccagctttggaaccctcggcaccctgctggggatcgcggccatcgtgctgctttacctgccggcctcggctccgtatttccggcgccagcagccgttcaccaacccctacggtggcaacatggggaacccgtacggccggtaactccaagcaccacccacccttcgggcgtgggccccggaaccaagcaggcactgctgacggaaactaggcggtctgccccggggcctgcgcccgttgtgcgtggtaggcgaggatctgcagttccgttgccatgtccaccttgcggaggttaacgccctccggcacctgcagcatgatgggggcgaaactcaggacgctgcggaccccggccgccaccacgcggtcgcagatgtcctgggccaccgatgcaggcagggccaggaccaccatattggctccggtgcggtgcagcacggtttccaggtccgccacatcgctgacgcgcagccagccgacctcgttgcccaccaccatctggtccgcgtcaaagatggccacgacgtcgaagccgcgggattcgaagccgccgtaccgtgcaagggccttgcctaggttgccggcgccgacgatggccactttccagtcgtgggtgagtcccagggcggcggcgatgtgccggctgaggtactgcacctcgtagcccacaccgcgggtgccgtaggagcccacgtgggagaggtccttgcggagcgttgcggagctgaccccggaggcctcggcaagtgattcggaggaaacccgctccacgccctcggccaggagggtattaagggcacgcaggtagagggtcagccgggccactgcagccggcggaatctgtttggctgccgtgcccgcagctcccggcaggtccgggacagcctggggggttgaatccagcgaagccaccagcccctccctcgcatcgcgttgtgactccactctagggcccaaccggcaatgccatcaaagcaggcgccgccgatgcaagggacactgaaggcctctccaccacggtactgctcccctactgtgccatggcccgctggagcacgcgcgccagccgggcttcgtcgattttccagaaatcgcgctgcacgccatccaccagcaccaccgggatttcttccgcgtagcgctcacggagttccggctggtggtccaccaactcttcgctccactcaagtcccagcgaggccgtaacccggctgacggcgtcgcgcgcgtcttcgcaaaggtggcagtctgccttggtgatcaggacaacgcggggtgtggccatgcgttaaccgtagacccgttcccccgggaccggcgacgccgggcaaggggggaacaaggctaaacggggattgaacagtgaattgactagactcgactgcatgcccgaggagaagtacgttgccgtagtcaccaagccggttgctgcgccgcaaccgggcgaggcagcgtttttcgacgtggacaacactctgatgcgcggtgccagcctcttccacgttgcccggaagatgcaccagcgcggggcgttcaccatggcccaggcggccgggttcgcgtggaagcagttcaagttcgtggcccgcggcgaaaacatggacgatgtccatgcggtccgcgactccgcactgacgctggccgcaggcatcacggttgacgacatcaaggcgctcggcgaagaggtctacgacgagatgatcgcctcccgcatctggcctggtgccaaagcgctggcggagcagcacctgcgcgtgggccggcgggtgtggctggtgaccgccacccccatcgaagtggccacggtgatctccacccggctggggctgaccggggcgctggggactgtgggggaaatttccgagggcatgtacaccgggcgcctggtgggtgacatcctgcacggctcggccaaggccgtggctgtccaggccattgcggacgccgaggagctggatctcaagcgctgctgggcgtacagcgactcctacaacgacattccgctgctcaccctggtgggccacccggtggccatcaacccggacgcccgcctgcgccggcacgcccgtgacaacaactggccggtctacgatttccggtcaggccggcgcgcagccacgttcggcctcaaggccgcaacggccggcggcgccgtctacgggctctggaagggcttcgcccgcatccggggcccgcgcatctagctccccgggccccgctcccatcccgcacaaagaaaatgcccgccgcctcggaaggcgacgggcatttctgcgctgttcgaagtatctctacttcttgttgcggcgctggtgacgggtcttgcgaagcagcttgcggtgcttcttcttggccatacgcttgcgacgcttcttaataactgaacccacgtaagttccttacaaactagatgcagtacctgtctgatggaaattgttcgtggacagagctacgaactgaacaactgacagattcttacaatgacgtaaaacgttccttaacagggtaccgcttccgggaggcggccaaggacagctgctcaggctgtctcggtgtggccgtccaccacagcacctttgaggtactgttccacggcctgttccggaacccggtaggagcggccgaagcgcactgccggcatttcgccggagtgcaccagccggtacacagtcattttggagacgcgcatgacctgggctacttcagccacggtcaggaacttcgcgttggagaagttctgttctgccgacatttccctattttcctttgctgacggatggacaacagtgaccccaggtacgtgccaatgcggtgttccgatgctgagccatccaccaaccacctatccagatactctagatgttcctgtggcagatgtgaaagtagtaaatccccctacttggcttcccggcgcttgcgggcggacgccgccagctggtccaggacagacacggaaatgtcccactccatgcaggcatcggtgacgctctgcccgtacaccaggtcagcccgtccgtccgcatgctcggcaacatccaggttctgcgcgccgcccaccaggaagctttccagcatgacgccggcaatcgcctgcgccgacgtgccgccgtcctcgagctgagcaccgatctccagcgccacctcggcctgccggtggtggctcttgccgctgttggcatggctggcatccacgatgaggcgcgggttcagctgcttgccggccagcttggctgacgccgccccgacgtcggcggcagagtagttgggtcccttgcgtccgccgcggaggatgacgtgggtgtccgggtttccggcggtggacaccagtgctgcccggccatcaccgtcgatgccgaggaaagcctgcgctgccgccgctgcaccgcaggcgtcgatggccacctggaggtcgccgtcggtcccgttcttgaagccgatgggcatcgagagcccggacgcgagctgccggtggatctggctttcggtggtgcgggccccgattgcgccccaggagatcaggtctgccatgtactgcgggctgatgggttccaggaactccgttgcggtggggaggcccagggcggtgacctgctggaggaagtgccgggcggcgcggaggccggtcaccatgtcgtggctgccgtccaggcggggatcgttgatcaggcccttccagcccacggtggtgcggggcttttcgaagtaggtgcgcatcacgatcagcaggtcttccctgtgcttctcggcctggctcaccagccggcgggcgtactccaggcccgccttggggtcgtggatggagcagggcccaacgatcaccagcaggcggtcgtcaacgccgtccatgatggcccggacttcatcgcgtccgcgttcgacgacgtccgccacccgcgcgtccaggggcagttccgcgatgagttcctgcggggtaggcagcgccgtgaattcgctgacgcgcaggttcgacgtggacctggccgcggattccgttgcggatgtgccggcggttgtggttgcgggggctgttgcggtgctcatgttcgggtcctgttccagatgggaagcgggcccggatcagaacccgccggagaaacggcgaagggcagagaataatctctgccctgttggctctgaaggaaaattggatgcgtgtcagttagacgcgggcccctccagagccaacgaaaaatacgcataccaacggtttgtcatgccatgaaccataaccacaggttccgcggatggcaaaacggttacgttgcgtcacgcgacaggcttgccaccagctcagcgtgcttccggtccgtgaggcggtaccagcgcatgatgcccacagccgccaggaccagggcgccgagaagcagtcccgccgcggcccggattgccagggttgcggattccggctgttctgccacacccgaggcgtaaccgccccaggccagcgaaaaagccacaacgccggcaccgaagcccatgcccagcttcctggtggcggccaggagcgcgtaattgatgccctgcacccggaccccggtcttccactcgccgtattccacggtgtccgcgatcagcgcccacgtgacaatgctgacggacgcggaagcaagcagccccagcaccaggcttgccacgcctaacaggggcacctctgcgggagccaggaaaaccagcagaccgccaacggcaccgaggctggcgccggcactgtagacagcacgcttgccccagcgcgccaccggacgcggaatgaggaccgccaaggtgagcgtgatggccacctgcgcggcggccatcaggggaaacaggtccacccgggacaggacatcgcggaggtagtagaactgggatgctcccgcggcggatgttccggtgacaaacagcacggagctgacgcagaggatcaccagcggtgaattggccttcagcgccgccatgctctggctgagggtaatcctggggacgcggccgggaacctgctcggcgcaggcggcaccggtgaaggcgtacagggctgagccaaccaccgcgaacgtgatggtcagccaggtgaagacctgctgcatgtcctgcccggcccccaggagcggggcgatgaagaagccgagcgcggcgccaacggacagcccgccaagggtccgggcgccgcccagccgggcgcgctgcctggcgtcctgcgtcatggcccccaccaggcagccgtagggaacattgaccatgctgtaggcgacgcacaccaggccgtacgtgcagtaggcgtagagcagcttcagggacggttcgacgtccgggacatggaagacggccacgctcagcaggagcgggacgaagccgaacatcaggaacggccggaacttgccccaccgcctgctgtggacgcggtccacgatgcgccccgcggcgatgtccgtgaaggcattgaagacccgcaaaagaagcagcagtgttccggcggccgccgccccgatccccgcaacatccgtgtagtagaccagcaggaacatgttcccggtgctgatgatcatgctgttggcggcatcacccgcgccgtaggcaaagacgctgagcctgctgagtttcttcattgcttcctgttcccgcggctgagaaaccgttttctcagcccgcagagggaacttaccccaaaatcttgcgcagaaacagcagctgccggatccagtggtgttcctggccgccctcgtggttgttgaaccggtacacctcgatctccttgtccgccccggatccggaggagcctgccgttccggtgccgtacgcgttgaaacttgcgaagaccgtggacggcgggcagatatcgtccatctgggcggctgagtacagcgcaggggctgttgcccaccgggccaggttgacgccgtcgaaatagcgcaggacggcgagcgcagcgtcgtaccggtcccggtgccgggccaggaactgggcgatctcggggtacgggccgcgcggtgtgatgtcgatggcccgggggaagtcctgcaggaacgggacatcgggcagtgcggcgatgacgccgtcgagccttccggccgccaggcccgcagtggccaccacaatgccgccgccttggctgacgccggccagcaccacccgggcggggtcgacggcggggtgggactgggcggcttccacggcccggaaggcgtccacgtacacccggcggtagtagtagtcctcgcggcttccgatgccccgggtcatgagtccggcgtgggcgacgtccccggcggaggggtgcgggtccgccgtatcgcccagcgtgccgccgtagccctgcccgcgggtgtccatgatgaagtgcgcgtagccggcctgcgcccagcgggtgtcctggttgaccagcccgcggccgccggagtagccaacgtactggaccaccaccggcagtgcggccccgggttccctgtgcgccgggaggtggagccagccccggaccggagcgccgccgtagcctgcgaaggtgacgtcgaaggtgtcgatgacggagaggtagttttccaccggctcaaagctggcgtccagcgggaaggagcgggcttccctgatggtggcgtcccagaagtggcccaggtcctccgggggcgtcacatccgaggagtaggcgcggagctgcgcaagggggaggtcgaagagcggcatggtcatccaatcctgtcggtaggtacgctgcgatgggcgctgtaggtgagaactgcgggctttcctggctcaaggtgcgcttcccttacgcccggcccataccggaccaggaccttgagcggcttccgtgcggccagggttgcctgcaccagcagcccgtcccgccagtccaggtccacttccaccccgggccgtgcacggagccgcccggcccggccagcgggcagttcggcgggcagggcgggaagcagctctatctcgcgcagcccgtccacggtgcggtggctctggaccaggcactcggccagggcggccacgtacccgaggttgccgtcgatctggaacggcgggtgggcgccgaagaggttggggtacaggcctccgctttggccgccgcggggtgtgtccatgtcccggaagtagagccgaaggaggtcgctgaccttgccggcctggcggagccgtgcgcgcagcaggatcttccaggccagcgaccagccggtggcttcgtcgccccggccgtccatgctggcccggacggccgcttcgagcacgggggtgagtggcgtgtccccgggataggcgaggtagaggtggctgacgtgccggtgcccgggttcccattcctccgggtcatcaagccactcgcggagctttccgccgcgtccgggtgccggcgcggggatcccgggcagggcccggcgcgctgcggaggccacggggtcctcctccaggcccaggcggcgggcaagcgcgtccagcatcctgaaaacatcgccgatgagggccaggtccatggtggaggaccgtgcggcggctccctgaacccgggtgccggaggacgggtctggggcggcgaatgtgttttccggggacgtggaggggatggttcccagcgagccgtcggggaaatcaaccaggaggtccagggcgaattcagcggcaccccggatggccggccaggcggtgtccctggcaaaatccggggcaaaactgtccggggcgaaagtgtccgcgtccgcggacctgtccgtgctgccaaactgcagatgctcccacaagtgccgcaccagccagaggcctgccacgggccaatacgcccactccggcgagtgcgccccgtgccccacaggttttgcgtaggcccagagatccgagttgtggtgcacggcccagccgcgggcgccgtagtactcccgggccaccgcggccccggtcccctgcatggcttcgatgagggcaaagagtggttccgcgcactctgccaggcctgtgggttcggcgccccagtagttcatctggaggttgatgttggtggtgtagttggagctccacggggccggcagctcggcgttccagatgccctggagatttgccggcactccgcgccaggctgtcccctgccgcgagcccgcaggggcgggccgggagctggagatcagcaggtaccgcccgtagttgaacagcagggcagccaggcccggatcagccgccagcggcccttccgggtgggcgttggccgccagcagccgccggcccgtatccccgccctcccgcaccggaacatcgagctccacccatgcggccccgtagagcctggaatggctctcctcgtgccggccaagcaggacctcccgtccggacgcgcgggcctggtccaccacggtgcgggcggcggccgcggcagtggaggcgctgccccgaggttggcgggccagccccgcgaaggtggtctcggtggtgaggtagatgtcggcgcgccgcacgcctgtggcggccaggccggcgtcgtgctctaacgctgggccggccggtccttgcacgggccggccgtcgtgctcccaggtggccgccactgccccctgcatgctgagggaatcgtcctccgagtactccacctcgccgccatcgtgcgccggcgccgcgtcggagggcattttcagttcgagggacaggctcccctccccgcccgagcggcggaggagacgcagcggggagtccaggcgcaaggcaaggtcgaggccctgcggcgcgtcggtccgcagcgagaccaccagcactgacggatcgtggctgatgaacgcttccacccggacggcgtggccgtccaggaagtacgtgttggtgttaagggcgcgggcaaggtccaggccgcgatgatagtccgacgacggctgtgcgggagcgccgccgtctcccctttcgcctgctgccgggtttgctgcggtggctgacgccgtgaggtagaggtcggcgaacgggaggtaggcctgcgagtgccggtgctgcaggcttttcaggatccccgcggcgcccgcgaagtcgccggagcctatcaggcggcggctttcggtgaggatccggtccgcctcctcccggctgaagacgggctcccggtcctggctgtgcggtgacccggaccaggcggacgagtcgttgagctggaaccggtgttccacgtccgcgtccgcctggctgccgccgaacaccatggcccccagcctgccgtttcccaggggaagggcctccagccaccgggcagcaggggcatcgtaggcaaggaggtgctctgggggcatgggttcagatcctagggccggccggggaacaagggaaggtcaggccacacactgaacaggagctacagccgcgagagttcagggacgaacacccgcaggttgtggctgtgcaccaccagtgcacggagttcggccaatcccccggaggcttcccccgcggcgcgcgcctgcaccaggacgttgcccagcgcagttgcttccacgggccctgccactactttcttcccggtgacgtccgccgtgagctggcagagcagcctgttttgcgagccgccgcccaccacgtgcaccacgtccacggtccggtcagccaggcgttcggcgtcccggatggtgcgggcgtagccggcggcgaggctgtccatgatgcagcgggtgatggtggcggggtcgtccggcagtacctctccggtgcgccggacggcggcccggatgcgttcgggcatgttgtccggggcaatgaagtagggatcgtccgggttgatctgcggcccgcccggcggcagcgcggccgccgcggtgagcagggccgtgagctcgggccggaacccctcctgcgcccaggtccgctggcactcgctgaggagccacagcccgcccatgttccgcaggtagcggatggtgccgtccacgccgcgttcgttggtgaagttcgcctcgcggctggcttccgtgaggacgggatgcttcagctcgagtcccaccagggaccaggtgccggaggagatgtacgcgaagttttcctcgccgtcgtctgctatcgcaggcaccgccgccaccgccgaggcggtgtcgtgcgagccgacggccacgacgcgtgtgtcctgcggcaggcccacctgcgcggcgatctccggcaggagggtgcccacggcctcgccaggctggatcagcggcgggaacaggtccttccgcaggcccagcgctgtgaggaactcggtagcccactcccccgcgacggcgtcgaacaggccggtggtggaagcgttggtggcctcggtgcggcgctgcccggtgaggaggaacgcgatcaggtccgggatcaggagcgcctgcaggccgtccaggttcttttcgctggccagctggtagatggtgttgaactgcaggaactgcagccccgtggtcccatacagccgtgcggggtccagtttccggtgcacgggttcgacggcggcgcggctgcggtcgtcgcggtagctgaagggctgggcaaccagctccccggctttattgaccaggccgtagtccacggcccaggtgtcgatcccgatgctggccacctgctcgccctgggcagcggcgacggtggctgctgccgccaggcccttgaggacctcggcgaagagggcgtcgaagtcccagcgcaggccgccgtcgatctccaccacgccgttggggaagcggtggaccacctccagctccacgctgcgttcacggctgcccgttccggctgtgtggacgcggcccaggatgacccggcccgaggaggcgccaatgtcgacggcggcgaacaccgaaccgccgtcgacacgtccctgtgcaggggatgcggacgtgctcatcgcaggaaggctgcggccactccggcgtccacggggatgtgcaggccggtggtgtgggacagttcgttgctggtgaggacggctgcggcgttggccacgtgctcgggcaggacttcgcgcttgagcagggtgcgctgggcgtagtactcgcccagtttctcctcgtccaccccgtacacggccgcgcgcttggcgccccagccgcctgcgaagatgccggagccgcggaccacgccgtcggggttgatgccattgacgcggatgccgtgctcgcccagttccgccgcaagcaggcgcacctggtgggcctggtccgccttggtggcggagtacgcgatgttgttggggccggcgaacacggagttcttggaggagatgtagatgatgtccccgcccaggccttgggcgatcatgaccttcgccgcggcctttgccaccaggaacgagcccttggccatcacgttatgctgcaggtcccagtccttctcggtggtttccagcagcggcttggagatggacaggccggcgttgttgaccaccaggtccacgccgccgaacgccagcaccgcggcgtcgatcgctgccgcaacctgggcctcgtccgtcacgtccgcctgcacaccgacggcgacgtccgggccgccgagctcttcagcaaccttctgcgcgttctccaggttgaggtccgcgatgaccacgcaggcgccttcggcggcgaggcgggtggcgatggccttgccgatgccggaggcggcgccggtgaccagcgcgatgcgggtggcatgggacttgggcttgggcatgcgggccagcttggcttcctccagggcccagtactcgatccggaacttctcggattcctcgatcggggcatacgtggagatagcttcggcgccgcgcatcacattgatggcgttgatgtagaactcgccggcaacgcgggcggtctgcttgttggcgccgaaggaaaacatgcccaccccggggaccagcacaatggcggggtccgcgccacggagggccgggctgtccgcgtccgcatggcggctgtagtaggcctggtagtcctctcggtagtccgcgtgcagttcgtgcagccgtgcgatcgagtcctcgatggaggcgtcggcgggcaggtccaggatcagcggcttgaccttggtgcgcaggaagtggtccgggcaggaggtgcccagggcgcccaggcgcgggtgctcggcggcttccaggaagtcaaggacgacggcgtcatcgctgaagtgccccagctgcggcttgtccgtggaagccagcccgcggatcacaggtgccagcgctgcggccttggcgcggcgctttgcttcgggcagggcggtgtagccggggagcttggccccgaagggttcggccttgccgttgtccttgatgtacttctcggcctgttcgatgatccagagcgagttctgctcggcttcttcgctggtggcgccccaggcggtgatgccgtgcccgcccaggatggtgccgatggcctgcgggttggcgtccttgatcgcggcgatgtccaggcccagctggaacccgggacggcgccagggcacccacaccaccttgttgccgaagatctttgtggtcagcgcctcgccgtccaccgcggtggcaatggcaatgcccgagtccgggtgcaggtggtccacgtgcgctgcgtccaccaggccgtgcatggcggtgtcgatcgacggcgctgcgccgcccttgccgtgcaggcagtaatcgaacgcggccaccatttcgtcttcacgctcaacgccggggtagacgttcttcagcgcgttcagccggtccaagcgcagcaccgcaaggttctgggccgtcagggtccccaggtccccgccggagcccttgacccacagcagctgtacgtcctcgcccgtgaccgggtccttctcggtgcccttcgcggaggtgttgccgccggcaaagttggtgttccgcttgtccgcaccgaggcggttggaacgggaaatcaggtcttcaacagtcttattcgtcatgactaatcaggcgccccatccggcttgctggccgcccacgcggtcctcgttgatcttcttctggtagccgctggccttgaatgcggccagcgggtccgcgggcaggccgcgggattcacgccattcggccaggaccggccggacgtcggtgtagaaggcatcgttgaaaatgccgttcgctgccagcacgtcaccggcgcgctgggcctcggccagggctgcggtgtccaccagcagggccctggccgtcatttcctgcacgttcaggaccgagcggatctggcccgggatcttctcctccaggttgtggcactggtccagcatcagcgccactcccgaatccttgccgaagccaccgccgcggatcacctcatgcatgatgcggaacagctggaacggatccgcggcacccacaatcaggtcgtcgtcggcatagaagcgcgagttgaaatcgaaggagcccagcttgcccaggcgcagcagctgcatcacgatgaactcgatattcgtgcccggcgcgtggtggccggtgtccaggcagacaaacgccttctcgcccagggccagggtctgcgcgtaggacgtgccccagtccggaacgtcggtgtggtagaaagcgggctcgaagaacttgtactcaagcaccaggcgctgctcgtcacccagggcagcgtagatctcctgcagcgactcggcgaggcggtcctggcggcctcggatgtcatcctggcccgggtagttggtgccgtcagccagccagatcttcagatccttggacccggtggcgtgcatgatctcaatgcagtccaggtggtggtcgatcgcccggcgccgcaccgcctcgttggacgaggtcagggagccgaacttgtactcgtcatcctggaaggtgttggagttgatcgtccccaggccaacacccaaaccggccgcgtactccttcagggcggcgtagtcatccaccttgtcccacgggatgtgcagcgcaacggtgggagccaggccagtgagttcgtgcaccttcgccgcatccgccagcttctcctgcacggtgcgcggggtgccgggagtgccgaacaccttgaaccgcgtccctgaatttccataagcccacgaggggacctcgatggcaagctcctcgagcctgcccagcgccgttgctacgtcattcatgatggttctttccggtgtcgtgatgctgtggtctgtggtgttggccccgctgctggagccggtgtgcgtcagttcgcggtgggctcggccgccgccagctggctgtcaaggttgaagacttcttcaaggacctggaacccttcgtcgggagcctggcctgcgtcctcgaagagagtggccatttccgcctgccagcgggcgttgacgtccgtcagcgccatgcgtgcccggacggcgtcgaagtcgtcgcattccaggtagcccacaaggagcccgtccccggagaggaacaaggagtagttgttccagccggcgtccttgagggcgcggagcatgtccggccacacggctgcatgccgccggcggtattcgtcgatcatggccggctggaccgaggagcgaaaacacaccctcatgtttggttctcctgaaatcgcaaatatttgaatcgtttcattgttacgattcaaagtactcttgaatctgagcaggtgtcaagcattcctgcccgcggtccacaacccgggcttaatgcgtgccacacggagcagcagcacggagaatcatgaatcgttcagccagtatcaaggacgtcgccaaccatgccagcgtggcggtgggcacggtgtccaacgtgctgaattacccggacagggtttcgcagcggaccaaggaccgcgtgctgaaggccattgacgagcttggcttcgtccgcaacgacgccgcccgccagctgcgcgcgggccacagccgcaccatcgggctcatcgtcctggacgtgggcaacccgttcttcaccgccgtcgtgcgtgcggccgaggacgctgccgcgctccacggcagtgctgtcctgctaggggacagcggccacgacgccgcccgcgaggccaattacatcgacctcttccaggaacagcgtgtccagggcctgctgatctcgcccgtgggcgatgtgaccgagcgtctggacctcctccgcgagcgcggcgtgcccaccgtcctggtggaccggctggcggacgaggcaaagttcagttccgtggcggtggacgacgacgccggcgggtacctggcagcgcggcacctgctggacaccggccgccgtcggcttgcctttgtgggcggccctacctccatccggcaggtggccgaccgcctccagggcgcccggcgtgcagtcaaggaggacgcggacgccacgctggaggtgctcgaatccgaggggcagaccgtcctggcagggcgcagcgtgggcaactcgctggtggagcggggccgtgaagggctgccggacggcatcttctgcgccaacgacctcctggctttgggcgtgatgcagtccctgaccatgacccacacgttccgcatcccggaggacgtggcgctgattggctacgacgacatcgacttcgctgtctccgccgtggttccgctgtcctccatccggcagcccacggaggcattgggacgtaccgccatccagttgctcgccgaagaggtcgaatcccggaatccgacgcaccgttcggtggtcttcacgccggaactggtggtacggcagagcacaaaagccaattaattgccggcctgcagccacttcatggactcggtccgggaggtgaagaagcgggtgggacagggcgggatatgcacgccaaggaagaaattggcgatgatccggtccaccggactggcacccagcagcgcaatgcggtcggcggcgcaggggatggaaaacacggagcgggccgcccgggtgacgtcctctgtggtggccatgtccaccagcatgggataggtctgctcaccggctatctcgttgacggccgccatggcagcctgcgcgtcctcgatctctatccggaccttgggttcccagatcaggtggatgacgccgtcggaacgcaactccaccgtccccttgcctccgtcgacagttaaaggctccaaacctgcttcccctcccttgaacaggacccgatgacctgagccgacaagcatgattctcttatcatgccgtagctttgcctgcccgccctcctgcaggccctggtccctgcggcaacggttggcaccggcccttgtgggcgggcggcagcagaagcaaggattggctatggatgacctgcggcacaccgccagagacctgctgcagcggaacgaccgtggcctggtggacctctggatcctgtactggaaccacggcgggcgctgccaccccttcgacttcgatgcctttgtccacgacgtgctgccggtcgagtggttcgacgtggacgctttggcggttgctgttgaggaactggcgctggaaagcatagcctgatggatgcccgcttcagttacagatgagcagaaccggctgctgaggtcctggcttggcccgttcagggtggtcaaggactactcctggcccctgcaggacacctccgtgctccacgtgtccacgcccgacggcgggagcttcattgtcaaggcgagcaccaccagccaccacatccggcgggagatcgccgccctggcgccgggcttgccccgcctccacggctcagcccctgtgctcaggcaggcttcggtgaaggccggaatcctggtcaccgagttcctgccaggaacgtcagtggagggaactgaagccgagtaccagcccgggacgtaccgccaggccggagcgctcctggcacagctgcaccgccctgccgggacctcagccgactacacgaagaaactcgcctaccagacacagctgctcatccgctcggctgaaggactgctggccgccggcctgcgcgcccgggccgctgaggaactggccagcatcacaccggcccccgtggagctggtgaccacccacggtgactaccagcccaggaactggctggtggatgggggcaggatcaaagtcatcgacttcgggcgggccgacgcccgcccgtgggtccatgacctggtccgcctcacccaccagcagttccttgggcggcccgccctggcggaggccttctacggcgggctggggaagcaccccaagagcgccgaagcagacgtgtggcagctggaaaacctgaaccaggccctgggaaccgtggtctgggcccataaaatcggtgacgccgcctttgagcagtccggagtagagcggctggagcggatactggctggctaagggcctgggcgccagcactgtcctgtggcctcacgcgacctcctgcgaggatggagccatggaattcaaccggctgctgcagatccggcgtatctatgcgcaacccgatgccctggagctgccccgggggaaggagatcgtcggacgctggccggacgccgacgtcgtgcttgttgacagccactggaacatccccgatctgcacggtgaagaaacgaacgtgccgcgctggtcccggatcaagacggaggcgctggtccttggcgtcaagaaagcactgtccgtcaagccgaacggccggtcagcggacttcattgcaccgtcaaccgcgaacggctgcgccatggcatgcgcctactgctacgtgccccggcacaagggatacagcaatcccgtgaccgtgttcgcgaacatcgaccagatttccggggcgctggagcggcacgtcacgcgccagggcatcaagctggagcccaaccagtgcgatccggaactctgggtctacgacatcggcgagaacagcgactgctcggtcgatgcgctgatcagcgacaacgtggaggatctggtgacgctcttccgcgacctgcccaccgccaagctgtcctttgccaccaagtacgtcaacccggcgatgctcggctgggaccacggcggccacacccggatccggttctccctcatgcccgcggccctggcgaagtccatcgacgtcaggacctcccccgtggctgaccgtatggccgccatcaatgacttcgttgatgccggctacgaggtgcatgtgaacttctcccccgtcatcatcactgatacgtggctcagcgactgggaggaactgctgcgccagctggaccgcaccctcagcccggccgcaaaagcccagctcgcggcggaagtcattttcctgacccacaacgagcggctgcacgaggtcaacctcggctggcatccgcaggccgaggacgtgctgtggcgcccggacctccaggagtccaagatctcctccaacggcttcaccaacgtccgctaccgcgcggggaccaaggcacgctacgtgaaccagttgacggcgctgattgaaaggatcgcgccgtactgccgcatccgctatgcgttctgaggctgccggcgggcaccggacagcgggagcgcccggcgctagactgatcccatcatgactggcgcccgttcccgcctccttgcctggctcgtcgccctggcgacctgcctcggggcctgcgcgcccgccgtcggcatcaacgaagcgcccgccgggcaaacggttccggcttcccaagcctccgcaaccggcgttgccctcgccccgcaggggaccaccgctccgattcccaccgccacgcccgcgcccgcgcctccgccggcgcccgcaccacccccggtcccccagccttacgcgctcaacctctaccaggagggagacttcgtgccgcagtacacctttgactggtgcgttgcggcgagcatccagatggcgcacaacctcattgacgacaccggtggcggcacctgggcggattccacccagcagggcgaactgtgggagatggcacgggcacggtcctccaattccttcaatggcgccaaccccctcggctgggcgcaggtactgactgaagtgggcatggggccgtacagagtggtcagcatcgccgactacgggtctgccctccagacggcggcacgcgccatcgctgatacgggccgcccggtggggctggtcatgtggagcggccgccatgcgtgggtgatgagcggtttcgagtcgatcggcgaccccgcccagttcccggagttctctgtcaccggcgtccgcgtccaggatccgctctacccgcacggcagcgggcaatggggcccgtcgccggagcccaacagccttcttacccccgagcagctggccacgcagttcgtggtccgcgaaccgcggcgctggagcagcgaattgccggcgggccacctgctggtgctcccggtcgccggggcctgaccggccgcggctggggaggaaccgcgaaggaatactggccgcgcgcggcggagcagggcgggtacggctgcccgccaccgtataatttcagcatgccgatcacgcgcctgcatccaggcagccacgcccagccgtccgaacgcgaacactgccggagcggtctgtgagcggcggcctcgtcgccctgctggacgacgtcgcagccctggcccgcatcgcggccgcctcggtggacgacgtcgcagccggagcggcaaaggccggggccaaggccgccggtgtggtcatcgacgacgccgctgtcaccccgcagtacgtgtccggggctgacccgtcccgcgaactgccgatgatcaagcggatcttctggggctcgctccggaacaagctgctgatcatcctgccggcactgctgctcatcagcgccttcctcccgtgggccatcccgttcatcctcatgctgggcggcacgtacctgtgcttcgaaggcgccgagaaggtctggcacaagatccgccgggaccactcggacgaaaaagcgccggcggtcgagcggggacctgaggcggaagccaaggtggtcaagggcgccatcaccaccgacttcatcctgtcctgcgagatcatggtcatctccatgaatgaggtggccgccgaatccatctgggcccgggctgtcatcctggtggtcgtggccctcgccatcacggtgctcgtgtacggcgccgtggcactgatcgtgaagatggacgacattggcctgcacctggccgccaaggaatctgcgggctcccagcgcttcggcgagctgctggtcaaggggatgcccgccgtgctggccgccatcaccctgatcggaacagtcgcgatgctgtgggttggcggccacatcatgctgcagggggcctacgacctcggctggcacctgccgtatgacctggtccacgccctcgaagccccggtggccgggattgcgggtatcggcggcctcctggcctgggtcgtgaacaccctctgctcagccgtcctgggactcgcctggggcctcgccgtgatgaccgtcctgcacccgctgctgaaggccctgccgttcggcaaggagaagggccagcacgaggaaggtgacgtccgcgccgaactcgcaggctaccggccgacgaaccacacgtcggatcccgctccctagccggactaaacctcctccaccaccaggttccggtacgccgcccggagcggggccatctgccggaagcccaggtagccgccgcccagcacggccgcggaggagtcgtgccactcgaaaagcggcagcccgttgatggcgaaagccacccgcggcccgtccttcacaacctccatccggtagaagtccacagcgtccccggccgggggcagcggatcggctccctgcgccaccagttcaaacccggcgctcttccggaggttgcaggtccggaaggcccgctcggactcgtatttgtgccggaaataggagacgtgcagggcatcgatgtccccggaatggtactgcgggtagtaccccgtccgcggcgttagcgcactggaaaacaggtccctgccattgtgtccccgggctgcgaagaagagcatggccaggcccggttcctccagcggcaggaattcccaactgatcctgatgccgtccggtagctccaccgggcaccagaacgtccagtgcgcatggtccccgaattccgcgccgtccaaagaacccgacagttccagggcgctttggtgagtccccaggctcaacggcccttctgccacccagtcccccacgtccgccggggatgtgagagcgttgctgtacagcaccttcgtctccacgccggacgtccccacttagccgcgtcccgccgtcgtccgtaccaggccgcccggcaccagccccagttcccggagccgggcggcaacgtgtccagccaccagcgcggccccctgctgggagaagtgggtgttgtccgccaggccgtccggccagtgcgcgtgcgagcccggcgcgaagtggcagaagagcgacgccgattcgtcccgtcccagctgcaggtacagcccgcgggtccacgcgttcaggtcaatgaccgccagcccgagctccaggccgatctcccgcaccacctccgggtagtcctccaggctctgttccaggtctttttgcccagcagcaacgcccgacgacggccggtccaggaagtgcctgcgctccaccggggtgcagagtacaggcagcgcccccaggttctgcacctcccccgccatggtgcgcaggttggcggcgtagccggtccgggccgcaaggtgctgcttcttctggtcgttgtggccgaactggatcaggaccaggtccccctccgcggcctccgccagcaggccggcccacaacccctcgtcccggaaggactccgtgctggccccgcccttggcgaagttgtgcacggccgcccaggtgtaggaatgtggggcaaggtgcgttccccagccgctcatggggtactcgtgcgtggggcagtttgccaccgtggaatctccggcgagcaggattttcatgctgtactttctctcgtggtgcaggctcagcccttgacggagccgatgagcatgcctttggcgaagtgcttctgcaggaacgggtagaagatgaggatgggcagggttgccaccacgatcaccgcgaacttgatgccctgttcgggcgggatgtagttcgggtccacgttgccggtgccgagcaggtccgaggacgccgtgacctggcgcaggtacatctgcagggtccacttggagttgtcggagaggtagagcaggggcgacatgaagtcgttccagatgcccacggcgtagaacagggcgaatgtggccaggaccggtttggagaggggcagcaggatccgccacaggatgccgatctcggtggcgccgtccatcttggccgattcctcaagttcctgcgggagttcctggaagaagttcttgatgatgatcaggctgaacgggttgatggccgccggcaggatcagcgcccagtaggagttcagcaggcccaggtccttgaccagcaggaaggtggggatcatgccgccggagaacaccatggcaaagaccaccagggacaggatgacctgccgtccgcggagggtctttttggccagcgggtacgccatggtcacggtgaacgcgagctggaccagggtgccgacggcggtgacaaggatggtggtcaccagcgccctggtgaatgcgggggtggagaagatgtattcgtaggagcccagcgtgaactgttcgggccacacgaagaacgcgcgccgggtgatttcggcctcgttggcgaaggaccctgcgatcacgtagatgaacggcagcagcgtgatgatgccgatcagggacaggaacacgtagttcgcggcgtcgaagatccgcccgccggtggtgttgtgaatcttcattagaacagtccgctctggttgaagcgtttggccagggcgttggtgccaaagatcagcacgatgcccaccagggatttgaagagcccgacggcggtggagtagctgtaggcgccctgggtgatgcccacgaagtacacgtaggtgtcgaacacgtcggccacggaccggttcagggcattggtcatcaggtagatctgttcgaagcctgtgttgagcatctgcccgatggccaggatcagcatcacgatgatggtggaacggatgcccggcagggtgatgtgccagaccctgcggaaccggccggcgccgtcaatgatggcggcctcgtactggtcctggtccacggtggccagggcggcgaggaagatgatggtgccccagccggtgttcttccagatctcctgcagcacgatcagcggccggaaccagttcggatcggacaggaaatcaatgtcggtgcccatcacgttgttcaggaacaggaacagcgggccgaagtccagggcgaacagcaggaaactcagcgacgccacgatggtccaggacaggaagtgcggaatgtagacgagcgtctggaccgtgcgcttgaggatggaaagccggacctcgttcagcagcagcgccaggacgatggtcagcggaaaggcgatgcccaggttcaggaacgccaggattaaggtgttgccaagcagccgcgggaagtccgggttggagaagaagtcctggaagtgctgggttcccacccacgggctgccgttcacgcccaggaacgggacgtagtccttgaacgcgatggacacgccatacattggggcgtagcggaacaccgcgaagtacaccacccccggcgccagcagcaggtagagccacttgtagtgcgcgaaatggacggagaatttaccgcgggggacttttggcggcttgcgcggcttggagctcttgcccgcatccgtcccggggccctggccatggccgatgttcgaggccagcgcgtctgtcagctgtgacattcagggcctcctttctggaagtggtggtgggtcctgaaccggcgggctccacagcgaatgtgcggagcccgccggtgcgggcgggactgttacttgttgtcctgccagagctggttgatctcttccgtgaccttgtcgccgccgctggtgttccacagcttgatggcgtccttcagcccctgctcgtcaatctggccggcaaggtacttgatccgggcatcggccacgatgttgtccagctgggcacccttggagacgtaggtcgcggacacgtacggcgcagccgggttgtagacggcgctcttgaggtcctctgccatcacttccgtgcgcttgtcgaagacctgctgctcgtattccgtgggctgcttgaccgggtagaaagtgttgccgccaacgttcattccaagttgggcgtagctcttgatgtccgtagtgacggcctttgactcctcagtctcgggcttgatgctggcggccttgccgtcctccacggtgaagttcacgccctcgatcccgttgttgagcaggatggccacgtccttgctgttcatggtgttcaggacttccagcaccttcgccagctcggcctcggtgcggacgctggccttcggcacggcgaggaagcctgagtagccatcggtggggtgggcgtgcagttcgccgtcggggccttcgaggttgccgacgaagcccaccttgttctcgtagttgttgggatctgcctgcttgaacaggttgaccaggacgctgacgcgggagtcgacgtccacaatgattccgcccttgccgttgaagaacggttcattccacttggtgccgtcaaacgtggcgaagtccgggttgatgagcttttcgtccaccatcttcttgacgaaccggttggcctcgaggaactcttctgtttcgaagctggggatcagtttcccgtccttctcggtccagcggtttccggcgccgtaccattcctcgatgaggtcgtaggggctgttgctgcccagcgcgccccatttgggaatggtgatgccccaggtgtcgtcctggccgttgccgtcggggtcctgctcggtgaaggccttggccacctcgtacaggtcctcggtggtcttgggcgcctcgaggcccagcttgtccagccagtcctggcggaacatcacggcggcgcgcatcggggcgcggccgcggaacacgccgtacaccttgccgttgatgctggcgttttgctgaatgtccgggaagttggtcttcaggttcgggtagtcatcgagtttgtccgtcaggtcccagaacgcaccggcttccgcgttcttgacgaacccgggtgtctttccctggatcaccatgatgtgcgggatctcggaggaggcaagcgtgatgttggtcttgtcctcgtaagacgcgttgggggtccacgtgatgttgatgtccttgccggtgagctcctccagcttcttctggacggcaccgtcggcactgggcggctgggcctcgaggaacggcgccatgatggacaccgtgctgaggtccgctgccggggcttcgccgccgctgcaggcagtgagcgacatggccgtggccgttacgacggcggccgccagggagagttttctgcgcatcatggttttccttttccacttcttcggggttttgttggtcaaaactgttgatgggactggttgatacgtttcaagcacaagggagcaagcagcgggaaggccgacggcgcctcccggacttatgcgcgcccccggcctcacggcgtcaggcggccacggaggccgacgggagggcgcccttccccgccgggatgccggcaccggccgccgacgccccggccacggattcatcattggcggtgaagaaccggtcgcacagccagccggtcacatacagccaggcaccgatgctgaagaacgggatcaggcccgggacggtggtgctggcatagaacgcggcagcggaaatgaacagcaggatgaccgttccggcgagatgccggaaggcgaagcgggaagacgtcagcaggtactgccccagggggagctcgtacctcgcgtaaagggggaagaggtaacaggttgcgccggccaggaagatggccgccacaaaaatgcccgccgccatcagctgcgagaacaggtcccccgacgccgaaaagtagttccagttcatggacagcgcaactgccgccgccatcaccggcagggcgagcacattggcccggccgaagttccggaagtaattggccccgaagctgcggagcagcggcgccgcgtcaccccgtgcgcgcttccgcacggcgatctgggcggccgcagtggcagggcctgcgccgaggacgcccaggcccagcagtgcgaagaggatccacagcaggttcaggcaggcgatccacaggagggtgtcaaagaacgagtaggcccgggcactgaatgatccagacagcatggcgcagctcccttcatttctccatcgttgcagaggcgaaggcggaagtgtcccgcatcacgccggtaatcggtttctcgaaaatctagacgtacacgggcggcaaggtcaagcgaaattttgaatcgttacatagctggactctggagagtgccatgacgcacactgagggttggaaagcgcttgctgaagttcgcacgcgcccatgcaactgtgccctgcagggcggaaatggagaaccatggcaacgccaaccggcacccacagcccggacgcgcccgccgggtcaacaacagcaacggctggtcgcggcgctgccgccggaacgtcagcccacgccgtcggtgttgcggctgcccgcgtggctttgatcggcgtgcacggcttcggcacacaccacctccgcaaccttgaacgcctccaggcggcaggcgccgtcgagctagttgccgtggctgatccgcagccgccgtccgccggctccgttccggcctcggcccgggtatacccgggactcgacgaactgcggtccgcaaccacaggcctggacctggtcatcgtggcaacccccatccagacccacgccccgctggcgctcgctgctttgcgcaccggcgcggacctgtacctggagaagcccccggtggcgtccctgggcgatttcgaccggctctgtgacgccgcagccgagtcaggcaggagcgtgcagatcggcttccagagcctcggctcgcatgccctgcaggaaatcgaaaacctggtggcagccggcaccctcggcacgctcaagggcatttccgccacgggccgctgggtccgggaccgtgcctactacaagcgctcccggtgggctggaaagcgcagcatcaacggcgtggacgtggtggatggcgtggccaccaatcccctggcccatgcagtggcaacagcactgaggattgccggggcccggaccactgccgacgtggcgtccgtggagaccgagctgtaccgcgccaacgacatcgagtcggatgacacctcggtgatccgcatccgcacggcctcgggcctgcccatcacctgcgcgctgaccatctgcgcttccgaatccgtggaaccctacatcacgctgcagggctcagccggaaccgccgtgttccactacacggaggaccgcctcaccgtcaccacggcgtcgggcaccactgaggagacgtacggacgcgacgacctcacggagaacctcctggcccaccgcaattccggatccccgctgatcagcccccttctggacagcggtgccttcatgctggtcctggaagcggtccggaccgctccgctgcccgctgtcataggtgatgcccacgtccggtgggagggctacggggaagcagcgcacgccgtcgtggtagacattgaggcggcgctggaacgcgtgggccgcgagcacgccacgttcagcgagctgggcctgccgtgggcaacatcggccccttgcgccttcagcgtgccggcttcctgatgcgcccgcagcctgcaacgaccccggcacattccacaccaataaccaaagcgcggggccagctgcacgccgtcaacctgctgacggagggcctcgccgagtgcctgaccgcatcaccccggcccaccttcagctggcagctggcgcagccggacggctccgatccggcgcgggccctgcagaccggctacgaggtcacggtggaggactcgcaggggctcaagttctggagttccggtccggtcacctcccccgcgcagcgcggggtccaatatgacgggcctgcgctcgacggcgacacggactacgcgtggcgggtgcgggtccgcgacgcagcaggaatacccggggaatggtctactccgaagatgttcagcaccggactcacggatgcttcctggcaggccgactggatccggcgcgctcccggcggccgcgctcccctggaaatcctcaacaacgccctccgcgtggccggctcaccccacctgccggttccctgcccgcctgcccgcaccatccgcatcgaagcccgcgtccgcccggtcatggggtgggccgggctcatccttcgcagcagcggccccggcaccggcctgctgctggaactcaacacggccggcgaggtggtcctccgccacgccccggtgtgggaaattcccgccccggccgtccccgaaaccaccgtgctggccagggcccgggcggaccggaacctggatgtccgccaggcgcggctgcccggcaaggacctggtgcccggctcctggcaggacctggtggtcaccgacgacggccacaccatcaccgtctccctggacggcgtggaactgcttgacgtgcaccagcccgcagctgccgggtccgccgggaagccggccctgcaccagggaccccggagccaggccgagtatgcatcgctgcgcatcagcagcggcggccaggacagtgccggcgccgtcctgctggaccaccgcttcgacgccagcggggaccacgcccgcgcctgccttgcgcagtgggccgccaccacggcgcaccgccagccggatgaatggacagtattccgcagcattctgcagctcaccggcccggtgcgccgggcgcggcttttcgtggcggcccaccaccacgcgcagatctccctggccggtgtcccctgcctggcaactacctctttcggatatccgggcgaaggttactacgacgccgcggacgtcaccggcctgctcgctgcccagcctccgggcgcagccgttcccctgacggccctgctgcactggtacggccccgggcagggccgcgccgccggacttcccggccttctggtgcgcgtcagcgtgcagtacacggacggccgccgcgaagccttctgttccgggccggagtggtcagccggcgaggcgccgtaccggcagtccggctaccgcaatgacgagggcgaccccgtagaacacctggacgggcaggccgcacgggccctggccgccgtgccgtcctccccgtccccttcttccccggacctgccgcccgccatcagccgcggccgccacccctcagcggagttccccacactgcacgcgcgccggaccttcctggccggcgggtttgttgctcccagggctttcctgacggccgacgacggcaccatggtggctgacttcggccaggtccttcccgggcgcccggaggtggacttcctggacggaattcccggccgcaccgtgatgatgcgggccggctacgcccttcggcccgacggccgggtggacgccggaaagaccgcaagccagaacacggacatgtccttcccctacacccaggcggccgggccccagcagttcagcgccacggtgcacctcggtttccgctaccttgagcttcccggcgtggaggccgccgaggtgtcccgcgtcggggccgtgctggtccacgggcaccacccggctgagggacgtttcagcagctcggatcccatgctggatgccgtcttcacgctgctgcgccattcagccctgtacggggtccaggaacagttcgtggacacccccacccgggagaagggccagttcctggcggacgcggtgaacatttcgtacgccaccatggccctcttcggtgagcacgcctacacggcgcaggcgctgcgggagttcgcctggtccgctgcccgctactggtccgaggggcaggaccgcggccgctacaacgccgtgtaccccaacggtgacggcaagcgcgacatcccggacttctccctcatgattccggagtgggccgaggagtaccacctgcgcaccggggaccttggcctggtccgggaactgctgcctcacctccgcaacaccgccgactacgcgttgcggtatatcccggcggaagggccgacggcgggtctggtcacccggctgggcggcggctccggcccctaccttcacggcatcgtggactggcccgaacccggccggttcggctacgacatggagtgcgccgcgaagaccaccgtcaatgcccaggcctattcggcgctggtgtccacggcccggctctgcagccttgccggggagcatgatgccgccgtccgctacgcctcttctgcccggcggctggcggacgcaatccgcacccgccttcgcgtggacggggtgatggtggacggcctgcgtgccgacggcattcccagctcccacgcctcccaacacgccacgtccttcccgctctccctgggcatcaccgctccggaattcgccgccgacgatgcgctgcggatcgcttcgatgggaatgaagcaggggccactgaccgtccaccggttggtgcgcgcgctgatttcccaggggtggacggacgccgtgctggacctcctgacaaacaaggaccaacccggctgggccaacctgctggagcgcggcgccaccttcacctgggaggcctgggacctggtggagggaacggactacagccagtcccacgcctggtccgcgtccgtggtcaaggaggtcttggaccacctgctcggcgtccggttcagctcccccggaggctcggagctgctgatcgagcctccgctgtgccggctggaccacgcccgcggcgcggtgcccgtcagcaacggctacgtggaagccagctgggcccgggagggcagccaggtccggctggagtgcacggttcctcccggcactacggcagttgtccggctgcccgccggcaagtacacggtcgcctccgggcatgaaagaacgacggcggaggccgccgtcgttcctatccccggggaaggcggggctgccgccgccgcgaatgtcccggccggcagcggcgccaaggtggacttccgcatccaccccggcgcctggtccttcagtcccgtcaactgattccagtcgcctaatcccaactaggtagcgctaaatgtcgttttgaaccgctaaaacgacacttgttgctacctggtttgggctgagggtcagaggagcgcgctctgcgcctcgtccatcgccttctttgccgcgtcctgcggtgacaggcggctgaagtggacctccagcgagtagcgggtcagcgcttccacggcggcgctgcctcctgccgggggcaccggcgcggcctcgcccagttcgctggagatttcgtcaatgaactttgctgtcttggcgtcggcgggggtcagcattgaggccaccgccgcacggatttccgagttcgccgggatgccgcggtctgccaggccgatctcgccggcggtggcgttatttgtgacgaagtcgatgaacttctgcgcttccgcggggtgcttggtccgggagctggcggaccagaacatggatgatttgtagaactgctgggcatcagccgccttcccgtcgaggctcggcggacggcggatctccaggtcctggccggaggccttgctcagtgcccccaactggttggaccagtacatattcatggcgaacttacctgtggacagaccctgttggtcgatcgaggcggtggcgtcctccgtaatgaccgacgcgggcggcaccgccttggagtcgcgcatctttgcctggtatccgtaccactcggccaggtctgattcatcgaaaccgagcttcccgtcggtggtgaacaaggacttgccgtgctgccggaaccacaggttggcggcagcgtcagagttgacctggccggtcccgaagaccttctcgccgctggccttggtgatttccgccgccgtgctgtccaggtcatcccaggtccaggtcttgtcatcgggaagagccacaccgctggcagatacaagcgctgggttggccatcaccaccatggcgttcacgccgctggtcacggcgtactgcttgccgtccactttgccggagtccgccacgggctggtcgaactttgacaggtcaacatccttcagctcgagcagggcgccccgctcggaatactcgcccaggtaggcggcgtccatctggatgatgtccggggcatcctgcgaggccacctgggtggcgagtttgtcccagtagccggaccagtcgccgtactccccctcgacgttaatgttggggttctccgcctcgaaggcttcaatcagcttctccgtcatcttgtgccgcacgtcggagccccaccagctgaaccgcagggtcaccggcccgtctgactcggcttccggcgagccgccgcagccggtgaggaccagggagagggcggccgctgcggcggcagctttgggcagcagggatttttgggcgcgaaacatcattgtttgtcctttggcgcgggttgctggaacctgaaagaaaccggtttcccacagcctaggtgcgagctggcgcacgcgtcaaggcttcaggggactccattgccgggaggcagagctgcccctgggatggcgtgcagtcaggcccgcctggcatccgtcctgcgcccgtggcgccacagcaacagcccaataacaagggctgaaagcatgcccagcccgccggtggccaccagtccggtacgcactccgaactgctccgtgagccagccggccaggaggcctcccagcgcgtgcccgcccagcaggaggggaaggtagagggccatgacgcggccgcggatctccgggccggcttcgagctggacggcggtggccgcgctggtgaggaacaggagggtcatgagccccaccaccaccagcatcacgatgaacagggtgaggctgggcatcagggccgccaccagctgggacagtccgaagagccctgcagctgccacgatgcctttccggcccaggctccgcagcctggcggccagcagcgctccggccagggccccgatggcgctgacggcgttgaacaggccgaagccttcaacgccgttatgccacacccgttcggcaaaggcggccagcaccacggggccgttcatgccgaacattcccaggagcccggccagggcgatgaccagcagcagcgacggccgttcccggacgtaccggaacccggccaggagctggccgcgcccgggcgccgcccgggcgctgggatgcagttcggcggggcggatggcggcgatcagcaagaggaccagcaggcacagcgcggagttggcagcgaacgctgcggccgatcccgcctgggcaatgaccacaccgcccacggcagggcctgccatcgctccaagctggccgatggcgttgttgaggccgatggccggccggaggtgggcgtcgcccaccacttcattgacgaagacctggctggccggctggttgatggccgacgtgacacccagcgccacacagctggcatagacggcccagacggtgatggttccgctcgcggcccatgcggccaggcccagcgcaaggacggcgatgacggcctggcagcacagcatgatccggcgtttgggaaacatgtccaccagcaggccgctcaaaggtcccaccaccagcatcggaaggaactgcagggctacggccactcccacggcagcgggactgccggtcagctgcagcacaagccagtcctgcgcgagccgctgcatccacacgcccacgctgccggtgaacaccagggccaggaagaggcggtagttgcgttgcgtcaggggctggtaccaggctggctggtttgtacgggtgtggagggactgactggaacgctggcggtggaaaggcacgtgcttcaggcgcgggtggaacgcagtttgacggccgcagcgcccaggatcagagtgccgggaaccaccacgaagagggcagccagcatccagacgaacaccacggctccgaagagcgcggcagcgagcaggagggacccgctccagtccttgagggacagcgcctggccagcctcgaacgctgaacgccaggcggtccgggcatccgtgggggcgccggcaaattcggaccacgctgcggcagtgcgcaggagcaggattgccccggcggccgcgaggaccagggtggccggcaggaccacttcccggcccgggagctgccccacccaagcgagcaaaaggttaaggacaatcacgacggcggctgccgccgtcgtgattccaagcttccagctgcctggcagggcagccttgaaggtgccccagaggccccggacggaatcgtcccggcccgagaggtggcgctccagatgggcgatccccgccgcataggcggcggggatcgtcaccagcggaagggacagcaccagcaccagcacccctgccagcagggtctcggagaacagcgcgaagcggttgaccgggacgggttcgtggtggctgggggcgggggtggtgctgtccatgacgctcattttctgtctcgtttttccgtcagcccttgaggccctgggtggagacgccttcaacaatgtaccgctggaacaccaggaagaagatcagcaccggcagcagggccaggacggacatggcgatcatggcaccgtagtccgaggactgggtctggtctacaaagaggcgcagggccagcggcagagggtacttgtccggggtgttcaggtagagcagcgggcccaggaagtcgttccagctccagatgaaggagaagatcgacgtcgaaatcagggccggtttcatcagcggcagcatgatggaggtgaagatccggacgtggcctgcgccgtcgatccttgctgcttcgtccagttcggccgggaggttgcgcatgaactggaccatgaggaacacgaagaacgcgtcggcggcgaggaacttgccgatcagcagcggcacgtaggtgtccaccaggccaagctgctggaacacgatgtactgcgggatgatcaccacgtggaagggcaggagcagcgtggcgatcatcatgccgaagaagatgctgcggccggggaacttgatcctggcgaacgcgtacgctgacacggacgccgagaggatggttcccaccacggcgccgatggccaggatgagcgagttggtgaagaactgcagggtggacaccccgccgatgccgtccatggccgtgacgaagttgtcgaagctgaagttgttggaccacagcgaggtgttggagccgccgatttcggagttgggcttgaaggccgaggcgatcatccacaggcccgggtacaggaccaccgccgtgagggcgagggccaccaggtggaagacggtgcttttgacgcgcttggtcccggccgattcggacttggggttgtagtgcgccagttctgcgtccgggagggactgcgtgggggttgccgtgcttgtcattttgcatcaccgctgtagtggacccaggacttggaggtcttgaagaagatcagcgtgatgatgcccacgacgatcaccaggagccaggccattgccgaggcatagcccatccggaagtcgctgaaaccacgcaggtacaggtaaagggtatagaaaagggtggagccggcggggccgccttcaccgttggagatgatgtacgccgaggcgaagatctggaacgcgtggatggtttccatcagcaggttgaagaagatcaccggggagagcatgggccaggtgatgttgaggaacttccgcaccgggccggcaccgtccatggacgcggcttcgtagaggtccgccgggatctgcttcaggccggcgaggaagatcaccatcggggcgccgaactgccacacggtcagcaggatgaacatgggcatggtcatggccgggttgcccacccagccgcccaggttgatcccgaagaacgacaggccctggtccaccgggccggcgtcgccgaacatggctttccagacgatcgcgatggagactgacgcgccgatcagggacggggcgtagaacgcggagcggtagaagccctggccgcggcgcttgctgttcagcagcatggccactgccagtgcggccgcgagcttgagcggggtaccgaagaccacgtaggacacggtcacgcccaccgactgcaggaagcgttcgtcctggaagagggtggtgtagttgtccaggccgatccacttgggcggctcgaacaggttgtaattggtgaaggagaggtagagcgaggaaatcatgggcccaacagtgagggcgatgaatcccagcagccagggcagcaggaaggtgtagccggcgcgggcatccgccccgcgctgccgcgacttgcgcggctgcgagggggcggacgacgacgagcgcctgctcagtgttgggctttgagtcacgagttcaatccgtcagtcatgaaagctttagcaggcacggtgcctgatcaggcgttctgcttgatgaggtcttcggcttccttgaaccacgcgtcggcggcgccgtcgatggtgagcttgccgtagttgaggtcggaggcaacgcgcttgaaggaagcctcaagcgtgccgaaaccgacgatgggcggctccggggcgtccttgaggtactgctcgatggacttctcgtaatccaccacgagcttgtccgtaccttcgaaggtggtcccgtcgcgctgcgtcttcgacgccgggacaccgcgggaggtcttgaagatctgtcccacctcggggtcgttgaccatgaagtcgataaagcgggcagcggcgtccttgtacttggtcttggcgctggccaccatcagcatcgagggcttcaggaacaggcccaggttgtccgggtcatccgacgggaccggcgcaagcttaagttccttcgcgccactgtccgcaaggtagccggccatgaagttgtcccaggtgacctcagtggcagtgacattggagccgaacggggacttgggggcgagctgggtgacgcgctcctcggagacgatggccggggtgccgcggagggcagcggtctggttccaccacttcttcatatcgtccttggtgaagccgagcttgccgtcctcggtgaaggcctcgatgttgttctggcgcagccagatgttgaacatccaccacacaccggtgtaatccgtaccgccgaagatctcaccgttgctcttggcgccaacctcggacaggaactcgttgaattccttgtaggtccatgaaccgtccggctcagcgatgcccagggaagcgagcttggcggggtcgtagtacacggcgaacgcgttggtgctggtggggatgccgtacgtcttgcctttgatctggcctgacggcagcagggacttctcgaacgcgtccgtgttgatgttcacagtgcccaggtccaggagctggttgcgctggccgtagtcacgcaggtaggacaggtcccactgcatcacgtccggcagtccgccgccggcggcctcggtggcgcgcttctgccagtagccggcgaagtccgtgaagttgccgttgactttgatgtccgggttcttctcttcgaacagcgcgatcgccttacgggtgcgctctgcgcggtcgtcgttgccccaccaggtgtagttgatggtgaccgggttctccgcggagcccgtctctccagcgctggtgctggatcccgttccacacgcggccaaagctgcggcagatgcggtgccgacggccacggtggtgaggaaatgccttctgttaatcatgggagcctccttgctcaatgtgtgcaacccctgatttcatctacaacgaaagtagtgagctggcttacacggcttctgaaacgatacaatatcttcattccctgaaatgggcaagcgttttccaagcaaccggtttcccaccgagcgcccgtcaaccccgcagacaaaggagtcccatgacccaccaggcaatcccaggcccggccagcgtttggaacaacatcgagggcatcagtttcggtggcgactacaacccggagcagtggccggtcagcgtgaggctggaggacctggagctgatgcaggaagccggcgtgaacttcctcagcgtcggcatcttctcctgggcactgctggagcctgctgagggccagtacgatttcggctggctcgacgacgtgatggacaacctgcacggcatcggcgtcaaggttgcgctggccgccgccaccgccgctcccccggcgtggctggtgcgcaagcatccggaaattttgccggtcagggctgacggaaccacgctgggaccggggtcacggcggcactacacgccgtcgtcggccgtgtaccggaagtacgccgccggtatcacacgcgtgctggcggaacggtacaaggaccaccctgccctggcgctgtggcatgtggacaacgaactgggctgccacgtttcggagttctacggcgaggaagacgccgccgcgttccgcctgtggctcgagcggcggtacggaaccattggtgcgctcaacgccgcctggggcacagccttctggtcgcagcactacggctcctttgatgagatccttcctcccggcgtcgcaccctccacgctgaaccccggccagcagctggacttccagcgcttcaactcctgggccctgatggactactaccgcggcctggttgcggtcctccgggaagtcacccccgcagtcccctgcaccaccaacctgatggcctccagcgccaccaagtccatggactacttcagctgggccaaggatttggacgtcatcgccaacgaccactaccttgtggcggcagatcctgaacggcacatcgaactcgcgttcagcgcggacctcacccgaggcatcgcgggaggtgacccgtggatcctgatggagcattcgacgtcggccgtcaactggcagccgcgcaaccagcccaagatgcccggcgaaatgctgaggaactcgctggcgcacgtggcacgcggcgcggacgcggtgatgttcttccagtggcggcagagctttgcgggctcggagaagttccactcggccatggttccgcacggcggccgggacacccgcgtatggcgcgaggtggtggacttgggagctgcactccagctgctggcaccggtccgcgggtcgcgggtggagtcgcgcgcggccatcgtgttcgactacgaggcctggtgggccagcgaaattgattccaagccgagcatcgacgtgcggtacctggacctgctgcgggccttccaccgctcactgttcctgcggggcgtctccgtggacatggtgcacccgtcggcatcactggacggctacgatctggtcctcgtgtgcacgctgtactcggtggcggatgaggccgctgccaacattgccgctgccgcttccggcggcgcgacagtcctggtcagctacttcagcgggattactgatgagaaggaccacgtgcggctgggcgggtacccgggggcattccgggaacttttgggcgtacgcgttgaggaattccacccgctgctggccggatcgcagttgaagctgagcgacggctcggtgtcctccatctggagcgagcatgtgcaccttgacggcgcggaggccatccaggcgttcacggggtacccgctggagggcgttccctccctgacccggcgggccgtagggaccggcgccgcgtggtacctggcgacgttccccgaccgtgacggcatcgagtccctggtggaccggctgctggaggaatcaggggtctcccctgtcgctggcgcagatgcgggagtggaactgacccgccggcgctcggccgatggcggcagcttcctgttcgccatcaaccacacccgggctgcggcaaccgtgcgggcatccggcacggacatgctctccggcgaacggttcacgggcacggttgaagctggcagcgttgcggtgatcgcggaggactgaccgcgttcttgcgttttgctgccaccgggcgtgggtgggccccggagaacacaaaatggagttttccggggccgtgcagtccgcaggtccgggaggatgctacggattttcatgtggcgtccgggcaggggctgtcccctacctcactgcagcgtcactaacccgtgatctcgatggccggctcggtgaaccccgcgaaggtcagcgtatagatgtaactgatggccacgccagagacaacgggagtccagttcgggttcgggcaagagaaatcggccaggaattcctccgagctctctccggtttcggactgcgccgggacgttcagcctgccgttcttcgttgatgtgaccacctcgctggttgtattcgtgtcggattccgtgaacgggtcgacgaccttgtccttagaacccgggttttggcactcgcccgtgaacgtgctggtgacagccagggtcactgtcgcgttcgtgttcccgacgcccgcgatctccgtgccagtgcaggttacggtgaggccgctgacgttacagtcgggttcgccagaattcttggtgtagtgggctccctggggagcgttatcgaaatttgtgaccgccagtgccgcggtcatgcccgttgcgagggcgatcagcattgccgcgaacagggcgaggacgcggcggattgatggcttcattttcttactttctgcagatgccaaggccagatgcctgaggcagcaacaacaggaattcgcggatccggctttcaccggtccttgtgagctttggaagccctctcgagtcccccaaagccatccggccgcagcacccagattgggctgcgcctttcacattgagcgagcaaccggcagctccgttggctgtgctgtcctcgccactcaagagatgagggccgtatccggctacttgttctgactgatattgggtttctttcagtgcaaacgctgcaaatgtgaatccaccgattcccagttaatggcggtgtgcataccatcgatggcaggcgacgctgaggccagttcacacctcccagcggcacaattttacgcctgtcagggactccatataatgcagcagcgctaaagaggggagggccaacttactggagtggggcattaggtaggtgtgcattggccagcggtgtggtgggggcgcggttcttgacctcttttccgtaaccgggtgcccgggccccggtttcacctcgattctgcttactttttggattgcaaacctggactgcaagccgagcgaacgcggatcatgtttccagcccagtgcagcgctgccaaggttttccacataggggatgtggggcgcgttattgtcggtggtctttggcagagttgggttatggcagttggtgggcttttggaaacggggcaggcagggcgccggcctgatttgtctgtgacttggcccttgcctgctaccgccacgcaccttgtctccgttacgccgccggttcctggtgtcctgtccgttgctgatatccgggcgagccttgctgccgtccctgtgtgtgctgacggtccggggatgattgatcagttgcgggatttggaggatttgaagtcgctggtggctgcgaagcaggcccggattgctgtggctttcgacgctgaacagcggcgggagcaggccgcggccggtatcccggccaaggaacgcggcgccggtgtggccgcgcaggtggcgttggcgcgccgggagtccccggcccgcggcggccggctcctgggcctggccaaagccctcggcaccgagatgccccacgccctggcagccctggagtccgggcagctgaacgaatggcgcgccaccctcatcgtgaaggaaacagcgtgcctgtccgccgaagaccggtgcgcggtggacgaggaactcgccgccgacaccggcaccctagcaggcgcaggttcactggcaggcgccggggatcgggccattattgccgcggtccgtgcggccgcgtaccggcgtgacccgcactccgtggccaggcgcgccgcccatgcggtgtgtgagcggaccgtgacccttcgcccggcgccggacaccatggcccgtctgaccgccctgctcccggtcgcgcagggcgtcgccgcctacgccgccctgacccgccacgcagacaccgcgagatcacacggtgatgaccgttccaggggcgcgctcatggcggaccagctcgtcgaaaacatcacgggcaccccgggaggggccagcagcatcgaagtccagctcgtcatgaccgaccgcaccctcttccagggcgacagcgaaccagcaagactcgcaggctacggcaccgtccccgcccactgggccagacaagccgttttggggcagccggaacgccccgatccaggacctgcggatagcgccatgacagtatcggcgggaggtatagcaggaggttcggtggccgtgaggacccctgatacaggagcggcccgcaccggcgctcctgccacggaagtcagggacagcactgacttcgaggtctggctccgcaggctctacacagcgccgggcaccggcgaactcctcgccatggactccaaagcccggctcttccccgccgggctccgccgcttcctccaggtacgggacgacacctgccgcaccccctactgtgacgcgcccatccgccaccacgaccacatcaccccctggcaccaggacggccccaccaccagcaccaacggccaaggcctctgcgaagcctgcaaccacaccaaagaaaacccaggctggacagcccgtcccgtccccggaccacgacacacggtgcaactccaaacccccaccggccacacctaccactccacagcacccccaccacccggcaccgcacttgatgcaggtgaattgggcgcaccagccgctattgctgctgccgtcgctacgggcccgccgctttatgtagcttcccccgccaacgcgggcccgtcccgcggcgaccccgaacccaccatgcgcggaccagcagagtgccccagcccagggaaacacggcgtccaaatcctcggccgcgttgttgttgctcacccacccctggttgtaccgcaccggcccctgatggtccggcccctggccgcagcagctgcaccgccctagtcctgccgccgcagctttacccccccagccttaaacagctccgtcccggaaggaacccgaggttcctaccgggacggagctgccacccgccgtcggacgctgggagtggaggaggcgtccacccaagctgtccggagccgtgttggcggtgtgaggactaactgctgattgccgacttcatctcgtcgtgggccttcttgcctgcttcgtccgtggagagccgctcgaagagaacctcggaggtgtaccgcttgatgatttcctggattgcgccggcgcccttcggcggcggagcgggtgcctcaccgagttcgtccttgatctggtcgatgaacttgaccaccttgacgtcggccggggtcagcttcgactcgatggctgcgcggacctctgagttcgggtatacaccgcggtctgccaggagggcctcgcctgccttgacgttgttggccaggaagtcgatgaacttggcggtctcctcagggtgctttgtgcgtgaggaggcggaccagaactgcgaagccttgtaccaaagctctgcatcagcggaggacccggtcttcgtggggaaccgcaggatcttcaggtcactgccggaagccttttccaaggccggggcctggttggaccaccagaaggccatggcattcttgccggtggcaagtccactctggtccagcggggcagcctcggcttcaaccacctcggaggccgtggggactgccttgttctcgctgagctgcttcaggaacgcccaccattcggagatgtcactgggctcaaagcccaggttgccgtcggaggtgtacagcgacttgccgttctggcggagccagacacccagggatgcctcgtccgtgccgtaggcggcggcaccataagtgcccttcggggacttggccgtgacatcggaagcgatcttctcgaagtcctcccaggtccacgtggagtcgtccggcatcgcaacacctgcggcctcaaacactgcggggttagccaggatggtggctgcgttgatgccggctgcgatgcctgtcaggccgtcctcgctcttgcctgcgttcagtgcggcttcatcgagcttggaggtgtcgatctcatacttggacaggtcaagcagggcaccccggcttgagtattcagtaatgtacttttcgtccatctggatgatgtccggggcgtcgttggcggcaacctgggtggccagcttgtcccagtaaccgctccagtcgccgaactccggcttgatcttgatgttcgggttctcagcctcgaactgcttgatggcttcctgggtcagctgggcgcgcttgtcgccgccccaccaggagaaccgcaattcaacggggccatcggcgttttgcggggaggatcccccgccgcatgcactgagggccataacgacggcggccgcggccgcaacgacgcccgtcttgcggatgcggcgtgctgcgccgggggaaggcgactgcgccggttgccgggcagcagacgcagggcgggaaaagagctgcactggtaactccgatcttctttgatctaaatgcgggggactaatgcactgacagggatgaaacgcgaaagcgctttctagatgcaatagtacaagtacgctacttgtattacaagatgtagggccaaggcattctggacggcacctctcgggtggcgtgctcgaggacggctgcttcaggacggccggacggcccgccacgaggacgggccgttcggttggtgctgcaggcctgctggccggcagcgctaaagtccggggagctggatctacttgatgccggtggtcgcgattcccttgatgaggaagcgctggccgaaaaggaagacgaggaagacgggcagcagcgagacgatggacatcgcgaacagcgatccccagctcgtggctgactgcgagtcgacgaaggccctcagcgccaccggaacggtgaacatgtccgggtccgtcaggtagatcagggcgccgaagaagtcgttccaggtccagatgaacgtgaagatggtggtggtggccagggccggtaccatcagcggcaggatgacctgcaggaagatacgcgggtggcctgcgccgtcgatcctcgcagcttcatcaagttcccgcggaatgccgcggatgaactgcaccatcaggaagacgaagaacgcttcggtggccagcagcttgggcacgatcagcggccagaaggtgttcacccagccgatctgcgagaacagaatgtactgcggaacgatcaccacgtggaacggcagcatgatggtcagcagcatgatgccgaacagcagctttttggcagtgaactgcagccgggcgaaggcgtaggccgccatggagcacgagatcaggttgcccaggatagagccgatgaccacaatcgccgagttgatcatgtagtggccgaaggggtgggtcagggcagaccagccggaggtgtagttgctcatctccaggctgttgagccagagcccgggttcgcggaagatcagttcgttggggcgaagcgaggaaacaaccatccagagcagcgggtagatcatcaggccgccggcaaggatcaggatgccgtgcttcatcagggattttccgcgctgggcccggctgaacgccagggtgccgcgggactcgcggggcttgcggtggttcgtaggcttgccggcgcctccggacttcttgtccggggtgggcagcgtctccagcttagtcgtcatagaaaacccaatacttagaagcgatgaagttgatggcagtgaagacgccgatgatcaccagcaggacccacgccatggctgacgcgtagcccatgtcgaactggccgaaacccttttggtagaggtacagcgtgaagaacatcgtggagtccgaggggccgccgttgccgcccgagacgatgaacgcctgggtgaacgactggaaggatccgatgatctgcaggaccaggttgaagaagatgatcgggctcagcatcggcagggtgatccgccagaactgctggagggtggtggcgccgtcaacccttgctgcctcgtaatacatgtgcgggatctgccggaggccggccaggaagatgatcatgggggcgccgaaggtccagacgtggagcaggatgatggagccgagcgccgtgctggggtctgaaatccatcccgggccctggatgccgaacattgccaggacctggttcaccaggcccgtggtgccgaagatctgcttccagaggatggcgactgccaccgaaccgcccaggagggacggcaggtagaacactgagcggtagaacggcaggcctcgcaggcccttgtccaggaccagtgcgatcaggagcgccacggcgagctggagcggcacaccgacgaacacgtaggtgaaggtcacgccgagcgagttgtgcaggcgtgcgtcactgagcatccgggtgaagttctccaggcccacccattccggcggctggagcaggttgtagtccgtgaaggacaggtacagggacatgatcatggggccgatggtgatggcgacgaggcccaccagccacggcagcaggaagatatacgctgccttgttgtcccggccgttggccttcttctcggcggcggtggctttgcccttgcgccgggttatggagctgagttcgctgatggcgctcactgttgccgtcccgttcgtgtcatcaggcccgctgctgccggcattccagccgggcgcagcgccctgggtatgtgcttagcggccatgtggtctcctttggtcatcgtggcctccacgttcttggtatcgcctgggcgataggtacgctcccgcggccggcggggctggccgccggagtctcggcgggttcccaccagtgcgggaggtgcgattgaaaaagcggctccgtaccaaagtaaacggtttcttgactcctgtatagccctttgttagtttttgagaaaacgctttctgttatacaggtcactacgaatagaaccacaacacctaaggggcaggacaatgcggttacgtctcaggaaatcagtcatgggggttgcgggagcaacagctgccctcgccatggtacttacgggttgcggcagcaacgcggaggccgggaaagtcgggacggttgaggatcccgtcaccatccgttttgcctggtggggcaacgattcccgcgccaagacaaccctcgatgtcatcaaggatttcgaggccgcgaaccccaccatcaaggtggagggcgagaacacggagttcagttcctactgggacaagatggccacccagattgccggcggcacaactccggacgtcttcgccatgagcggtgcctaccccagcgaatacgccagccggggcgtactgctggacctggatgaggttaaggaccagctcgatacctccaagttcgccgaaggcacggtggacctgggcaagatcgacggcaagcagtacaccatcaccgcaggcgtgaactccatgtccatggtgatcgatcccaaggttttcgaagcagcaggcgttgagctgccggacgacgaaacctggacctgggacgattacgcgcagatagctgccggcatcaccaagaactccccggcggggaccttcggcaccacccccatgtccaacgactccttcctggcagtgtgggcacgccagagcggcgaggagctctacaccgatgacggcaagaagctgggcatcagcgaggaaaccgccaccgaatggttcgagctcaacaagaagctcatggacaccggcggtgccccgtcagcgtcgcagaccgtggaggacggctctgcccagcccgaaatgacgctcatgggccagggcaagcagggcatgaagatctcctggagcaaccagatgaactcctactccggctcaccgctggtcatgatgaagatgccgggcgaaagcaaaacgcccggcgcgtggctgcgctcctccatggagtacgccatttcctccaagtccgcgcaccccaaggaagccgccctcttcatcaactacctggtgaacaacgtggacgctgccaccaagatcaagagtgatcgcggcatgcctgccaacaccgagctcaaggctgccatcactccgctcctgaaggaatcccagcagaaggaagcggagtacctggaccgcatcgcggagatggacatcgagccgccgctgccgttccctgcaggttcctcggccaccatggaggtcctgaaccggttcaacacggatgtcctgttcggcaagatctcaccacgggatgcggccaagggcttcatccaggaagtcaactcgaacctgggctgaccgccggctggttcagccatcacaacaacatcccgaacaggaggcaggccagtgactgaaaacaccgggcccgtcaggcccagcgccatcgccggctacgaggactggcctgcctacgtccagcaccacccccgccaccaggccgccacgccggcggcacaggaactcgcggacgcgctcggcgttccggaagttccagcgcagcctgaagtgtcggttcactgggaggaaacgcacgacggcgtcaccacctcccagctcagctggcagttgggcttcggcccccggactaccggctggctgatccggccggccggcagttccgggccgctgcccggcgtcctcgcgctgcactgccacggcggcaacaaattcggcggggcggaccggctggtggaactcccggagcagcacccgtcggcggaggccgcccaggcaggccactacgacggccacgccattgccacggacgtggcacggcggggtttcgccgtcctggctcatgacgcctttggctggggcagccgccgcttcgatctctccgccccgccgtggcggacggcctcggcactggaggcgaggcaggcacagtggcgggaggacggcgtcgtgccttccgacgccgacatgtacaacgccgccgcaggtttccacgaagagaccgcggccaagaccgccggcctgctgggcaccagcctcgccggcatggttgcccacgatgacctggccgccctggaggtcctcgccgggctgccggacgtggaccaggaccggctgggctgcatcgggttctccggcggcggcggccgttcgctggccctcgcggcgctgagtccccgcatcaaaagctacgtcgtgacctgcatgatgaccaccttccagtcgcttctgcccgcctacctggacgcccactcgtggctgctgcagacccccggcctgtggaagctgggtgactggccggagctcacggcaaggtccggcgctgaaaggctgctggtgcagtacgccctggcggaccagctcttcccccaagccgggatgcgtgacgcccaccgggtactggaatcacttcatgcccccggtacctacaccgggagcttctggccgggcgggcacgtgttcaccgccggcatgcaacaggaagcgctcggtttcctgtccgcctcgctcggcgccaatgattcccaaacccttcccctcagctaccaaggacccgcctgatgattgatcaatccgctaccgcggaacgcgaaagccactccgggggaggcgccgtcccgccagccgtcccgcgcatcgccctggtgggcgtgcacggcttcggtgaacggcaccttgccaacctcgccaggctcgaagcagccggcaccctggaactcgtcgccgtcgcggatcccaatcccccggctccgggacgcctggcggagtccgtagccgtcttcggcgaccttgcccagctgctggcagcggacccgggcgtcgaggtcgtcatcctcgccacgcccatccaaacgcacgcccccctggccctcgcggcgctggctgcgggcaaggacgtgtacgtggagaaaccgccggtggcctcgctcggccagttgcgggaggtcctcgccgctgccgacgccgcaggacggctggtccaggtgggattccaaagcctggggtcgcacgcgatgcctgctatccggacgctcgtggaatccggcgacatcggccatgtcctggggctgagcgccaccgggcagtgggtgcggaacagggcctactttaagcgctcacgctgggccgggaagcgcagcctggatggcatcgacgtggtggacggcgtggcaaccaacgcccttgcccatgcggtggccacgggcctccacctggccggcgcccacacaatgtccgacgtcgaatcagtggagactgacctgtaccgggcccacgacaacgaaagtgacgacacctccatcatccgggtccgcaccaccggtggctccacgctgctgtgcgggctgacgctgtgcgcgccggaacagcagcggccttccgtaacggtgcacggcacccgcggcgagatcacgctcttctacaccgaggacgaggtggtcattagcacccccgacggcgagcgccgggagacttttggccggaccgacctgctggagaacctgctggacgcccgctccaatggggcgccgctgctgtgcgccctgccggacaccggcgccttcaccacggtgctggaagctatccggacagcgcccgcgccgcaacccatcgaccccggccacatcacgtgggagggtgaaggcgacgacgcccatcccgtggtccaggacatcgcggccgtgatcgcaagggcagtcaaagcccaggccaccttcgctgaactgggagtcgcgtgggcccggaaactgccgccagtccgcaccctcaccctggacggcaaggctgttgcggagtaccaggacggcagccggatccgtgcagtgtcctcgccgcggccctacctgcaccccgttcggaccctcgcaggcaccgtggtgacggaccaccagccgctggaccacgtgtggcacctcggggccggcgtggccctgcaggacgtggacggcatcaacttctggggcggccgcacctacacgcgcgaagccggccagtatgtctggcggccggaccacggcagcatcgcgcccacggatacccagtttgaagacacggctgcgcagacgggcggcgcggcgggccggctgcaggagaccctgagctggaacgggccggacggcgcggcggtccttcgcgaggaccgcacctgggagtggtccggcgtcggctcctccgcctggcgcctgtccctggactttgccctctcccccgccggcgacaggcaggtcagcctgggcagccccggttccaacggccggtttgagggcggctacggcgggttcttctggcgcctgcccgcctgtgcggacgccaccgtgtggacgccgtctggtgccggcgaaccagaggtacacggttcagtaaccccgtggctggcctgggcaggaacgttcgacggcggcagcgccacccttgtgttcgtggctgcggaggggtccgccgatccctggttcatccgggtggacggctacccgggagtgggccagtcactggcctgggacagcccggtcatcgccgaaccgggcgctccggtgcagcgcagcatcaccgtttttgtggccgacggcatcctgggcacaaccgacatcgaagcactcatcaaccagcaggggaaccattcatgacccagacaacagccgacgcctcgttgcttgcgggcagggcggctcccgcctccgcggaggaccgtgccgtcaaacgccagcgggtgctggacatccttgacgcaaagggccaggattccctgctgctgaccaccaacaccgccctgacgtggtacctggacggcagccgggtgcacatcagcctggccggtgatcccatcgcagctgtcctggtggaccgcgggggcgaccaccttgtcacgttcaacaacgaggcgggacgtatcgccgccgaggaactgccctcgggcgtcaccctgcattccgtgccttggtacggcaacctgcatgaggccgccgccgccgtcggactcagggggagcaacgccgtgccggtggcagaagcggacgttgccgccgagctgcgcgcggcccgccagcaactgctcccgaacgagagcacacgctacgcccacctcggcgccgaggttgcagccctgatgacggacgtgctgtccaccgcccggccggaaaccaccgagttcgagctggtatccgccctggctgggcgggtggttgcagccggtgcggagccgctggtcctgctgtgcaacggcagcagccggagcggattccggcaccccctggctacacacgcgccgctgggacgccgcgccatggctgtggtgtgcgcgcgcagggacggcatggtggccaacataacgcgctgggtgaggttcgacgacggcactgcggcggagcgcgacgccgaggcacggatcgccgcagtggaggcggacatcttcgacgccacagtcccgggcgcccggctggaccggatctttgccgagatcaaggctgcctacggccgccatggtttcggcgcagaccagtgggagcagcaccaccagggcgggcccgctggctatgcgggccgggatccccgcgtcaccgcctccgccacggacacggtggtcctgggccaggccttcacctggaatccgtccggtcccggcgtcaagatcgaggacaccgtccagctcaccgagtccggcctgcaggtcctcaccgtggacccccgctggccctctaccaccgtgaacggcctccagcgcccggccaccctccagctctaggccagacgctctctcagatcctgcagtaaaaccaaaaacgctctctcagttgccgccgtacttccggcatcaactgggagagcgtttcggttaaagcgacatcaagtgggagagcgtttcggttaaagcgacatcaagtgagagagcgtgtcaggggaggcggagttccccgtccacccggcgcgggatacccagcgggttgctttcgtgcagggccggatgcaggaccgtctccggagcatcctggtaggcaaccggacgctggaagcggcggaccgccgtcgcgcctaccgaggtgaacagcgacgtggtggccgggtacgggccgccgtgctgctgggcccagttgacggccacacccgtgggccagccgtcaaagaggacacggccggcgagctcggaaagctggtccacaagagcagacacatcctcgcccggctgggcgtgcacggtggcggtgaggctgcccggcaccttggccaggacctcggccagctcctcctggcccgagtactcgatcagcatggtggtggggccaaagcactcttccagcagttcctcgggccgctccagcaccttggctgcggaagtggagaagaccaccggcgcggcgccgtcggacaccgcgtcctggtccaccgtgccgctgactacgtccacgccgtccaccgacgcgaagctgcgcaggccgtccgggtaggcctcggcaatccggctggtgagcatgcccagcgcaggcttgtccttgctggctgccgccactttcgcggcaaagtcggttccggccgggataaacacgagtccgggcttggtgcagaactggccggcgcccagggtgaaggaccctgccaggccttccgcaagctgcccggaacgctctgccagcgcggccccggtaaccactaccgggttcaagctgcccagctccccgtagaacgggatgggatccgggcgggacgtggccaggtcaaagagggcacggccgccggggatggagccggtgaagcccaccgccttgatggccggatcctggaccagcgccgttcccacctcgcggccgctcaccagcgcgaacaggccttccggagcacccgctgcgcgcagggcttcggcaacgatttccgccgtccgctcggagaggcggaggtggcccgagtgggctttgacaatgacagagcaacccacggccagggccgaggcagtgtcgccgccggcaaccgagaaggcgaacgggaagttggaggcggagaacaccgccaccggtccgatgggccggaggatgcgccgcaggtccggcttgggcggggtggaggcggggtcggcatggtcgatcacggcttcgaggtaggagccctcggtaatgacgcgggcgaacaggcgcagctgcccggttgtccgggccacttcgccggtgaggcgggctgcgccaaggctggtctcggaatcggcaatctccacgagttcggcggcgtttgcgtccagcgcgtcagcaaccgccgtgagccaggccgcacgttcagagtcggaggcggccgcggagatcttggctgcctcggtggcagcggcggtgagttcggacagggaaagcgttgcagttgtcacgtcaggtacctgttcttcgtatgtatattcatcaaaggccgctttttacaatccgtcccggaagcggaagccgagtccgggctggtgggtgagcgtcacccggctgttgctgaaccggaccggcgaaggccctgccaggatccccagctgctcaaaggatgcatcctccacgtcctccaccagggtgggctccgcgagggtcagcgccagctggccggacagctccggcagcaggtgcggcatgaccttgatgctgttggtgcgcgcaagttccacgatgcgccggaacggggtgatgccgcccacccggataatgttcggctggatgatgtccactgcttccgcctctatgaaatcgcggaagcggtagatggtgtgcaggttttcaccgagggcgatcggcaccggtgaatgcttgcggagcctgcggtaggcccacaggtcgtccgcgcggatgggctcttccagccactccagcccgtagccggccaggacatccagggcgcggagcgtggtgggcaggtcccaccgctggttggcgtcgatcatcagcttccggtccggccccaggacggaacggacagcggccacccgttcggcgtcctcgcggatgtccggcttgcccactttgatcttgaccgcgtgatgcccggctgcaacccagcgctcggtctgcgctacgagctcttcaagggtgtagtgcaggttcacgccggagccgtagacttccgcggattcctggcgctgcccgagtaatccggtgacggaggtatgggcgcgcgatgcctggaggtcccacagggccaggtcgacgccggccatggcgatggtggtcagtcccccgccgccggcctcatgcagccgcttccatacggcatcccacaccgtctcggggttggcgggcagcccggtgacgaacggggcgatgtcgtaatccagcagcgccttgaccgcctgcggaccaatggtgggggtccaggagaaaccgtgccccgcgccgccgtcgtccgtctggatctccgtgacgatcacgtggttttcaggtgcctccacgccccagctgcggcgcaacggcaccgtgatgagccggttggtgaggcccgtgatgcgcggttccgtgcggacggcaacagccgcgggggcgctcatcagcggccagccagctcgtagcccttggcgaggatggccttcagctgcaccagctgctcctcggtggggtccaccagcggcgggcgcacggagccgacgggaagtccgcccagccgcaggcccgccttgatcagcgaaacgccgaaaccgggcgtttggtcgcggaggcggaccagcggtgcgtagaagccttccagcagggcgttgcggcggtcctcatctccggcctcgtaggcgtcgtagtaggccttggcaatctccggagccatggcgaacgcggcggacgagtacagggggatgcccagtccgcggtaggctccctgggtcagttcggcggtcagcaggccgttgaagaaggcgaagtcctggcgtccggtggcacgcaccgcggacacgatctcctgggccagtccaacgtcccccagcccgtccttgaagccgatgaccttggggttggcagccagcagcgccatggaagcggcggtgaacttggcgttcccacggtggtagacaatcactggcaggctgctggcgttggccacggcctcgatgtaggccacgagtccgtcggttgggccggtcaccaggtagggcgggaggacaaggagggcgtcggcgcccgcttcttccgcggcgcgggcggcggcaatcgcatggcccagcggcccgccggcgccggcgactaccgggacctttccggcaacgacctcgacggcggccgtcaccacggtgctgacctcctcgatgctgagtgcgtggaattcgccggtgccgcaggcggggaaaacgcccccgggcccgaacggaagccgggagctgatgtgttccttcagcagctcgacgtcaacagtgccttcggccgtgaagggggtgacgggaaagaacagtacgccgtcgaatttcatggtgtctccttggctccgctgccggcagtgaccagcgcggagttctcgtctttgagcggggtgttggacttgagttcggtgcgccagctgcgcgttggctgccagcccaggagttcctgggctttggcgatggagaaggcagggctggttccggtgagtcctgcgctgagggcttcgcttccggggaggaattttggcatgagttccgcaaggggcccggtggccagggcgtctgcggcaccgacgaagaaggtctccccgttggggatggacggcatcttctccaggagcaggtccaggaagtccgccacgtcccgggcatcaacatagttgaacagggcaggcgcggacagggcggggtcggccagccgctcagccagggtgtggccctgctgcgtcggggcgccttcccactcctccggagagatcacgtagcagggccggaacgccgcatagcggatcttttcgccttgtgcggctgcaaacgtctgcaccgtctgctcggcgatgagtttggacagcgcgtaggcgttccacggccgcggcggcgtccgctcatccagcgggaacgacggcggcagccatcccgccggcgaaccgtagcccagcacggtggggctgctggccgtgacaatcttctgcacgcccacttcggtggctgcgctgatcacggcgaacgcgagccgcgtgttcgtggcgaagatgacgtcctcgggcgcgctgaacggtacggctatggctgcaaggtggatgacggcgtcgggcgtggtgtcccggaggaggcgcagcgcctcgcccggggcaaggaggtcggccgtttcctgcacgacgccggcgggcagctggtccgccggaacggcgtcgcggtccaccgaaatgacgtggtggcccttttcggcgagccccgccacaacactgcggcccaggcggccggagccacccgtgacaaagatcctgctcatggttattccttcaggttggttcccgggcaggattcagttgccgcggcggaggtcgacgccgaggtccaggtcctcgatgcgtacgggcagggaggactcaagggagcggttgccggcgatgccgacggagacggaacgcagcccgtccaggtagcccgaggggcgtcccagcgggtcctcacccggaccgttgaagaggtccgagagcaggagctcgtcaccgccgccgtggccgccttcgccattgacgatcggcacctcgtaggcggcctcccagtggcgctggaccaccaggcgttcgccgttgcggcggatggcgtcatcttcctcgatgggggtggcgctggggtccacgacggtctttttgtccgtgctggacgtgacggcggcgcgttccaccacttcaagctcggcgcggccttcggtgccgttgaccgctacccggtagccctcccaggggctgtgcgcgttcaacgagtagctgaggcggggcccgccctggtattccaccacgagtgcgaggttgtcctcgatggtgatgccgccggtgaagacgtcctggtcgcggcgatagccgtcgtagtgctcgttgtccaggaagagggccttgaggcgctcgtcctcgcgcaggtcaagggtaaagggatccttctccgcgccggcgggggcatcggcgctgggcgtgccgcgctcggggcggggacccaggccgcgctcggcggcgtttttgtcgccgtagaacttcaggccgccggaggcgaagacgcgctcgggaacgtcgtcgatccaccagttgaccaggtcgaagtggtgcgaggccttgtggatcagcagaccgccggagttcttcttttcccggtgccagcggcggaagtagtcggcgccgtggacggtgtccaggacccagctgaagtcgatggacgtgaccttgccgatcacgccgctctggatgatctccttgagggcgctgttccgcggcgaatagcggtagttgaaggtgaccaccacgttgcggccggtctcgtgcacggcctgggtgatgcggcggcagccttcggcgtctatggtgaggggcttttctacgacgacgtcggcgcccgcgcgcagtgcctccacgatgtagtcggcgtgggtgtagtcaggggtggtcaccacaacgcggtcgatgtcgttggcctggatgaaggcagtgaggccggcgggatcgaatgatgcgaccggacccggcgcacccagttcctggatgagcttctggtagaactccacgcggccggggttcacgtccgaaaatgccaccagctcggcggtgtccgcgtgcttgccgaaaatggcgcggatgtacatctcggaacgccctccggtgccgatcagggcaatgcgggctttgccgccatggcgggcgggcgaggcggcggcagcagtcccggtgccgtccgcgggttcggaccgggcctctggggcggaagtcgactcggctgtgttgaccatgaggggtccctttcgaagacgcaaaatccggccggttgggccgctgttcggtgacgatgtggtgccttttttatatcttgcctcagaaagcgttttctcaggctgctatatgagttgtatcaatccgatcgctcatccgtcaagcattggcaggcgttggcagaaagcgttttctgcacaacgggggctccgaccctggaaaagtcgggaaaattggccgggaaaagtgggaaaagaagagaaatcgctttcccgtcccgttatatgctgtcactcactacatgctttgacgagtacgcggccacacagtcggttcggatcctgccctgcaatggaacggcgccgccatctgcccggccgcggcgcgaaggaagggaccatgcatggtcaggaaatcggcatcgggccggatcggcatcgcggatgttgccgtgaaggcgggcgtctcccacgcaacggtttcgcgcgtcatgaacggcaacttcacggttgaccccgagatcgcggcccgggtccgggcggccgccgtcgagctgaagtaccagcccaatcccgtgggccgaagcctggctctgggcaagacagacaccatcggcatcgtggttccggacctggccaaccccaccttccaggccattctccgcggcttgagccgggccgccgcccaggacgggtaccgcgtgctcatcgctgattcctttgaggtctccagcgaggaaaccattttggcgggcgaggcacgccgtcggtgcgacggactggtcctctgcgcgccccgcatgagcgacgccgaactggaggagattgcgccgtccctccggccgctggtcctcatcaaccgcaccacggccgccgcgggcgttcccagcctggtggtggactatggccagggcgtgcaggacatcgccgaacacctggtggaactgggccatacccgcctagccttcctggcaggccctccccgcagcgcctccaacaacctccgcctccagggcctggaggccttcaaggcggcccatccgcaggtggaggtcaccatgctggaaggcggctcggacttcgataccggccacggcgcggtggatgctgttttggagagcggcgccacggggatccttgccttcaacgacctcgtggcgatgggcctgatgagcggactgcatgaacggggccttgacgtccccggcgacatctccgtcaccgggttcgacgacattccctttgcaaagtacacgacgccgacactcaccacagcggctgttcctattaccgagttgggcgagcaggcctggcaccagctgcgggccctcatccgcaacgaggaaagcgatgcacccggcagccgctaccagcccaagctcgaggtacgcgccagcaccggtccggccaaggctgcccgtacggcagtccacggctgaccaccccttagggcaggcccattccggcctcccggtagtacccctcgatatgggcagcaacgagcttcgccgcgcggtcgccgtcgtcattcctgatggcggcaaggatctcccggtgctccgccttcagtcgcgaggctgtggcctcccagtccggaaggttggacgtcagctgcgcggcgtagcgctggatggattcgcgcagcgaccccatcatggcgctgaccacggcatttcccgcggcatcggcgagggccaggtggaaccggacatccagtgccaggaattcgtcaacgtccaacccctccgtggccatctcgtccagcaggctgccggccgcctccagctcaggcgcctgcggacttgcctttgatgccgcccaggattccaggaggacccgggtttccacaatgtccgccaccggaaggtgctgcgtggcaacgtgcagccgcaacgctgagccaagtgccgccgtcggatccgaaatgaccaccgtcccggcatccgggcccgagccaaccccggcccggaccacgcccatggcctccaggatccggatagcttcccgcacggacgtgcgtgagaccttcagctgctcagcgagggtgcgttcggccggcagccggccgcctacggtcagccggccctcggaaagctcggcctcaatccaggacaaaacaagctggtgcgtacgcatagggccatggtacttgatgtggtccgaccacatggcctacagtgtggttagaccataggaggtcccggatgcggacctgccggcccaacggaggacgccatgacccacaccatccagcccaacaatccggagaccacccctgccccggacgctactgacatcccgtcaggcaccgccgggcacgccaccccaaaggccgtttccgcggtgccggcagcgctgaagcgccggatccccaagtattcggacctggccccgctgatgcagttcaagaagcccgagttcagcaaggaagcgcggctcaagcgggccagcaccatctgggaactccgcgacatcgccaagcgccgcaccccgcaggcaccgttcgactacaccgacggcgctgccgaaggggaaatcaccctccgccgcgcccgcgaggcgttcctggacatcgagttccggcccggcatcctgcgcaacgtctccaagatcgacctgagcaccgaaatcctgggcaagtcttcccggctgcccgtgggcatcgcccccaccggcttcacccggatgatgcagtccgaaggcgagtacgccggttcccaggccgcggaagccgccggtatcccctacaccctttccaccatgggcaccgcgtccatcgaggatgtggcggctgcagccccgaacggccgcaactggttccagctgtacctctggacggaccgcgaccgctcgctggaactgatcgagcgggccgccagggccggcaatgacaccctgatggtcaccgtggacaccgccgtggccggcgcccgcctccgcgatgtccgtaacggcatgaccatcccgccggcgctgaccgtcaagaccgtcctggatgcctcctaccgccctgcctggtggttcaacttcctcacgcacgagccgctgacgttcgcgtcgctgtcccgctacaccgggaccgtggccgacctcatcaactccatgttcgatcccacgctcacgttcgaggacctggactggctacgcgaaacctggaagggcaagctggtggtcaagggcatccagaccgtggaagatgcccgccgcgtcgtcgaccatggcgccgacggcgtggtcctctccaaccacggcggccgccagttggaccgggcacccatcccgttccacctcctccccgaggtcaagcaggccttcaccgcggacaacagcaacgcagcgatcatgctggacaccgggatcatgagcggcgcggacatcgtggctgcccttgccctgggtgccgacttcacgctgatcggccgcgcctacctgtatggcctgatggccggcggccgggcaggcgttgaccgtacgctgcagatcctggagaaggacatggcccgcaccatggccctgctgggtgtcagcaagatctccgagctgaccccggaccacgtgcgcctgctcaataagtaagtagcgccccacccaactaggtagcgcgaagtgtcgttttgggggttcaaaacgacacttggcgctacttacttgggataagcggctattttttacggccgaacttcggcagggtggggaggttcgccaggaggtcggcggccttggtggcagccctgcccacggtcctgccgatctgctggggaacgctgtcgtcgctcaggggcgtcgtggttccgccgggaatgacgacggcgggactcagctcggcgccgtcgcgcgccaggacaccggcggacacagcctctgccgccatggccccggccgtggcggcttcctggtgcgcgggggcccccttgggggtggtgcgggaagcctgttcctggctgctttcagcggcagcggcgtgcacgggcgcggggacggctgcctccggagccgctgttccgacgtcgagggtctccagccacgtggcgatgccctccagcggcttgcggttgagtgcgtagtagcgcttctggccctgggccctcatgctcaccagctgggcttcgcgaaggactttgaggtgcttggaaatggtgggctggctcgctgccagttcctccaccagttcgcccacggccttgtcccctgaacggagggaaaccaaaatgtcacgccgggtcgattccgctatgacggcaaatacgtcgtctgtcaccatgcctccaaccctagcgacatatacgccgaaaggcatcaactatttcggcccgtacccgaacgccattgcccgagtccttccgcggtgctagaacggttccagggttgccccgggttcccgggcagcggccggcgtgacctgaggagtgggtggcatggatatcctccgccagcaactgttcaacatcatcgcgttcgtgttcctgggcctttttgtcgcggtgtggggctcggtgctgctgcgcgtggggttctgggtgcctgacgggcggactgttgcgccgcccctcaatggagccctggtcactgcggccggcgtcctggcaacgtctttgagttcgctgacagcatcggccctgggttttaccatcgccgaggtccgccgtgacgagtctgagcaggatgcccgccggcctgggcccggggcgccgggaagctccaccgcggtcaacccgtccgacgtcaccgccaggctgtcggggaggatcgtcgcagccatcatcgtctacctcgccgtgggcctggccgtcctgctgctctggctcgccaagggaaccgcgtccacggacctgatcggggccttcgcgttatcgctgctgggatggctgatcggtgcggcgggcgtggtgttccagacggagaagcggaacacctgaagtcaaagcgtcagtcgaaccaggggtcgagtccgtggagcgggaacacggacttccgggttgccatcaccgtacggtccacgtcgtcattgggatcgaaaccgacctcccaggatcgccaccagagctccacgtcgtcactcatcagcgccggcgcggaggagccgaacttctcctggacgtaatcacgccagtcctgcgggaccggcgtgcgcagcggcacgggccgcccggcagcgatggcaatcaggtggctccaggaccgcgggaccacctggagcacgttgtagccgccgcctcccgtggcgatccaccggttgtcgcagtggcgggcggcaaggttcccgacggcggaggccgcctcccgctgcccgtcaacgctgaggttgaggtgcgtcaggggatccaggcggtgggaatcgcagccgtgctggctgacgatcacctccggctggaaggcagccaccaactgcgggaccacagcgtagaaggcgcgcagccagccggcgtcccccgttcccgagggcagcgcgacgttcacggccgtcccctccgcctgcgggccgccgatctcgttcgcgaaccccgtgcccgggaacagcgtcagcccgctctcgtgcagcgaaaccgtgagcacacgggggtcgtcccagaagatactctccgttccgtccccgtggtgcgcatcgacgtcgatatacgccaccctgcggatgccgccgtcgagcagcttctgtacggcaagtgcagcgtcgttatagatgcagaacccgctggcccgctcgcgggaggcgtggtgcatgccgccgccgaaattgatggcgcgcacggctgaaccgtccagtatccgggaggcggacagcagcgaggccccggcaaggcgggccgcagcctcatgcatgccggcaaaagcggggtcgtcctcggtgcccaggccgcgggcctcgtcaggctggccgggattcgcgctgacctttttgactgccgcaacaaactcgggggaatgcacggactcaaggtcggcgtcgtccgccacgtccggcgcctccaccgcaacatgctccagatcaaacaacccaaggctggccgccaaccgggcggtcaggtccatgcgttccggcgccatggggtggcccgggccgaaattgtaggcggtcatgtcagaactccacgccaccaccgttgggggcgcgggcaagctgaggcccggcaggtatgtcatcaatcacaggctacctgagcgcggcacccctcctgcccagtcatgacgcgtgcattagtggtttactactgagggaagcagtttctaccgaggaaaagccacacatgacccaaagccagtcgaggccccgcaccccggccaactggcatcccgcagggcaggagcgggaaggcctctggatccttacgcggctgcgggacttcgtcgacgacattgcgaacacctcgcctgcccggcttgccctgacggtgttcgccgccgtctgccttgtatttacgctgctgttgtcgctgccggtctcttccgccgccggcaccgttaccccggtccaccaggcgatgttcaccgccgtgtccgcggtgtgcgtcaccgggctcacagttgtttcgacggcggtccactggtccttcttcggccagctggtgatcctgataggtatcttcatcggcggcctcggcaccctgaccctggcctcgctgctggcgctgatggttggcaagagactgggcgtgcgcggcaaaatcattgccgccgagtccatgaacaacgcagggcgcctgggcgaggtgggcaccctgctgcggatcgttatcaccacgtcagtagtcattgaaggaatcctcgcactggccctgatcccccggttcctgaccttgggtgaaccgttctggcaggctgtctggcacggaattttctatgccatctcctccttcaacaatgcaggcttcactccgcactcggacgggatcgtgccctacgaaacggacctctggatcctggttcccctgatgctcggcgtcttcctgggcagcctgggctttcccgtggtgatggtcctgcagcagaacgggttgaactggaaaaagtggaacctgcacaccaaactcaccatccaggtttccttcatcctcctggcggcgggcaccgtcctgtgggctttgatggagtgggacaacctgcggaccatcggaaccatggatctcggcgacaaggtcacccacgccctgtttgcgtcggtcatgatgcggtccggcggcttcaacctggtggaccagaaccagatggaatccaccaccatgctgctgaccgatgcgttgatgttcgccggcggaggttccgcctccaccgcgggcggcatcaaggtcaccaccatcgccgtgatgttcctggcaattgtggccgagggccgcggcgacaccgacgtcaaggcgtacggcaggaccatcccccaaggcaccatgcgggtggccatctcggtgatcgttgccggagccaccttggtttcggtgtccgccttcttcctgctgcacgtcagcggcgcatcactggaccgggtgctgttcgaaacgatctccgcgtttgccacctgcggcctcagcacaaacctcagcgctgaagtgccgccgtcgggcgtttacgtcctcacggccctgatgttcgccggccgcgtgggaaccgtaaccctcgccgctgccctggctcttcgccagcgcagccagctctaccactatcccgaagagaggcccatcattggctagttcacccgacgccccgcggcgtcccgcccacaacgcccccgtgctggtcatcgggttgggacgcttcggctcctctacggcagaacagctggtcaagcagggccgtgaagtccttgccatcgagcgggacaggaccctggtgcagaagtgggcgccgctgctcactcacgtggtggaggccgacgccaccaacatcgacgcactccgccagctgggcgcccaggagttcagctcggccgtcgtgggggtgggcacgtccatcgaatcctcggtgctgatcaccgtcaacctggtggacttgggcatcgagcacctctgggtgaaggccattacgccgtcccacggcaagatcctcacccgcatcggcgccaaccacgtgatctacccggaggccgacgccggtgtccgggccgcccacctggtctccggccggatgctggacttcattgagttcgacgacgacttcgccatcgtgaagatgtaccccccgcgcgaaacggtggggttcacgctggacgagtccaaggttcggtccaaatacggcgtgacgatcgtcggcgtgaagtcccccggcgaggactttacctacgcccgcccggagaccaaggtgtcctcccgggacatgctgatcgtgtccggccacgtggacctgctggaacggttcgccgcccggccgtaatccccaaccgccccctaacctcgcaggctcggccagggaaccctgcggtcgtgggcccaggctagccgagctgcttggtgatctcggctgcccgctccgcggcggcgcgggcgccggcagcaatgatggcgggcaggccgcgctcgtcgaatgtggcgatggccctctcggtggtgccgttcgggctggttaccgctttgcgcagcgcggtggggtcggcgccgggctcggccagcataaagccggctccggccaccgtttcccgggccaggagcagcgacagttccgggtccaggccaagctcccgtcctgctgcggccatcgcttcagccaggtagaagacgtaggccggtcccgagccgctgatagccgagagcgcgtccacctgttcctcggggacctccaccaccgttcccgcgccgtgcaggacgtccttgaccctctggagctgctccggggtgcagttggtgcccggcgagaccgacaccacgccgcggcccagcttagccggcgtattgggcatggaccggatgaccggctgacctgccggcagtgccgcctcaagctgggcaatggacacagccgcggccacactgaccaccaccgtggtgggcgaaagcgagctgctgatttcccgtgcaagttccgtgatgcccacaggcttgacgccaaggatcacgacgccggatcccttggttgcctgcttgttattgtccggctcctcttccccggcgatcgcggtcaccccgtggtgccgttctgccagttcggcggcgcgttctgccctccggacggttgcgacgacgtccgccggatccgtcccggcttccagcaggccactcagaattgcttcgttcatggatccacagccaaggaatgcgattcggttgctcatggctccatcattacagttcggcccggccggcgcagaaaaccatgacccgggacggacacgaaaatggtgggaactcccggaaatccattcacaggtagctcccatgttgggtgcaggtgcctcacaacttggcgccctaacgtagttattacctcattgagggtgcgagtgatgcggcagggatggggatccctgccagggtaccggcgttcggcaacaggttttcccccattttcctgttgccggcgccggtacttccgctttaaagagttttctagactgcggcttcgacagcctgcggcggtgccaggtggggtgacagctccagcggtccggaaaacaccagctggtccagccgccggaggatgaggccttcccgcagcgcccagggacagatcctcagcttcttgaatttgaagagttccagggcggcctccgccacgagcgctccggccagcagctggtgggcgcgggcttcggagacgcccggcaggtgcaaccggtcctcgactttcatggccgagatgcgctgcgcccaaacccccaggtccgaagcctgcagctcgcgtttgacgtaggggccggccgcgctgggggcagccccggcaatccgcgccagggagcggaaggtcttggacgttcccgccaccacgttggcgcggcccagcccgtcgaactcccggaccgcaggcttgagggtggcccggatgtatcgccgcagctccttaacgcttttggccgacggcggatcttcggccagccagtcccgggtgagccggctggcgcccagcggtacggaggtggccatttccgggagctcgtcctggccgaaggccatctcaaaggagccgccgccgatgtccaggttgaggatgggtccggcgccccagccgtgccagcgcctgacggcgaagaaggtcatggatgcttcttcgctgccggtgagttcctgcagggtgacggtggtttcgtgcttgacgcgggccaggacctcggggccattggttgcctcgcggatggctgacgtacaaaaggccaggaggtcctcggccttatgcctggccgcaaattcccaggcctcaaggacgaactcggtgagctcgtgctggcctgcgtcgttgatactgccgtccggctccaggtactggaccagggacagcggccgtttatgcgaggcgaagggcaccgggcgcgcgccggggtgggcatccaccaggaggagatggacagtattggacccgatatcgaggacgcctagacgcatggtgccattattcctcgtcagcccgcttgaagtcgcgcttgatgttggccacgccttcggggttaatctcaaaaccgtaggctgcccccgggttgatgaccattcccagctcgtcgccaatgttggcaatgatggccgcaccctgggttcccagcacgttgggcgcagcttcgaggtactgctggtccacgcggctggggtgcgagaagacggccaggacggggtcgccgtcggcgttgcccaggaccaggggctccacctgcgagtcctcgccctcaatgccgtccgaactgatgatgtagacctcgctgttcaggaaggacaggatgacatctaccgggctggcgtcaggctgcccgcccttggcgagcttttcctcgaggtcgttgagaggctggagatccgtatgcgcaggctgttcagtcatccccctacccgatcacgatccagtgccccatgcaaaccccgtagccaccgctacttcttggctgtggccttcttcttggccggagccttgcgggtggccgtacgcttcaccgggcccttggcgcgcttctccgccagcagttccacggcctgttcgcgggtcagctcctccagggaggttgcgcgcggaacggtgatgttggtgatcccgtccgtgatgtaggggccgaagcggccttccttcaccacgatgttcttctccgacaccgggtccgggccgaactccgccagcggcgggacggcggcccgggcgccgcgctgcttcggctgggagtagacctccagcgcctggtccagggtgatggtgaagatctcttcctcggagccgatggaccgggagtcggtccccttcttgaggtagggaccaaaccggccattctgcaccgtgatgaggttcccttcggcgtcctcgcccagggcgcggggcaggctcatgagctgcagcgcctcgtcgagggtgacggactccacggtcatggacttgaacagcgagccggtgcggggcttggccttgaccggcttcttcggcggcttgggcttgccgttcttgtagtactccacgggctgggcggcgatctgttcctcggtcatctccgggatgacctcggtgacgtaggcgccgtagcggccgttcttggcaaccaccgtgtgcccggtgtgcggatcggtgcccagcacgcgttcctccggggcagcggtctccatcagttcaatggccttggcagcggtcaactcgtccggagccaggtcctcgggcacgttggcgcggggcgactccacgatctcccccgtcttcgggtcaacagtggcggccgagctttccaggtacgggccgaacttgccaacccgcagcgtgatctcatcagtgatggggatggagtttatttcgcgggcgtcgatctcgcccaggttgttcacgatgctcagcaggcccgggtccgagtcttcgccgaagtagaagtgccggagccaggaggcacccacggcctggccgttggcgatcttgtccaggtccccttccatgtccgcggtgaactcgtagtcaacgtagtcgctgaagtgctgctccagcaggcggatcaccgagaaggcgatccagctggggaccagggcggaaccctgtttccggacgtagccgcggtcctggatggtggagatggtggaggcatacgtggaggggcgtccgatgcctttcttctccagctcggccgtgagcgatgcttcggtgtagcgcggcggcggcgaggtttcgtggcccactgccaggatctcggatgccttgagggcatcgccctttgccacgttgggcagccggcgggcgtcgtcggaatcgtcgtccccgcgggtctcgtccttgccttcctcgtaggcggcgaggaagccggggaacgtgatcacggtgccggacgccgagaactcggcatcccggccgtccgcagcgaccgcacccagccggatggtcgccgtcgagcccttcgcgtcggccatctgggacgcgacggtgcgcttccagatgagctcgtacaggcggaattcgtcgcccgagagctgcttggccacctgggccggggtgcggaacgagtcaccggcggggcggatggcctcgtgcgcttcctgcgcgttggctgccttgccggtatacacgcgcggggactggggaatgtactccgggccgtacagctctgatgcctggcgccgcgcggcggtgagggcttcgtcgctcagtgcggaggagtccgtacgcatataggtgatgtagccgttttcgtacaaccgctgggccacctgcatggtgctcttggaggagaagcgcagcttgcggccagcctcctgctgcagggtggacgtggtgaagggcgcagccgggcgccgggtgtatggcttggtgtccacggaccggacagtgaacgaagcgtcctgcagcccagccgccagggacgtggccagctcctcgttcaggtgggcgacgttcttcgacgtcaggacgccgtcgtcgttgaagtcccggccgctggccaccttggcaccgtcaacggcggcgagcttcgccttgaaggaaccggcgtcagcgccgaactggccggtgaggtcccagtaggaggcggccttgaaggccatgcgttcgcgttcgcggtccaccaccatgcgggtgaccacggactgcacgcggccggcggacaggccgcgtgccaccttgcgccacagcaccggggagatttcgtagccgtacaggcggtccaggacgcggcgggtttcctgggcgtccaccagcgcggtgtccacgtcgcgcaggttgcccatggcgcgctggatggcttccttggtgatttcaccgaacgtcatccggtacaccgggaccttgggcttgagcacttccagcaggtgccacgcgatggcctcgccctcgcggtccccatcggttgcgagatagagttcgtcagcgtccttgagcgcagccttgagctcagtcacctttttcttcttgtccgcagacaccacgtagtagggcttgaagtcgtgatcaatgtcgacggcgaacttgcccaccgacgttttcttcagctccgcggggagttcggacggctgcggcaggtcgcggatgtgaccgatggaggcctctacgatgaagccctcgccgaggtacttggcgatggtcttgctcttggccggagactccacaatcacgagtttcttgccggttttggccttgcttggcacggtgctcctacagaaaaaggttgctcgggcagatgcgcccatactggcctagttcaccatattttgcagaaatgtgcgcatccatgtggaaaagaagggggttctgccgggcgccgtcggcgccttgctccttgccttatccggcggcggggatcaggaagccgtcccgcaccagattggccacgtcggtgagcagcccgccccggaaagaaccggcgtcgaacccgtcctcgtccaccatcccgccgccgagcagcgcctccaaagcaccggcaatctgcccggccgtcaggtcgccgtcgcaggccgacacgaagcctgccagctcggtgctcaggaggtttgtccggcgcaggcccgcgccctgccggaggaggatcacccccgggtgctccgcgcccggcctctggtggcgctcctccgtgacgtcctccgccaccagcaggtgcgcgtcctccaggctgtgcgcagccagccagtcgatgcgttcgacggcggcgcccaggtgggggccgatgggctgctcgatggggtaggtgatttcctcgaaccggctgaacgtgccctgcccgggtgccggcggccgccggagccagaccatgccgaaaccgatgccctccaccttcctggattcgaagtcagccagataggccgcgtaagcgtcgcggtagtgctgccggtcccggccctcggaggcatcctgcagccaggtttccgcgtactgctccggccctacctgctcgcgctggatgaaccaggcgtccgtgcccggccggacccacgcccgcggccgctcctgccattcggtcccggccgccacttcccagtttcccagcatctgtgcggtgccgccgggcgctaggaccccgggcagggcggcaaccagcgaggcaacaatctcatcgcccggaaggccgccgtcgcggtaggtgaactggtccgcggcgtcctcgccagcgctccgcggcgtgatcacgaacggcggattggacaccaccagcccgaattcctcccctgccacggggtccaggagtgagccgaggcgcaggctcaccctgtcctccagccgggccgggtcaacagacagtgccccggcgttcagcaggatgttgaagcgcgtgaaggccagggcgcgatccgagatgtccgttgccgtgacgtgctcgcagtggtggagcaggtggaaggtctggatgccgcatcccgtgccgaggtccagggcgcgttccgtatggcggcggacggtggtctgcaccagggtggtggacgcctgcccgatgccgagcacgtggtcgtgccgcagcacgcctgcctgctggtgtgcggccaggtcactggccacccacagttccgcacccccgctgccgtcctcattaggttcccacccgtagggccgcaaatccgctttcgccgacaaaagccctgagccaggaacgggctccaccagtccaagcgtgaggaggccgtcggcacgggtgcccggaagggcggcgtcgagcgtttccttctcctgcggctcagcaaggagccagaggcggacgacggcggcgagcgccgcgttcccttcgtcctgccgtaccgcccggtccactgccagcagggccggaatgacctggtcccggttcagggccgcggaggcggcggcgcccaggaggctggcgacgccgtcgggcgtgtaatccaggcgcctcaggtcagcggcgagggccgtgagcagctccgggaggtcgctgcggggtgcgtccggggtgttgccggcgatgaactcgtatggggatttaggcactgcctaagtttagtccggcgggcgccggagcccggggcagccggcaccgggtagcgtggaggcatgccttcgcgttcttccgtccttccgcgcgcccggctccggcctgtgcggcgcgcctgcctgctgccgtggtccgccgcaatcgcgggtgcggccgttgccttggccgggtgctcccccgttgtttccatcgagaacgcggacgtcccgcaatggcaggccaccgcactgcccaccgcgccgggagcggtccttgaggatgccggcaaaatcctcaaccgggaccgcatcatcagggaagccgctgacgtcccggcgggccgctacatcctcaccgccacgtgtgagggcggcgggaaagccttcttcgccatatcgctggacgggaagatgctggcggacgccggagcagcctgcaacggcagccgggaaaccacaaaaattaccctgccggacgccggcccactggagatcagcacgtacagcgtggacgcacccctgatttacgcctaccggctggtgcccgcggaataaccgccctccgtgctctggcccgccgtcgccggcgggcatacagtctgactatgcccagtgtgcggatagcctccgtgccatccatcgtccccccggcccccggccgggacgcacgggtgcggccggcgcggaaaccgagcgccgccgtcgtcattgctgtggtggccgccgggacgatgctgggcggatgtgaatatacgtacgacgacggccggaacctgcccgggcccgtcgaggccgaagcgacgcgccttccagggccggtgttcacccgcgaccccctgcagaacgaccccgtccgcgaggaagacgtaggagcgtgggcggcccggacgctgcccgacacagggcagccggtggcctccgccggggcaggcctcgtggccgctggcaacgtccggaccgaatccacgcccgtgctgggaacgggcacctacgcgcttgcgctggcgtgccgcagccagcgccgcgtgaccttcacggtccgcagcgactcactgacgctggtggacctggggctccggtgcgggatcaaccgggagaacgtcatctatttatcatcggaaacagcactcaccatccgggtggaggccaggacaggcgcgaactacgcctaccggctgcggcttctctgacgtgttgccggtgctcaggcggcgcagccctccgggcagcggagggttaccgggctggaggcgcactccgcgcaatacagggtaagggtgcggcagctggggttggagcagttctcgaacttgctggtaggtgctgcgcagcgggcgcactgcccgatggtcttggcgtcatcgctgaactcaaggtgcatgcgcttgtcgaagacgtagagcgagccctcccacaggccctggtccttgaaggtttcgccgtagcggacaatgccgccgtccagctggtacacctccttgaagccccggttcaccatgaggctggacagcacctcgcagcggatcccgccggtgcagtaggtaaccacgggcttgtccttgagcccgtcatacttgccggactcaagctcctggatgaagtcatgggtggtggcaacgtccgggacgatggcgtccttgaaccggccgatctgcgcttcgaaggcgttccggccgtcaaagaagaccacgtcctccccgctctgcttcttggcgtcaacgagctgatgcagttcctcgggcttgagatgggttccgccgcccaccaccccgtgagcatcgaccttcagctcgccgggagctccgaaagagacaatttcatcgcggaccttgacgctgaggcgcgggaagtcctccgccccgccgtcggaccatttcacgtcgatgtccctaaagccctggtactcgcgcgttgtcttcacgtactgcttcacggcgccgatctcaccgccgacggtggcgttgatgccgtccttggagatcaggatgcggcccgtcagcccgagcttctcgcagagcgcacgctgccagagccgtaccgcctccgggtcaggaaggggggtaaagccgtaaaaaagcacaattcggtttaaagccacgcatttaagggtaccggcacggttaaggcgggaggtgcggggacctgcggcttccggagggtcggcgatgaatgccggcccgtaccggtgctttcgccgcatcacaattgcataagctcttggccgccccctgttgctggcgagcgggctggaatagtctcatgccatgagtccggaaaccatggttgaagacatcactggccttcttgaggtgtgggtggcgggctgggccggttgtcgcggttacaggacatccaccgagggccgcttcccggctgcgctccgcgccgataccagcggcgactgggaattcttcgcctccgagcccacggacgatgagttcgcagccctggccgcaaagacggcggaggcgcccgcgagggtcctcaccatcctcaccaatgatttcccccggtactccgccctggcggagcggcacggcctgaacgtgacctctgactcgcaggcaatgatgatcgtggacatggaaacccaggacgccgaggatccctggctctccgacgacgacctcacgcattcaacctgggagcaggacggcgtgcactatgcagaggtccgctccggcgacaccttggcggccagcggccgcgtctttgtggtgggggaaactgcggtgttcgacaagatcatcaccgaacccgctttccagcgccgcggcctgggcagtttcatcatgcgggccctggcagcccaggccttcgagcacgacgtgcaggagggacttctcctggcctccgcggatggccggaaactgtattcccacctcggctggaccaccgtttcccgtgtgctgatgctctccacctcccatgacggttctgatctttccctgagctgaccctcctgttacccccatggcgaaccggggccggcaaggccccggcgggtgaaacaatgtgggggtgaacccccatgactccctgattccgttgctgggccgcggcccggacccggaacaactccgtcatgtgcgcaccatcccggcccgcgaagccgagcatgagccgtggcccgcgtgggtgcaccccgacctggttgcggcgtacggatcgctgggcatccaggagccctaccggcaccaggtggaggcagcgggcatagcccacggcggcgagcacgttgtggtggccaccggaaccgcgtcagggaagtcgctggcgtatcagctgccggccctcgacgccatccaccgctccgaactgcgcgtcctggccgaccctgggaaaatccacgacgacggcgccgtcaccctctatctctcccccaccaaggccctggcggccgaccagctcaacgccatccgtgccctgaaactgcccaccgtgcgggcggaaacctacgacggcgataccgaccccgcgtcccgccgctggatcagggaccacgccaacttcatcctggccaacccggacatgctccacttcgggatccttcccaaccatgcttggtgggcagggttcttccgccgcctgcgctacgtgatcattgacgaggcccacagctaccggggcgtgttcggctcccacgtggccaacctgatgcgccggctgcgccggatctgcgcctactacggtgcgggcacggcccatccggggccggtgttcattgcagcctccgccacagcctcggagcctgacgtctccttcgcccgccttatcggtgcaccggtcaaggccgtgtcccgtgacggctccccgcacggttccaccaccgtcgctttctgggaacctgcgctgaccgaagtccggggcgagaacggcgccagggaacggcggacggcggtggcagaaaccgccgacctgctggcgaacctggtgtctgcgcgtatccgcaccatagcgttcatcaagtcccggcgcggggcggaaaccatctcctcgatcacgaaacgcctcttggatgaggtggatcccagcctgccgcagcgggtggccgcctaccgctccggatacctgcccgaagaacgccgtgcggtggaacgggcgctgcgctccggcgagctcctgggcgtttcgagcacctcagcgctggaactgggcattgatatctccggcctcgatgccgtactggtggcaggatggcccggcacccgggcttccctgttccaacagatcgggcgggccggaagggcgggccaggatgccgtcgcggccttcgttgccagcgatgaccccctggacaccttcctggtgaaccatcccgaagcgatcttcgacgtgtcagtggaagcgacggtcttcgacccctccaacccctacgtcctgggaccgcacctgtgcgccgcggctgcggagcttcccctgggacccgccgaactcggcctgttcggcgccaccgcggagtccctcctggacaggctggtggcacagggctacctccggcggcggcccgcgggctggttctggacacactcccagagcgcggcggccatggtgaacctgagggccgacggcggcgggccggtgagcatcgtggatgccgagaccgggtccctccttggcacgatggattccccgcagacgcactaccaggcccacaccggcgccgtctacatccaccagggtgacagctacgtggtggaggacctgaacgaggacgaccactgcgtgatggtgcgccgcgccaatcccgactactacaccaccgcccgggacgtgacccagattgaggtgctggcaacccaaaggacggcggaatggggtgacatctccgttcatttcggggacgtcaaagtgactacccaggttgtctccttccagcgcaaggccctcatttccaacgaaatccttggggaggagccgctggaactgggtgcccgcgaactcttcaccaaggccgtctggttcgtggtggacaaccgctccctcaccggggcgggcctgatcgaagcccagttccccggcgcgctgcacgcagcggagcatgcagccattggcctgctgcccctggtggcgtccagcgaccgctgggacatcggcggggtttccacggccctgcacgccgacaccggggcgcccaccatctttgtgtacgacgggcaccccggcggcgcgggttttgccgagcgcgggttcgacaaggcgaaggtctggctgacggccacccgcgacgccatcaaggcctgcgaatgtgattccgggtgcccttcctgcgtccagtcacctaaatgcgggaacaagaacaacccgctggacaaggcggccgccgtcaaactcctcgatgtcctgctcaagaacgccaccgaagccggctccccgggcctggaagtgcggctctgacctggactggctagggcggaggtcctgcacgggagcgcccgtgggcagccccgaataccgtccgttccaccagctcggtcctcacctcgacagtctggcctgtgccctccgtgcagctgacgactgcggctccgtgccgggcagccacctccgccgccacggtgcaggggtccccggaaacaaggccgcgaagggtgtcggccgctgccagcgccgcaaggtcggcagcggatgccgccctgctggccaggacggccgactgggccagcaacagcatcagcgccatggccgtcatcaccaccagggccaggccggccgccagcaccgtccccgagccgcgttccctgttggtgccaactgcacttccccttcggcctgaaccgagacgcctgaccaggttcgcccggagcccgcggcccgttccgggtgcctggcagcgcgtcatcccgccgtctcgctccgggtggaggcccgcgcagtcaggagccacgggacggatgcgccgaggggaccgcccacccggtctgtcacggtgacatgcagccactcgccgtcggccgataccgccgcggacgccgacccgccggacagggtccggacgatcctttccacagtggcggagtcgtcaccacgggcaagtgcgcgggcgccggcacgcgctccctcctccagccgcagctgcgtgaccccggcggaggcccccgccagcagcatggccagcagcagcaggaccgcgggcagggtgacggcaaactccgctgtcaccgcgccgcacgacctctgagccatgaggcctccggaaggactgccggcccgtcggtccggcccgccggtgcacccggtggcggactgcgtggcggcaaacggccccgcggcggacgcacctgtggcggtcggagctgtggcggtcggagctggtccggacggacccgtggccgggagcacggccggcgcccctctcatggcagggccaacgcggtgcggatcagggtgagcaggaagccacggacctcctcgctgcgaaggatgaagaccaggagcccggcaaagcccacagcggcaagggtggctatggcgtattcggcggttgccatccctgcctctgatccgaggagccgtacccggcctttgctggttagcggagagccggcacccggatacagttccacggcgtcggcaggcagcgggctgctgcccccggcgtggatgccatggcggccggtgctgcggtgttcccgaaagccggcacgggcagcggcgggcgccgcagctccgccagcgtagcggcggcggtaatgagtggacatgtggtgtttccttcctttgggccggtggtgttgccggctgttctgactcttccgggccttgcctggtgcggtaagccccgaggattcgtaagtggaaaagctcaacggttttcccttgtggaggagaagacgtgatgtctaggagccggaaggcaccagggccaggagtacaggaaccacgcccaggcagataaaggctggaagcgagcagaggcccagcggaaccaccagcttcacgcccagtgatgccgcgcgcttctctgctgcacggaacctctcccggcggagccgtgccgcctgcgcgtagagaatcgctgaagacggagctccggtcagcgccgcgaaccccagcgcgtcccggagttccaaaacctcggggagtcggaccgcgctgctgcgccatgcggtttcccagtcggccccgattgccagtgccgccacaaccggccgaagggcgccgccgtacttgtcagaagccgaggcagccaccagttcaagtgaacggccgatgcccgatccggcgtccagcatggcggccacaagttcgagcatcatggcggtgtccctcagcccttcggtcgcaggtccgggcagatgccctccgttaccggcggaggcctccgcgccgcagcacgaggcaccggaggccaaactgcgcagccgcttgcggggcctgccccgcccggttccggccaggactgccgctgccgccagggtgaggaagagcgcgagcgctgcggcggaaggcggggtcatggcgctccagcccctgctgccgcggccaccagccgggccgaccacaaccgcccggccactgtcaggccggctccggctgcaagtgctgcgagtccccagggtgttcccagcaggatggcgagcgggtccacgcccagcgcgattcccaggcccagacccatcagcggcagccaggttaggaggctgacggtggcctttggtccggcaagggccgtctggcgggctgcatcggcgtcatcctctacttcaagctgagcggcgaacctggtcagcacgtctgcgagcggacagccgcttgcttccgcgatatcgaagcaggccgcgagctccgaccagatgcgggactccctgtcccgccggggaaaagcggacggcgacgcccggcggatggcttccgaaacgggaatgccgcggcccgccgcagcacgcgcggcggccagcatggcaccggatcccgcggacaggccgtacgcattagggccggaagaaccgtagacctcccagatctcctcccagagccgcgccggtgtgcggccgcctttgagcagcgcggcgagttgctgcaccaccagcgtcatgggggccgcaggccgttctgctcccctcccggcgccacgcagctttcccgcaaagccgccccgtgagcgctcttttcgactcggaaccgggccggacgcgccggcgcggcgcaacctggcaggtgcacccagcggcgggctgacaagcagcaccgctgccagtcccagggacacgacaagaaggaagatcatgcgggcggtcccgggtgaagccccaaccgtgccgccagtgccgtccacccggggccggcggccactgcaccttcaacactttccaaggcaggctggacagtgagtccaccgggcccgtccccgatcaggcccacgcacgccactgcccggccccgttgcgtcctgtcaacgtggatgaccacgtccagcgcgctcgatgcctgaagcctcacgccgtcagggctcattccggcgagcgcaccgagcgcagtgagccgggcgggaacagcagcggcggtattcgcatggatggtcccgcccccgccgctgtgtccggtgttcatggcagtgagcagctcgcggacttcggcgccgcggcattcacccaccaccagcctgtccggccgcatgcgcaatgcctgccggacgagatcccccagatccacttcgccgccgccttccaggtttccgtggcgtgattcgagggacacggcatgcggatggacagggttcagttccgatgcatcctcgatgaggaccagccgctctgcggggctgcacaggccgagcagcgtggagagcagggtggtcttgccggacccggtggccccgctgatgaggaagctcagcctgcgctccaccacctgttccaggacggtctgcagtccggagttgaacatgccggcctcccgcagctcatccatcgtgaacacacgttcgcgccggatcctgatgctgagcagcgtcccggccgtagagacgggcggcagcacggcatggacacggtagcctccggccagccgcacgtccacgcagggtgagccatcatcaagccgcctgccgcctgccgccacgagccggcaggccaaagcccggagctgggtctcattgtcgaacgccacggtcacgcgctcgatgccgcggcccctgtccacccacacggaccctggagcattcacaaagatgtccgtaacggcagggtcccgggtgagggcctgcagcggccccagaccgttcaactcggcgctgatccgctccacggcggcaagtgaacccgccgtgcccaaaagcttccccgtggcctgcaccgcggccgccacccgcgagggcgtcaccgcggccgcgtccgacatcatggactcccgcacggactcaaggagccccaggtcaacagcctgccgctcacccgtgcggcgttcgcgccggcgccattcgccggggccgggctcacccgggcccccgccctcctggcggcgactgatttggcggggactttcctgccggggactttcctggcccgcgtccaggatccgcgcccgccgccggacccctgcctcgggtcccggtgccccagcacccgcctggtaactcattcaagctctcccgaagccagcccgtccccaaggagatccagcacggaagccgcgaaatgccggaccgcccgccgctttcccagctcaaggaggcggcccgattccatggccccagcgactccgcgcagctcaggcacccgcccctgaacgggaagtccgatggcctcggcgatcagggggccatccagcgctgcgccggccttgccacggaccaggagggcagcctcaaccgggggaaactcctggagcagccgcacggcggcgactgcagccttcagctgcgccggaaccaccatggcgatgcggtcgcagtcccaggcgaacgtatggatggggtccgctccccggccaatgtccaccaccaccagctcatacccgcggcgggcagcatcaaggatgcctgcggtggcggcagcggcgacgggtaccggctgctcccgggtggcaggccacgacaggaatgagaacccgcccgcaacaggcagcgagtccgcaagctggatgggatcgatgctgcccctggcctcggcgagatcgggccagcgcaggccggggttctcttcggcggccagggccagttccagcccgccgccccagggatcgccatccaccagcagcacccgggctccgagtccggctgccgcctgggcgatccaaatcgcagccgtggtggccccggctcccccgcagccgccggtcacgccaaggatcaccccgcctggaccgggtgaacgggaccggctgagatggtcggcgagccaggctgcagcatcgggcaggacggccacccgttctgcgccgagaacagctgcgagatgccacaggctgtcaccttcgccgtcgagtcccaccaggacggcgggggcccgccggcgcgggggcagctcccggatgtcgcttcccaccagcacggctgccgccgcgtcccaatgcctgcctccctctgcagcagtggctgcaacgcgcagctgcgccccggcagccgccacgatccgctccacctccgcacgaaggacagtggaggacgtcaccagcaggatgtcgtcaccaccgtccggcagccacgcgtccccgtcacctcccgcagcacccaccggcccgagggcaccaggccgcgagcgtccgggcggacctgccccgtccgggctgccgacaacatcagggtgggacgggtcagggtgggacgggatcagttggtgcctgctcatacagccactctccgcccctggaacacagcgggtaagtgctccagccccctatgtggaaaaccgggtcggcaaggccagcaagccgcaccgccgggcacagacaaccccggaaacaaggcagaatgggaccatgtacctgctgctcgccgcccacccccacggcgcggccctgcaggaactcacgcaggctggacagcccctgccggccacctcgaaaccccggctggtcagcaccggcgatcttcccgccgtcgtacgtgaactcgaaagccgccggccaaacgggcagcggccccgttggatctggcaccgcacccaggactggtacccggccctgctggcggccggcgtcgagctggagcggtgctacgacctgagcctctgcggcaacatcctggcgttttcccggttcaccgagcacaccgactacgccaggaacgcggaacgggtggtggttgaggacccgctccagtcgcccaggacactgcagccgccgcctccccccgcagaccagggtgccctgttcgatgctccggggatccggccggaaacccggcgcggcccggaagaacttcgtgctgaatacgccgcccagcaggtggccctggcatcggtcagtccggaagagaaccggcgcagccgcctgcagctgctgctggcggccgagtccgccggcgccatgatcgccgccgagatgcagcacgccggcgtcccctggcgcgaagacctgcacgggcagatcctcgccaaccacctcggcccgcgcccgcccatgggccagcgccccgccaagcttgaagcactgaaccaggaactgcgcgggctcctgaactcacccacgctgaatccggactccccgcaggacctgatgcgcgccctgcaccgcaacgggatcgaggtcaaaaccaccaggaagtgggagctgagggaatccacccaccccgccatcgagccgttgctcgcctacaagcagctctcccgcctgcatacagccaacggctgggcctggcttgacgcctgggtggacggcggccggttccggcccgagtacgtggtgggcggtgtggtttccggccgctgggcctcgcgcggcggcggtgcccttcaaataccgcgccagatccgcggcgcagtccatgccgatccgggctacaagctcatcgtcgctgatgcctcccagctggagccgcgcgtcctggtggccctcgcccgtgacccttccatggcagaatccgcccggaaccaggacctctacgcgggcattgctgccaagggattcggcggggaccgggcgaaagcgaagatggcattactgggggccatgtacggcgccacctccggcgaggccggccgcctcatgccgcagctcgccaagacttttccccgggctgtggactttgttgagcaggcggcgcgcaccggcgaggccggcggaacggtgaccacccgcctgggacggagcagcccgccgccgtcggagcggtggttccagagccagcggtccgcctctgccgaggagcagcggcgggcagagtcgatcgcccgttcgcggggtcgcttcacccgcaattttgttgtccagggttcggctgcggactgggcggcgtgctggctggcggaattacgacggcggctgcgcaccctccggagcgacggtcacgtcaacgctgaactcgtcttcttcctgcatgacgaggtgatggtgcatgcgccggcggaggcggtggacgcctgcatcgccgccattgaagaggcggccagcgctgccaaggagctgctgtttgggcccatcccggtggagtttcccgtcagtgtggcggttgttgattcctacgacaacgcgaagtagccgccagcggcgacccccgaagtaacctacccaggagtagctcgccaggggcttgcggcgcgggctatggtcgatatggcgactgaggcagatcggtcaaaagctgatgcaacgacgcattccaggggaggtccggcttatggcgggcaagttcgaaattcatcgagtaggcgacgagtcgtaccggctgcggctcacagacgcagagggcaacacggttgccgtttcacccaagttcaagtccctcactacagtgcttgagggcgtcaaggcagtccgtgagaacgccgccaccggaattgtggtggatctccgccagcagcaggcctgaggctagacgcccatcgggtggagccggctccggtcccacggaacggcccagcccagctgttcgaacagcccgttcaggacaattccggtaaagccccacaccaccacaccgttcactgtgaagcctgggctgtcgaagctgcgcccggcacggtggacggttgccatcacgcggttgtccgggtccagcagatcacggacgggtacccggaacacctgggccgactcggcatagtccaccacacggacaggtgacggcgagcgccaccagcccagcaccggggtcaccaggaagttgctgtgggcgagccccagctcctgcagggtgccgaggacctccacgccgcctgaatcgagcccggtttcttcttcggcctcgcgcaaagctgcctgaaccggcgtttcccgggcgtcaatggtgccgcccgggaacgccacctgccccgggtgggaacccagggtgtgggcgcgctccagcaggaggacgtcaagatcggccggcgccagcggcttgcccgatacagccgggacgtcgtcaagggtgccaaagagcatcagcaccgccgccttcctggcctgttcggcatccaccgtcagggctgcccagagcggatccggcgcggcagccgttccggactccgcccggcgtgccaggtgcagcaggtcctcgcgcgcgctcacggtgtcctctgctgggatgccatccggatttcggcggcccggtgggtctcggccagcaactgctccagcagcgcttcgctgccgggcgcgagctcgtacttcaagagcttggctgccttcgcggggtctgtttcgcccagcccgaagctggggcaccaggtggccacggggcaggccccacaggcgggcttccgcgcgtggcatacccgccgcccgtggaagattacccggtgggacagcatggtccagtccttgcggtcgaacagctcggccacatcatgctcgatctggacgggatcgtccgactgcgtccagccgaagcggttggccagccgggcgaagtgggtgtccaccgagatgccggggatgccgaagccgttgccgagcaccacgttggccgttttgcgtcccacaccgggcagcgtcaccaggtcctccagccggcccgggaccaccccgttgtattcgtccaccaggcgggtgcacagggcaatgacgttcctggatttggtgcggaagaacccggtgggcttgaggatcgtttcaaggtccgcgggatccgcctcggccagggcccgcgcgtccgggtagcgggcgaacaacaccctggtgacctggttgaccgtgacgtccgtggtctgggccgaaaggaccgtggccacgagcagttcgaacgggttgcggaaatcaagctccgcgtgggcgtacgggtatttctccgccagggccctgttgatccgccgtgcccgccttttcagtgccagcacggattcggaggacaccaccggcatgccggctacctggccggcggatgccttggctccgccggccctgggagcccgggcctcgcccacggaggtcagccgcgctcgatattgctgaggtcccgcaggacacccagccgcccgtcagtgtgctggaccaggaactcgtggccacggtcctcgagcgccaggacccagccgccgggctcgataacgaacgcaggggcccccgtgcgcgggtcataggcggtgcggtgctgcgcgacggcaaaccagaaagcctcgtgaatgggctgttcttccgattcatccggacgggttgaggggtccaccgtggcgccgatgggctcctcggtacggacctgctggtgcactgcggtggcaggcgtcggctcccagccgctccgcgcgccctgcgcggaggaggcagcgccctggccggacggggcagccggatgcgtgccgccgtcgtggtttcctgcggcgtcgtgatgcgctgtggcagcagctgaactggcgccggcgactgccggaacatcccccagccgggtctcctcagcggcaggcgttgaggaggggcgtacgacgtcggccgcctgggttgcggggcccgggtcgcctccgggagtccagtcggatacctcgggagccgtggagacaggcgaagcggcagtggggacggctgccgtggcaggggcaggggccgccgcgctttgcgcagcggaacgggactgtgccggtgaacctggctgacccgctgaaacctgctgttccgcaggctccggcttgaccgcggaagatcctgcgccggcaccgcccagaagctttccgccagacaacatcttggagccgaactttggctcttttgagcccggggcggtctctaccttcggcttcttgggggcgcggggtttctggatgggaacagcggcctcacgcgccaccacgtgggcgggcacttcggcacggtcctgaaaatcactggacagatacggcaggaaacggcccagcactgttgccgcgaagaggaccagggagccgatcaggcccaccaggaggctgggtacgtaggcgcccgctacggagacaaaaaagaaggccacggcaaaggacgcaaccactgatgcgaactggtcgatggacagggagccgatccggatcttcgtggccggggacagcctgcgggctgcaaagagcgcgctgacgatcaggggcaggacgatgcccagccccaggaagaactggttgttaaggttccacaggttgtaccgggcgccgaagatcggcagcagggaggcaacaaaaaggatcagcgtgccgccgaagacggtcaggtcgcggatggtgaacggacccagcactgcctcgttggcgttggaggccttgcctgcggcgggggccttgcccgcggcggcctgggagccttgcccttcagcggtcccggtactgtggccggaacccgccgtatcggggccggtcttctggccgtagctttgctggttcattctgctctccttagcgtggcggcaccgggacctgtgtggtcccgacatcgtgccgtcttgacagcggttccggtttggccaggcccttgtggtgcctggccaaaacggtccgccgtgaagtcacaattccatcccagcctagtcaagggccaggccgatcactagctggccacgcaccgcgggggcgggagaaagctgccctggaaaaccattcaccgcttaataaatgccgttcacgggctgccatgtgacaccgcacacatcgccgccaggcaaagcattagtcttgattccggaacagctctttgcggaatgtccgtgaccagccggtgcccgacgtcgtgcaggcggcggagcccggccggcggcggacatcccgcccagcaaagatcgatgaatgatgaggttcacatgtcccaggacactacaagcgccgtcgtagacgcttccgcaagcacagggcagcccgggtcagccaagggagccgggcagggcgatgcctttgaaaacctgcttcatgagacccgcaagtttgcgccttcacccgagttcgctgctgacgccgtcgtcaccgccgcggagtatgaggacgccaacgcagaccgtcccgcgttctgggcgaagaaggcccgtgagctgctgacctggaacaaggactttgaccaggcactggactggtccaacccgccgttcgccaaatggttcgtcggcggggaggtcaacgccgcgtacaacgcgctggaccggcacgtggaaaacggcctgggcgaccgggtggccatctacttcgagggcgaacccggagacaccagcacctacacctatgcgcagctgaccgaggaagtgaagaaggccgccaacgccttcgagtccctcggcgtggccaagggcgaccgcgttgccgtgtacctgcccatgatccccgaggccgtcatcaccctcctggcctgcgcccggatcggtgccgtgcactccgtggtgttcggcggcttctcctccgaagccctgcgctcacggatcgatgatgccgaagccaagctcgtggtcaccgcggacggcacgtaccggcgcggcaagcccagcgccctgaagcccgccgtcgatgaagcgttggcccacaagggagatggagacggccacacggtccagaacgttgtggtggtcaagcgcaacggccaggatgtggactggcatgagggccgggaccactggtgggccgacaccgtgggcgccgcatccgcggagcacaccgccgtgggccacgattccgagcacccgctgttcatcctctacacctccggcaccaccggaaagcccaagggcatcctgcacaccaccggcgggtacctcacccagaccgcgtacacgcacagggcggtcttcgacctgcaccccgaaacggacgtgtactggtgcacggccgacgtcggctgggtcaccggccactcctacgtcgcctacgcgccgctcgtcaacggcgccacccaggtgatgtacgagggcactccggattccccgcaccagggccgctggtgggagatcatcgagaagtacaaggtctccatcctctacaccgcccccaccgcgatccggacgttcatgaagtggggcagggagatcccggacaagtacgatctgtcctcactccgggtccttggatccgtgggcgaatccatcaaccccgaggcctggatgtggtaccggaaggtcatcggcggagacaagacccccatcgtggacacctggtggcagaccgagaccggcgcgcagatgatcgcgccgctccccggggttaccgccaccaagccgggctcggcccaggtcccgcttccaggcatcgccgtggacgttgtggacgagatgggcgaatccgtgcccaacggccacggcggcttcctggtgatccgggagccctggccggccatgctccgtggcatctggggtgatcccgaacgcttcaaggacacttactggtcccggttcgagaccatgtatttcgccggggacggcgctaagaaggacgaggacggcgacatctggctcctgggccgggtggatgacgtcatgaacatctccggacaccgcctctccaccaccgaaatcgagtccgcactggtgtcccaccccgccgtggccgaggccgccgtggtgggcgcggcggacgaaaccaccggccaggccgtcgtcgcgttcgtcatcctccgcggggacgccgtggattccggggacgccatcgtccaggaactccggaaccacgtgggcaaggagatcgggcccatcgccaagccgaaggccatcctggtggtcccggaactgcccaagacccgctccggcaagattatgcgccgcctgctcaaggacgtcgccgaaggccgcgacccgggtgacgccaccaccctgtcggacccgaccatcatgcagcagatcgcagcgtccctccgtaaataaacccgaggaggactttgcgacggcgacgcctggctcacagccgggcgtcgccgtcgtcgtatgctgggagcagactcatcccctgcctaaaggatcgccctgatgctcgccgtcgcccgccaccaggccattttggacgctctccaacgggagcgggttgtccgggtctccgacctggcccagcagctgggtgtgtccctgatgactgtccgccgcgacatcgaggtgctggaggaaggcggccgcctggagcgcatccacggcggcgcgaaaatcccgggcgacaccagcactcatgagcccggattcgacctcaagtcgacgcagctgacggcggagaaacgcgccatcgcggtggaggcggcctcgctggtgcaggagggcatggccgtggggctcagcgccggaaccaccacctgggcactggccaaggagctggtgaacggcccgcagatcacggtggtcaccaactcggtccgcatcgcagacctcttccaccacgcggcgtcggccggctccgcccggtacgcctccacggtgatcctcattggcggagagcgcacgccctccgacgccctggtgggccccatcgccaccggcgcgctcaagcagctgcacctggacgtcctgttcctgggcgtccacgggatggacgccgacgccggcttcaccacacccaacctgcttgaagcggaaacggaccgggccttcgtggctgcggcgcgcaagaccgtggtcctcgccgaccacacgaagtggggcatgctgggcatcagttccatcgcgtcgctggacgaggtggatgaggtcatcagcgattccgggctgggtgccgaggcgcagcgcgtcctccaggaacaggtgggcaggctgcggctcgcagccgtgtaggaggcgttcctaggggcagccgcaggactggcggacatgcagcgtggtggggaagatccggtgccggggcttctcgccgcggctggctcccacaagcgctgccaccgccgcttccgccattgcggccacaggttgctccaccgtagtcagcggaggccaggagtattcggactcggcagaaccatcaaaggaagcaacggccatctggcccgggacggacagcccggcttcatggaccgcacggagcaggccgatggcttgcatgtccgaggtggcaaagatggccgtgggccggttgactgacgccagcaggcgctgccccgcggtgtagccgccgggacgggtgaaggcgctgtacacgatcggcccctcgggcaggcccgcctcctgcagggcctcccgccagcccacttcacggccatcagtggcgccggagacgttggtgcccatggcgaggccgatgttggtgtggccgtggccgatcaggtgttccacggcgatccgggcaccggctgcgaggtccacgccgatgctgttgaatccgggggcgtcccgttcctggttgagcaggaccgaggggatctcggccgtttccaggacttccaggtcgggttcgaaaaggacactggccagcagcacgccgtccacctgcctggcggcgaggttgcggatattgcgccgctccttggccaggtttccgtccgagttgcccagcaccagtgcgtatcccagggcggcggcggcgtcctcgacggcgtgggagaacagggcgaagaacgggttggagatatccgggaccacgaggcccagcgtctcgctggagcccagtttgagcgcccgggccgcagcattggggcggtagcccaggacgcggatggcgtcctgcaccttggcctcggtggcgggcgccaccttcttgggcccgccgttgacaacgtaactgacgacggcggtgctgacgccggcgtacctcgccacgtccttgcgtgtcaccgggccccgcgaagcctgcactgccggagtagtcatgctgttcatgttacgtactggcacccggtgcatcgccaaagtcacggatgggaagccgttcgccgttttgcagggcggactggtgtgccacgatcccgggaagggtgaagcgggccgccacccaggcgttcaccggaggcagggtgccattgttgaccgctgtcacgaagtcgtccaccaggaaatggtggctgccctcgtggccgttgggcgcgcccaggaactcctccggcagccgcccgggatcatggaccggggccaggccggagacgaaggcgtccctcagctccggtgcaacgttcgcgagggaggggtcatcgagggagatgctgggccgggtttccatctgctcggagacgtcatggacgttgtgcttgtcctgccatacggagacctttgccagctgttcaaagctggcgtccgtaccgaagaaccggaagcgcgattcgcggatgtgtgaggggtagccaacccggcgcatctcgttggtgcgcatcacgccgccgtcgttcagttcaaagagggcggtggcgttggagaaatcgttcccgaacatgctgacgtccttgtcaaagacgccgtcgttgcggtcatccttgacgcccacgcagctgacgctcacagcatgggcggggacggcacccagtacacctcccacggcgtgggtggggtacagcatgggcgggtagctggctgtttccttccaccgctcccctccgctgtactggtaggcctcgtagaagcccaggtccatgtcatggacgtagtcgccttcggcgtagaagatgcggccgaacttcccgtcagcgagctgcttgcgggcataaaccgtggccgggttgtagtagctggtctcacccatcatgtacaccagtccggtgtcacggacggcctggatgatccgggcgatttcctcctctgagacggccatggggacggctgagtagacgtgcttgccggcacggagcgcccgctccacaagggggccgtgcgtccagcgctgcgtgaagatggccactgcgtccacgtctgagtccaggagcgcgtcgaaactgtcttccacgcccgcaaggccgtaccgggccacggcctctgccgcccgctccggaagctcgtcggccacatacacctcgctgacgccagggtggaggttgaacaggtgggcgaactggctgccgaactggccggctcctactacaccgagtgaaaacgtcattgtttgccttccgttgggccggtttggggtcgccgggcaagcgctgtcctccaggaactccagtgttccacccgtatctactcgagtcaacaggccagcgaatggataaaagggctggattacagagcgaaagtaatctcttgcccttccaaatctactcgtgtagattacagcgcagttgttacccccatcacagtcaggaaagggtcgaagatgaccacccttgccaaacactccaggtccgcctccgcggcttcggcctccccgaagccgcagggaagccaccgccgcctcggtgacctcaagatcgcactgctgttcatcgcaccggcaatgatcgggttcgtctttttctacgtcctgcccaccgtccggggcatctacctcagcttcacggaatacaacatcctcggcgacccggaatgggtcggcatggacaactacgttgccatcgccgctgacccgctgttctggaactcgctggccgtcaccggacagtacgtgttcctcaacatcctcctccagacggccctcgccctgggcctggccctcctgatgcacaatgtggccaagtccaccatcatccggggcaccctgctcctgccgtacctgatgtccaacgtcatcgccgccctgctgtggttctggatgctggactaccagatcggcgtggtgaaccagttcatcgagtggagcgggctgccccgcgtcgcgttcttcggcagcgaggcgtgggccattcccacccaggcgctgatcaatacctggcgccacatgggctacacggccctgctgatcttcgccgggctccaggccatccccagccacgtctacgaagtggccaaactggacggcgcgtcagcgttccagaccttccggaaaatcaccattccactgctgcgcccggtccttgtcctggtcctcgtggtgaccgtcatcggctccttccaggtcttcgacaccgtggccgtgaccacggcgggcggcccggtcaacgccacccgcgtcatccagtactacatctaccagcgggccttcaccgagtcggacttcggctacggatccgccatcgccgtcattctcttcctcatcctcgccctggtggccttcatccagatgaagttcctcaagggcaacgagtcggacctggactaaggagtcccgcatgagcaccaccgcacgccgcgcaccgctgccggccgcaacccgccgccgtcgtcctttcaacgcccgccgcgccggcgcctgggcactcctcgtcctggccatcgcagtctcggtccttcccttcctttgggtcctgcgcacggccctgtccaccaacaacgcgctggcctcgaacgccaccagcctgctgccggcggagttcaccctaggcgccttcaaacgggtcttcgggctgcagtccccggcggaggccgtggccgaaggcggatccggcgccgccatcgacttctggctctacctgcgcaactcgatcatcttctcctcgatcaccaccgccggcgccgtcttcttcagcgcaatggccgcctacgccttctcccggctgcgctggaagggccgcaacgccgtcttcagcctgttcctcggcaccatgctggtcccgccgatcttcacggcactgccgaacttcctgctcatcaagaacctggacctgctcaacaccatgctcggcctggtcctgccatacgtgttcatgacccccttcgccatcttcttcctccggcagttcttcctgaacatgtcacgcgaggtggaggaggcggccatgctcgacggcgccaagcacctgaggatcttcttccagatcgtgctgcccaacgccgcagcccccatcgccacgctggcgctcctcaccttcatcggccagtggaacgaatacttctggcccctgctggtggcgtcgcaggacgatgtccgcgtcctgcaggtaggcctcggcgtcttcaagtcccagtccccgcagggggcaccggactggtccgggctgatggccgcaaccctcatctcggccctcccggtactgatcctcttcgccgccttcggcaagaagatcgtcaactccattggcttctccggcatcaaataagcaatccccacccatcgcatcccagcgaactccaccccgaacggaaagtagaaccatgaagaaatccctcggcgccgttgccgtcgccgcagctatggcactctccctctctgcctgcagcggatcctcctcctccgaagaaagcgccacgggcgagatcagctactggctgtgggacgccaaccagctgcccgcctaccagcagtgcgccgacgacttcgcccaggcgaacccggacatcacggtcaagatcacccagcgcggctgggacgactactggagcaccctcaccaacggctttgttggcggcaccgctccggacgtcttcaccaaccacctgggacgctacggcgaactggctgagaacaaacagctcctggccatcgacgaggccgtcgaaaaggacaacatcgatctctccgcctacaacgagggcctcgcggacctctgggtgggccaggacggcaagcgctacggtctgcccaaggactgggacaccatcggcctgttctacaacaaggcaatgctcagcagcgccggcatcaccgaggaccagatgaaggacctcacctggaaccccgaggacggcggcagctacgagaaggtcatcgcccacctgaccgtggacaagaacggcaagcgcggcgatgagccaggcttcgacaagaacaacgtggacgtctacggcctgggcctgaacggcggcggcgactcctccggccagaccgaatggagctacctcaccaacaccaccggctggtcccacacggacaagaacccgtggggcaccacgtacaactacgacgatcccaaattccaggaaagcatggactggttcgcggggctggcggacaagggctacatgcccaagcttgagaccaccgtcggcgcgagcatggccgacaccttcgctgccggcaagtccgccatcaacgcgcacggctcctggatgatcggccagtacaccggctacaagggcatcgaggtgggcatcgcccccaccccggtgggccccgagggcgagcgtgcctccatgttcaacggcctggcggattccatctgggccggaaccgagaagaaggacgccgccatcaagtgggttgagtacctcgcctcggccgactgccaggacgtcgtagcctcccaggccgtagtgttccccgcactcaaggcgtcctcggacaaggcagccgttgccttccaggccaagggtgttgacgtcaccgcgttcaccgagcacgtcaagaacaagaccacgttcctgtaccccatcacggacaacaccgccaaggtcaagggcatcatggagccggccatggacgccgtcgtctccggcaaggcacccgccagctcgctgacccaggccaacgaacaggtcaacgccctcttcaagtaggccctgttcaagtaggccctgccccaaaccgtggctgcgtttgtggtcgcagccactgggctggatgccgccgtcccctcctcgcggcggcggcatccagccccctcccctggcttgaagcgaatacgacgctccagcgccttcagacgtacagcacaacgacgaaagagatttcccctatggaccccctccacctccgttccgccgggaccagcctggtgatcagcttcgacagcggagaggccgaggtggtccactggggcgcagatctgggcgcggacctgccggacctggccatcctcaccgccccggtcccgcactccgccatcgacgcacgcgtccccgcagccctcctcccccaggcgtcatcctcctggcgcggccgggctgccctgcgcggctcccggacggccgacggcgtctccgggctggatttctcggcccgcctccgcgttgtgacagcaggcgccaacggcggctccgcagtcattgtccagtcggacccggacgccggtctcacggtggaatccaccctcacccttcacgacggcgggctgctggagatgcggcacaccgtcaccaatgacggcacctcgccgtaccgcctcgacgaactggcgaccgtcctccctgtggcgccggacgccgtcgaactccttgacctcaccggccgctggtgccgggaacggcacccgcagcgccgcgccatccagcagggcacctgggtgcggacaggccggcacgggcgcaccggacacgactcctccctcctgttcgccgccggcaccaccggtttcggcaaccggcacggcaaggtctgggccacccacctggcctggagcggcaaccacgaacagttcgcggacaccatcggcgacggccggaccatgatcggcggctcagaactcctgggccccgccgaggtcatcctcgaacccggcggcagctacaccacaccggcactgttcgccgcctactccgaccatggcctggacgggatcaccgaggccttctacagctggttccggtcccgcccgcaccacgtgctgcctgctgcttccaccggcctgcccgccgggaagccccgccccgttgtgctcaacacctgggaggccgtgtacttcgaccacaacctggacacgctgatcgagctggctgagtccgctgccgaccttggcgttgagcgcttcgtgctcgacgacggctggttccgcggccgccgggacgaccacgccggcctcggcgactggtacgtcgacgagaccctgtggcccagggggctgaccccgctgatcgaggccgtgacctcccggggcatggagttcgggctctgggtggagccggaaatggtcaacctggattccgatatcgcacgggcgcacccggactggattgttggtccgtcagcggtgcaacacaaagacggcggccggctgcccctggaatggcggaaccagcacatcatcgacctggtcaaccctgaggcgtggcagtacatctacagccgcatcgacgcgctcctgagcgagaacaacatcagctacctcaaatgggaccagaaccgggacctgctggagcacggccatgccggacgctcctccgtccacgagcagaccctcgccgcgtacaggctgttcgacgagctccgcacggcccaccccggcgtcgagattgaatcctgctcgtccggcggagcgcgcgtggacctgggcatcctggaacgcaccgaccggatctgggggtcggactgcaacgacgcactggagcggcagaccatccagcgctggaccggcgcagtggtcccgccggagctggtgggcagccacatcggccccaccacctcgcacaccaccgcccgcacccacgacctctccttccgtgccatcaccgcgctgttcggccactttggcatggagtgggacatccgcggcgtccagggcaaggaccgggaggagctcaagcgcttcatcgccctgttcaaggaacaccgcggcctcctccacagcggccgccgcgtccacgcggacgtggccggtgacgccctgctgctgcacggcgtcgtcaccgatgcacccgccagtgccggcacgacggcgggcctgttcgccctggtcagcacccgcacctccgcagcggaggagccgggcaggatcggcattcccgggctggaggcggcgcgcaagtaccgggtggaggcagtgttccccactcccgaagatgccgactacggccacacctacacgcaggtgcagccgccggcgtggctggctgacggggcagtggccaacgggcgcttcctggccgaggtgggcctgcccatgcccaacctcaaccccgagcacgcgctgctgatgaagttcaccgccctctaggcccccaggccaggagttccaggcaggggtgccgcgcattgcgtaagaatgcgcggcacccagcgccagccgatagattgtcatccatgactgacgcctccacagactctgccgccggccgcaccatcctggtgatcaacgggccaaacctgaacctgctgggcactcgggaaccggaaaaatatggcaccgcaacgttggccgacgtggagcagctggccgccgcagccgctgaggcccacggcttcacggccgaatgcgtccagtccaaccacgaaggcgtcctgctcgacgtcatccacgccgcccggagcaacgccgcgggcatcgtcatcaatgcgggcgcttttacccacacctccgtggccctccgggacgcccttgccgccgttcagcttcccgccgtcgaggttcacatcaccaatgtgcaccagcgcgaagaattccggcaccattcatacctctctcccgtctgctctgcggtcattgtgggcgcaggcgttgtggggtaccggttggcgattgactacctcgcagaggtcctctaaaccgctacttctggatgcactgcccggaggacaccggcgcggacagggacgccgcctgcgatgccacgggagtgaggtcgtccatggtgatggcgaatcccatttccgtatccgccgttgccttcgcgaaaatcactcctgccacctggccgtccatggtgagcagcggcccgcccgaattccccggctgcacgtccccggccagccggtagatctccgcgggggacgcgttgttgccgtagatgtccggcaccagcacggtggtgatgtcctggaccgtggcgggcttggactggaacgggccgccgtgggggtagccggcgaaggcggccggactgccgccgggcaggtcccggctcagcgacagcggactcgcctgcaggccgtccacagccagcaccgcaaggtcgtgttttgtatcgaagtagacaacacgccctggcatcgcgccgccgtcgggcatttccactaccggctgcgacacgcccgccacaacatgcgcgttggtgaccaccctgtcctgggacaccacaaaccccgtacccgtctggttctggccgcactggtacgcggtcccggcgatccggagcaccgactccgcggcccggttcagcgcgggagtgtccgtgctcgcgttcggcaccggcactgccggcccctgttccaggccctccagcagcgtggggatgccgttgccgatcacggtggagcgcagttgcgccatggtggctttgacggggacgggcgttaatccgtcgatgaagcggatgaccttggactcggccagctgctgcgacacgaacggcacacccagggagctgacactgaaggccagcatcgacatcaccagcgcggacaccaccacgttcacggctccgcccaccaggcggtccaccgcccggaggggccggatccgcacggcgccgcggatttgccgccctgccatcgtccccaggccatggcccaggaccaccagcacgacggcggccgccacgatggcggtcagcctccaaccggagtcctcaacgaagccgctcaccagggggaccgcgaagaaggctgcgacggccccggccgcaaaccctgcgatgccgcccgccgtcaccaggaaaccgttgcgcagcccgtaaaccaggtatgacagcagcgccaggatcaggatcaggtccaggacagtcaagccgaccactaaggctccttattaagcagttggatccccattctagtggcggtcactgacagtattctggacagcccacccctcctggcaggcctcccaacgtcgccttcccctccgcctccaagccgcccttgcgacgtcctgtgacgcctccggcggtgacgtcacagccccggatcagggcgtttcgcctgccaagttcgtcacagaaccttgaaaattctgaaacaatggcacaagcgccacagccgacacttttattcaggagatttcatggacatcgaggtactgcgccgagcaccccttttcgccacgctcgacgacgacgcattccgtctgctgacggacgagctcaccgaggtggacctgtcccgcggcgcttcggtgttccgcgagggcgaccagggtgaccagctctacttcatcgtctccggcaaggtgaagctcggcaggacgtctcctgacggccgggaatccctcctggcaatcctcggcccgggtgaactcttcggcgagatggccctcttcgacccgagcccccgcaccgccacagcaaccgcagtgtccgagacccggctggccggcctcaagaacgagagcctcaacacgctgctccgcacccgccccgaggtttcagcgcagctcctgcaggccctggcccgccggctccgccgcaccaacgattccctgtccgacctcgtcttctccgacgttccgggccgcgtagccaaggcactcctggacctcgcggaccgcttcggccgccccgcaacggacggcgtcctggttgcccacgagctcacccaggaagagctggcccagctggttggcgcctcccgcgaaaccgtcaacaaggccctcgccgagttcgtccagcgcggctggctgcggctggaagcccgcgccgtcgtcatcctggacatgcagcgcctccgccagcgctcccgctaattccacagcacgaaaggctgcccccgtgaactgttcacggaggcggcctttctgcgataacgcctggcctctcccccgcgccctctctcacttcctgcagcctttcccgtaacgctctctcacttgatgcgggcttccccggaacgctctctcgttatcctgcatcaagtgagtgagcgtccgcgcagaaccgacatcaaatgagtgagcgtccgcgcagaaccgacatcaagtgagagagcgtcggggacgggaagtcgccagcaccgacaaatctagcgttcgcgctgggggtcgtcggcggttgtcttggcggcctccacctcaagcatgagcttgccgtcttcttcaaccaggacgggctggtacacgtgggccttgcgcttgtagctgaggtacgcgatgcagccattggccgcggccatcttttcgagcatgatctcagagccggggacgaggagctcccccaaggtacggcccactgtgttctcctggcccacttcgtcacccagcgctgtggtgtcgcgttcggcgatgacatccgcggcattaacccaacggccccatacgcctttgccctccaacagggtgggctgctggttaagggggacggtggcggcaaagtagcgggtgtcgaaccggcggtgggcaaaatcgggactgcgccagttgaccagggacttgagcaggtccgtccggacggaaagcccccgcttggccagaacttccgggaaggtcttctcctgctcggcaacggcaacgcgggcgcgcatccactccggcgttgacgtcgcttcgacggtgccggccatgtcaggcccggccagcagcaggccggtttcctcaaagagctcgcggatggcgcccagcacgtggcgccgcgccagcccgacgtcgtccgttcccatctgctcagcccaatgctgtggtgacgggcccagccaggggacgggatcgtcgtcggccgcgtccagcgagccgccgggaaacgccaggacgcccagcggcgaggaccccggccggtacgccagccaggtctccaggccggttggggaatcccgcagcagcactaccgaggatgcaaggcgtgctgcccgcggggtccgttcgccatgttcgagccagctctgagccgccccttcaaggtcctggggaagggcgaagagccgtcgggcgaggtgaggcaagggaaacgaccggtcctagctaaattcggcgatcagttcgacctcgacgggagagtcgagtggcaggacggagacgccaacggcggaacgtgcgtgctggccggcgtcaccgagaacgcgtcccagcagttccgaggctccgttgatgacgccgggctggccggtgaaggaaggatcggacgagacgaatcccacaaccttgacgatgcgggtgatccggtcaaggtcaccgatgacgcttttgacggctgccagggcgttgacggcgcaaatggccgcgaaccgctgtgcgtcctcgggtgaaacggtgggctcgtcggcgtaaccttcggtccctgccgagactttgcctgttgccgggagtttgccgttaataaagggcagctgtccggacgtgtacacgtggctgccggagaccactgccggaacgtaagcggccacaggcgcagccacctccggaagggtaagccccaggtctgcgagccgctgctcaacagcggaaaccggcgcgtcagccgcgccgggctgggcctgtgcggaggtgctcatgctactgcttctccctcttgaggtaggcaaccaggccgtttccgtcgggtccggggacaacctggaccagctcccagccgtcgtctccccactggtcgagaatctgctttgtagcgtgaataatgagcggaatcgtggcgtactcccatttggtcatgagagaaagactagtccttgccggtaaagtggaaaacatggcgactcgtacgaacccattattcgacactgccaccaccctcggaaaaatcctcgttttccttggcgtgagtgcgatctgcggtgtcctggtagcaggcctgctggttcccgccgcggccgtttcaggcagcgcagccagcggttcgatcgagttcttcgacacccttccggatgagctgaaggttgatccgcccaaccagaccaccaggatcctggctgcggacggcagcgagatcgcgagcgtctacaaggagaaccgcaccaaggttgccctggaccagatctcgccgttcatgaaggaagcggtcatcgccgtcgaggacagccggttctacgagcatggcggcgtggacaccacgggtatcctgcgtgcgctggtcagcacggcgcgcggcaacaggcagggtgcctccaccatcacccagcagtacgtgaataacgtcctcaactcaaacctcgccgccgagggcagggacgaggacatcaagctcaacggcgtgaacaagggcgtgggcgacaagctccgcgagatgaagctcgccattgccttggagaaggagttcagcaaggagcagatccttgagggctacctgaacatcgtgttcttcaaccgcgacgcctacggcatcgaagctgcgtccaggttcttcttcagcaccaccgccaaggacctcacccttccgcaggcagctctgctggccggcctggtcaacagcccgtccgcattcgaccccattgccaatccggagaacgccaagcagcgccgcgacctggtgctgagcctgatgctgaaccagggcaagatcacgcaggcagattacgacgccgccgtcgccactcccgtggaaaccaacgtcacgccagcccggcagggctgcgcctacgcgtccaccgccccgtacttctgcgactacgtgctgcacctgctggaaaacaaccctgcatatggtgcagaccgcgaggaacgacttcgcctcatctacggtggcggcctgaccatcaccaccacgcttgacccgaacgctcaggctgtggcccaggagcaggtcaacgcctccgccggcgccaacccggacaagtggggagctgccctggtttccgtgcagcccaattccggcaagatcgtttcgatggcccagaacacttccttccttccggctgagggtgccttcgactcgcaggtgaacttcaacgtggacaagctggacaaggacggcaacgacctcaacggcctgggcggcgcgcagcccggctccaccatgaagccgttcaccttcgcgcagtggcttgaggagggcaagtccatgaacaccgtggtcaatgccgcccaacgccgctacccgctgaacttcaagtggcgcaactcctgcggccaggtaacgggcgcctacaacacagccgaaaagtcactcggcgccgctgacgacctgcagaacgcggaaccccagtggtaccggccgctgtccgtcctcgaaggcctgtacaactccatcaacaccgtcaccttcgcttcggcggcacagctggacttctgcggaatccagaagattgtggatgcaactggccttcatggtggactccccgctgacggcgatcccaacccgaagatcaacatgtccacgctgggcaacctgctggggtccacccagacggctccgctgaccatggccagcgccttcgccaccttcgccaacgacggaaagtactgcgagccgatcgcaatcaccgcggtcactgaccagaccggggccaccctgccggcacagtccagcagctgccgggacgccatcaaacccgaggttgcacgcggcgtgaactatgcccttcaggaagtgctgaaccgtggctccggcgccctgatccagccccgcatctccacccggaccagcttccccatcggcgccaagaccggaacctcgaacaacaacggttccacgtgggttgtcggccacaccacgggcctggcaacagctgcctggtttggtgacgcgcttggtgcccaggaccgctccggccagaacatcaccgtaaacggaaagttctaccccggcattgacggttacatgattgccgggccaatgttctcgaacttcatgtcccggattgcgcccgcattcggcaccgaaccgttccctgctccgcccagctccatggtgaacggcggcggtaatacccgcacccccgccaccacggcgccgcgcacaacccaggcaccccaggctccggcaacccagccgcctgccccctcagccccagccgcacctgccgccaccgaacctgccccgcccccgaccaacagcggcaacgggaatggcaacggaaacggaaacggctagccgcggatgacgtcgaccaacacgttggccggccgcgcccggactatcggacgcggccttgccgtcactgcaggggccggcgctgccgccggggcagcggccttcgggtatggcttgtgggagaaggaccagttcgtcctccgcgaggaaaccctggccatcctgccgcccgggcatgacccgttccgcatccttcacctgagcgatatccacttcatcaccggccagaagaagaaggcggcgtggcttcggtcgctggctgacctcaagccggacctggtggccaacaccggcgacaacctcagccaccccaaagccgtggaccccctcctggccgccctgcggccgctgatggacttccctggcgttttcgttccaggctccaatgattacttcgcgccgagcccgaagaatcccgccctgtacctgctggggccctccaaggtgaagcccaagcccaaggtgcttgactggccccggctgcgctcaggttttggcatggccggctggatggacctgaccaaccgccaccagtccttggtgctaaacggcatccgcttcgatttctccggcgtggacgatccccacctgaagcgcgaaaagtacgccggctggccccgtggaaccgtgaaccaggacgccgcagaccacctcaaagtggctgtcatccacgcgccctaccagcgggtgctggaccacttcaccgaggacggcgcagacctcctgctcgccggccacacgcacgggggccagatatgcatcccgggctacggcgcgctggtggccaactgcgaccttcccacgtggcgggcaaaaggacttaatgactggcagagcaacggaagtacgacgccggtcaacgtgtccggcggcatcggcacctcccgcttcgccccggtaaggatcgcctgcaaacccgaggcagtcctgctgaccctcacttcgcccagctaatatcgcatcgcgtgcagcatcatgctgcattgcagaacgcaataactggccaagccctttatcgcgcctaaattcctgtgaaccgcctcacgtccatggcatagggtagttgctaagggaaactacattcgttttagagcttgagaagcgggcatggccaagcaatcttcattttttcgatcgatcagccgtctctacccccatgtccggcccatcattccacggctcctgctgggactcgtgtgtgcgctgctggccagtatcgttgcactggcgatcccccaggtcctgcgggtgctggtcaacgagtcgctgcggccgggcggcgccaccggggccatctgggtttcggccggcatcatcctggtcctgggcatagctgaggcaggactggtggcactccgccgccagttcgtgatcaatccggccaccacagtggaaacccggatgcgtgtgtcgctctacgaccatctgcaggagctcacggtctccttccacgaccgctggggctcaggccagctcctgtcccgtgccatgacggacctcaacttcctgcgccgctggatggcgtttggcgccatcatgctggtggtcaccacgctcaccgtgattatcggcattgccgttatgttcgccatgagctggcagcttgccctgatcttcctggccgcggccgtgcccatcatggcgtacagcttccggttccgcacccgcttcagcaaggtggcccgccgcagccaggaccaggccggcgacctggccaccacggtggaggaatcagtgcacggcatccgtgtgctcaaggccttcggccgcagccgggaagcactcgaaaacttcgaggaacaagccgaagaactgcggcaaacagagatcgacaaagcgcgccaccaggccatgttcaccatggtggtcacgctcttgccggaacttgcgctgggggcaggcctggtggtgggcatcatgctctgcgccagcgggcaactgagcatcggcgcgttggtggcgttctttgccacggcggccgtcattgcctcacccgtggagttctccggcatgctgctggccatggcactcactgccaagaccgccgtcgaccgccactacgaagtcatggattccgccaacaccatcaccagtcccccggaaccccgcctgccgcgccagctcgcgggcgccctcgaattccacaacgccaccttcgcctacgaggatgccccggacaaacccatcctggagaacgtcagcctggatgtccggcccggtgaaaccatggccctcgtgggaatcacgggcagcggcaagagcgcgctgatccagctggtgccccggctgtatgacgttaccgatggatccatcagcatcgacggcgtggacctgcgcgacttcgacgtgccggagctgcgccgcatcgtggcggtggctttcgaggacaccaccctgttctccaactccgtccgggacaatgtgctgctcggcgccccggtccgcagcgacgccgtcctggaggaagcgctcgatgttgcccaggcacacttcgcgtactccctgccgcagggcctggacaccctgataggcgaggaaggcctgagcctgtccggcgggcagcgccagcggatcgccctggcccgtgccatcgcggcccggccccgcgtgctggtgctggatgaccctctctccgcccttgacgtccacacggaggaactggtggaaacccggctccgagccgtactgaaggacaccaccaccctgatcgtcgcgcacaggccgtccacagtggcccttgcagaccgggtggcgctgcttgaagaaggccggatcaccgccgtcggaacccacacggaactgctggcgggcaacgaccattaccgctatgtgattgcgagcctggaccaggaaccccgggacctggactcggagctctcggacctcaaggaagaagcaaatatccaggaagcggaggtcacccgatgagcaccgcctccttcggcactgccaatgaagacaacgcgcacctcagcaagagtgagagcagggccgtccgacggcggtcactggcactcctgcggtcactgatccgccccgtgcggctccggttctggctgaccatcgccatggtggtcctctcacaggcagcaagggtggctggtccggcgctgatcgcctttggcatcgaccgtgccctgcctgccctgcaggccggggacaacgcacccctggtgttcaccggcgccgcctacctcctggctgccattgcgacggcggggctcacggctttgtacgtcacctccaccgcgaggctcagccaggccatgctgctggacctgcgcctgcgggtcttccgccagacccaggggctgagcctcgagttccacgaaaagtacacgtcgggccggatcatcgcccggcagacctccgacttggaagccctccgcgaactcctggactccggcgtcagctcgctggcgtcaggcatgctcttcatggtcttcaccgccatcaccgtgtttgccctggactggcggagcggcctgctggtgctggccgccggcgtgcccatgttcttcctggcccgctggtaccagaagcactcccagatcgccttccgcgaatccagggtggtgtccgcccggctcattgtgcacttcgtggaaaccatgaccggcatccgcgcagtcaaggccttccgcaaggagcaggaaaactccggccggtacggccagctcgctgaggactaccggcgggtcaccgtccgctccatcaacctcaacggcatcttccagccgggcctggtcctgatcggcaacgtctgcgtgtccgtggtcctgctctttggcggcttccgcgtcctgggcggtgacctggaggtcggggtgctgctggcgctcatcctttccaccaagcgtttcttccagccggtggaccagatggccatgttctacaactccttccagagcgcgcaggccgcgcttgagaaggtgtcggggctcctggaggaggtcccgacggtccggccgcccaagagccccgtggccctgaagcaggccaagggagccatcgacttcaacggcgtggagttccgctacggcgacggcccgctgattgtccccaccctggacctccacattcccgcgggccagactgttgccctggtgggacagacgggtgccggcaagtccacgctggcgaagctgatagcacgcttctacgacgtctccgccggttccctaacgctcgacggcgtcgacgtccgccacctgggcaccacggaccttcgccgcaacattgtgatggttacccaggaggcattcctgttcagcggctcggtggcggacaacatcgccctgggccggccggaggcttcccgggcggagatcgaggaagcggccaaagcggtaggcgcccatgacttcatcatggaacttccggaaggttacgacaccgacgtcaacaagcgcggcggacgcgtctcgtcagggcaacggcagctcatcagtttcgcccgggcgttcctggcccgtccagccgtgctgatcctggacgaggcaacgtcctccctggacatcccgtccgagaggctggtgcagcagggcctggcgcggctcctgacgggcacggaagcggcccgcaggacggcgctcatcattgcccaccggctgtccacggtggagaccgctgacagggtgctggtggtccacgacggccggatcgtggaggacggcagcccggccgaactcattggcggcggcggccgctttgcggacctgcatggtgcctggaaggactcgctggtctgattccgtccgggatttcgcatcgggacccggtatcggctatccttgtaaagttgcttttgcagcggatcgggatgtagcgcagcttggtagcgcgcttcgttcgggacgaagaggtcgcaggttcaaatcctgtcatcccgaccaaacaagaaagagggtctccttgcggaggccctcttttttgttaaagggaatggccccgaagcctgcgctccggggccaccctcgcctccatggtgaggaagctattacatcgggtcgggccagttgcctacgtacgtggtgtacgaggtatccgtgcccttgtccttggtcttcttggacatcgggtcaggccagtttcccacggctaccgaagttccggcagggtccccgagggaaccggcagacaggacagctggagccgcagcagaaaaagcaagggcgcctgccagtacggccgcggttgcgatcttcttcaacataaataggttcctcaatacgagtcggattcgttacaaagccagcactgtccttgttgacatacattgtaaaatgttttccacagggactgtcaagcattttgtacgaagaccgtccggaaaaggaggaaaacccgtgggcaacggattcggggagaagctccgtgcggagcgtctcgaacgggggctgacacaggcggaactgggaaaggacctgtattcccccagctatatttcactacttgagaccggccgcagggaacctacggcggaggtcatcgaggaacttgcacgcaggctggaactggcacccaaggcgctggaggcttggagccagcccatctcagtgagcgatgccgaatacgtcctcgccgggttgtacgcccggcaggcgtgggacctgagggactaccagctcgcggcaagccatgccgccacagctgccaagatagccctcgaaggcaggaacacgagcgcctggtggaacatgacgtacatgcaggcggagtgcctcatcaagcagggcaactggcaggaatgccagcgcatcatgcagcacctgctggagcaccccatggccacggaatcagcaggcctcgctgtacgggcccgccagatgctcgccggcatctcccagggccagggccagctgagcgcagcggtggaccacgccatggaggccgtgcggctgtgttcccagctgccgaagggttccacgctcatcattggtgcccaccgggcactgatcggcgcacttgccgaaagcgggcggctcgacgaagcctggaaatactgccaggcgatgatcgaccacgtggatgagcactccatgtcccagctcgccggcgaagtggcgtgggtgatcggcaacgtggccttcatgcggcacgactaccaggagggaataaagcaccacgaacgggcagcccggctgctctcccctgccaacgacatcgaactgtgggcacggttcaacaaagcctcggcggccgttcgcctgtcctccgggatcgttgagccggagacactgtcatcgatcgaacgggccgagctggccctgtccatcgtgggtggcaacaagtccgaccagctggaggtcgccttcatacgcgcccgctggctgtacctgaccggggacattgttgccgccgtcgagaagctccgcgaaatccatgcggaacgcgccagcctggcaaagcacaccgccggtgaagtctcgctcctgctgggcaagtccctgaaggccgcgggcgaatccgacgaagccctggtgcacctcgaggaggcccagaaagccttcagtgcggcaggagcggctgaccgcgtccagcaggcaatggacgcggtcctggaaataaagctggcccagcagcgcgccgcggccgctgccaaagccagctagcacaacaccatccgccgggagcagctggggctccgtcaggcgaaggctttccccgtaagtctctcgtaggcctcgacgtagcggccgcgggtacggtccacaacctcgttgggcagcgccggtggcggcgtatccgaggacctgtcccagcctgattcagcagacgtcagccaatcgcgcacatactgtttgtcgtaggacggctgtgcctggcccggctggtaggtggcggcatcccagaaacgtgaagaatccggcgtcagcacctcatcccccagggtgatgagccccgagacggggtcatagccaaattcgacctttgtgtccgccaggatgattccccgctcacgggtaattttctcagcggtgctgtagatcttgagcgtcagctcgctcaggcgtccggcgatgtcgtcgccaaccatggccaccacggcgtcgtaggggatgttttcgtcatgctcgcccacctcggccttggcggacggcgtgaagatcgcgtggtccagtcgcgacccgtcaaccaggccctccggcagcggaatgttgcacacggtccccgacgccttatattcctgcaggccggagcctgtgaggtagccccgggcgatacattccaccgggaacatgtccagcttcttgcagatcatggcccggccctccacctcggccgggacgccgtcttccaccgtggagcccaggacgtggtggtccacgtccaactggtcgaaccaccagaggctgagctgggtcaggatgcgtcccttgtccggaatcagggaggacaggacgtggtcaaaggcgctgatccggtcgctggccaccaccagcacgcagtcctggcccatacgctgcaggatggcctcgtcagccggctcgtagaggtccctgaccttgcctgagtagacgtgtgtccatccgggaaggtcgagggtcttggtgttgaaaccgcggggtgctggatcgttgctcatgtcaggccttcgtcttggtcccgtggagggatgcgctggcagtggaggggacctttatttccccgcgggcggcttttccgccaatgtcggtgcggaactgcgagccttcaagctggaccagctccacgccgtcgtacgctttttcccgcgcgtccaccaggtcgctgccgagggcgacgacggcgagcacgcgcccgcctgcggacaccactttgccgtcctcgtcgaaggcagtgccggcgtggatgacgtggacgccttcgagctcctccaccttcttgagcccgcggatgcggtccccggtgcggggggtgtcggggtagttttcggatgcgacgacgacggcgacggcagtttccctggcccaccgcagctcttctgccttgtctagttcacccctggcggctgccagcagcagggcgccgagcggggtcttgagccgtgcgagcacggcctgtgtttccggatcgccgaagcggacattgaactcgatgacgcgggtgccgcgggaggtgagggccagccccacgaacagcacgccgacgaacggggtgccgcggcgggccatctcgttaacggtgggctgggccacgcgttcaatgacttcctggaccaggccttcaggtgcccactcaagcggagtgtaggcacccatgccaccggtgttgggtccctcgtcgttgtcgaagatccgtttgaagtcctgggcgggtgaaagggccacggtgttgtggccgtcgcagaggacgaacagcgaaacctcgggaccgtccaggaactcctcgatcaccacggagccgccggcgtcgaaacaggactgggcgtgggccagggcttccccgcggtccttggtgaccacgacgccctttcctgcggcgagcccgtcatccttcaccacgtagggtgccccgaaggtgtccagggccgattcggcttcctcggcgttagtggccaccatggccatggccgtgggcactcccgcttccgccatgatttccttggcgaacgccttggacgcttccagctgggctgctgccttgctgggaccgaacacggggatgccggcctcgcggacggcgtcggacacgccggctgccagcggcgcttcggggccaaccaccaccaggtccaccgtcagcctggttgccagtgcggcgacggcgccgggatcgttgccgtcgatcttgtgggtggggaccagtttgctgataccggcgttaccgggagctgcgtggacctcggacacgttggggtcggcgagcagggagcggacaatggcgtgttcgcggcctccggggccaatgacgagtaccttcacagtctccaagggtactttgtgcaccctgcgtgctcctaagctgtgtcaccgccaatgccgcgggggcgcccccgcgacaatcccggaccctgtccgctccgaatacccgtcatggagaagctgaagaactggttccggggacccactgctatggcggcgctggcaggcgtggtggcggccgccgtcgtccttgccgtggccgagctgctcggggccttcttcaccgcccgggccacgccgctgatcgccctgggatcaactttcatcgacttcaccccgtcgtggctgaaggacttcgccatcgccacgttcggcaccaatgacaagattgccctcttcgcgggcatgggcgtgaccatcaccctgctggcgtgcgtgctgggcgtggtggcccaccgcagatgggcgctgggtgtccttggcgtcctgttcatgggtgccgtcatcgtggccagcgtggcgacccgtgccggcgtcggggcctttgaagctctgccgtcagtggccggaaccctggccggccttctggtgctgcggttcctgatcaaaaacctgccggcaaccaaggcttggccggaagcgccggccggcagcgccgtcgctgatgaccctgacgtggtggccgcgccgggcacgacgccccgcgccgcaaccagccgccgtcgttttttcgccgctgccggaattaccgctgccgctgccggcgtggccgcaacaggtggccggatgctgggcgcggcccgcagtaatatcctccaggcgcgggatgccctgcaactgcccgcggccgccaaggcggcgccggctgttcctgccggcgtccagtctcccgtgcccggggtgacgccgtgggtgacgccaaacggcgacttctaccgcatcgacaccgcactcagcgtgccggaaatcgacgtggcggactgggaactccgggtccacggcatggttgaggaggaaatccggctcacgttccaggacctgctcgacgccgacctgatcgagtcccatgtgacgctcacctgcgtgtccaaccccgtgggcggcaacctcgccggcaacgccaaatggctggggttccccctccgcgaggtactcaagcgcgcacggcccaaggacggcgcggacatggtgctctccacctccatcgacggcttcagcgcctcaacgcccctggaggtcctgcaggacgaccgggacgcaatgctggccatcggcatgaacggcgagccgctcccgctggagcacggctatcccgtgcggatggtggtccccggcctgtacggatttgtctccgccaccaagtgggtggtggacctggaggtcacccggttcgccgacagcaaggcgtactggacggaacggggctggtccgaacgcggccccatcaagaccatggccagggtggacgtgcccaagtccttcgccaaggtaccagccgggaaggttgccgtgggcggcaccgcctgggcacagacccggggcatcaccaaagtggaaatccaggtggacgacggcaactggacggaggccgagctttccacggaagcgtcgctggtcacctggcggcaatggtcctaccagtgggacgccgcccccgggcagcattacatcaaggtccgggccaccgacggcaccggcgaggtgcagacagaccagcgcgcggaccccgtgcccgacggcgcatccggctggcagtccgtgatggtcaccgtggagtaacgcggcattcaggaaggcgccccatagactggcaccatgccccacaacccccatgccacctttaccgtggactccgccgtggaactggccgtcgtcgaacgcagcggttttgtggaatcccggcacatcggatccgccgtcctcctggcggcggacggatccgtggtcaccgagctgggcgacatcaacacgcccatcctggccaggtccactctcaagccgttccaggccctggcgtccatgcagtcaggcgtcccgctgaggggcgcccaggtggctgttgcctgcggaagccacaccggttcactggaccacatggacgtggtggcaggaatgctcaaagccgccggagtccgtgaggaccagctgcagtgcccggaggcgtggccccaggacgagacggcccggaactggctggtgcgttcggaaaaagggaagtcgcgactggcgttcaactgctcgggcaagcacgcggcgttcctctgggcctgcacggaaaacggctgggacacgcacagctacctggaacccaaccacccgctgcagcagcgcgtccgcaccgtggtggaggaatacacgggcgagaaaattgcgcatctgggcatcgacggctgcggcgcaccggtagccgcggtatccctcaagggacttgcccgggggtactcgcagctggccaaggcaccgggcgaccaaagcttcagcgcccgtgccgccaccatcgccacctccatgctggactacccctgggcggtccaaggcatcggcgaggccaacacgctggtgatggatgagctggagattatcgccaagatcggagctgagggcgtgctggccatggccacagcgcagggagtctccgtggccgtgaagattctggacggaaacgtgcgtgccacctccctggtggccctgaccctcctggctgcggcaggcgcggtggacatccccgctgttgccggcgtcctggagagggtggttgatcccgtgctcggcggcggccggccggtgggaaagatccggcttgggccggcagtatccgcgcttctggactagtttctggactagcctttgttcgggcaggctggcctcacacgtgctggtccacgatgaccgggttgccgtccgggtcaacaacaatgaagctcgccggtccggttgttccttcttccgcttggcggacgaaactgacaccttggccctgcagttcccgctggaggtcacggacatccgtgaaggactccagcggctgggcgtcctggtcccagccggggttgaaggtcagggcgttcctctccagcatcccctggaagaggcccaccaccgcctggccgtttttcaggattagccagttctgcgcgatgtcaccggcaaaacgcgtgaacccaagtttttcgtagaaagccgttgaagcggcgatgtccttgacgttgaggcttactgagaaagcgccgagctgcacgggccgttcccctcccttgtgacgagtgctaccgatcgtactcccccacccaattccttcctgttaggcatccgcggtactctgattgcctttgccgctgcatccccacgaaaggggccccgaaaacatggctgtagcccgtcgccggatcgacccgaaggaaggcgccgcagcggtggaggcgtggcgtaaagccgccggaccgtcgtcggacgttcccgtcccgcgacccatcctggcaactgcggtgcgctacacgcttgaggaagtcacagcgcgggcgccgggaaattcggtggaggtaagggtgccgccgttcggcgtcacccagtgcgtagaaggcccgcggcacactcgcggcacgccgccaaacgtcattgagtgcgacgccgccacctggcttgcgatggtcacaggccagttgggctgggcagacgcggtggccgcacacaaagtcgctgcctccggcctccgcgcggacctctcagcgctgctcccgctctaacccccgagttttgggtcagccgcggccgatgaagggcatgcctgcggcgctgatgaccacagatccgacgctggccgacggcggcatgttggccatcatcaggactgcccgcgcggcgtcctccacggggaaggtgggttccacccggcggctgccgtcagcctgcagcgcccccgcacccacgccgatggtgtccatgatgtccgtggccgtgttgccgatatcgatctgcccgcacgtgatcccaaagccccgcccgtccagctcaatgcttttggtcaggccggtcatggcgtgcttggtgacggcataggccacggtccggggccggggcgagtgcgcggagatggagccgttgttgatgatccgcccgccctgcgggtcctgcgccttcatggcccggaccgcggcggcggcgcacagcatggaacccgtcaggttcaccgcgagggtgtcgttccagtcccccagcgaaatttcgtccacgctggctgccgggccaaacacgcccgcgttgttgaacaggacgtccacccggccccaccggcggcggacggcgtcgaaaagatgctcgacgtcgtcctgccgggtgacgtcacacggcaccaccagcgcttcggcgtgactgtccgccgtctcctttaactgcgcttcccggcggcccgccagcgctacccggtatccggcggccagcatctgccgggccacctcccgcccgatgccggaacctgctccggtaacgacggcaacccgcgcggcggaaggggtattgttcacgctgttctccttgggatgtggtgctaaagggccgccgtcacgcccgtgctgttcagcggccagcctatgacggtcttgggccgcggcgcagcgtaggtccgcaccttggaggtggacaggcgcatgcggaccagggattccgcgatggccacggcggaggccacgccgtccaccacgggcactccggccctcagcctgatctgctcgtccagtcctgccattccgccgcaaccgagcacaatcacctcggccttgtcctggctgacggcaagcatcgcctggttgatgatggcttccactgcgcgctccggctcctcctcaagttcaaggacggccatgccgctggcccggaccgaggcgcagcgcgcgtcgagtccggcgagcttgagccggtcctcgatgagcggaacggtccggtccagggtggtgaccaccgagtacttgtggcccaggaacatggcggtgctggcggcggcctcggtgatgtccaccaccgggacgtccaggagctcctgcagcccttcccgtccgtgctcgccatagccggcctgcacaacggcgtcgaacggctcctggtaggaggtgacggcgtccatcacggcgatggcggccaggtagctttcgaagttcccttcgcaggagtcggccccgaaccggggtgtaatccccacgatctccgtgccgggtgccgcgatgctgcgtgccgaagcggcgatggaatccgtcatggaccgggtggtgttgacgttcgcaacgagtatgcgcatcaggggatccttagtgtttgctggcgacggcgaaggcctcgccgtcgcggtcttcgagccgctgcgagcggtccgcgatgaagaagtacacaactgctgcgatgccggcggcgaagaaccaggcaaacggtgctgccgccgccagcgccgggacgaaggcgatgaggagtgccaggacggcggccggcaccatggcgatgatggccctggggttgacgccgttcttgtagtagtaggcaccttcgggcgatgcggtgtacagctcggggacattgaccttgccacggcggatcagccagtaatcagccatgacgacgccgaagagggggccgagcagggcgccgaggccgcccaggaagtacacgatcaccagcgggttgttgtagaggttccacggcaggatcaccaggccgatgacggcgctgacgaaggcagccttgcggaagtccaggtgtttggggaacaggttggtgagggcatagaccggagccacgaagttggccatgaggttgaccgcgatggtcaggatcagcagggccaggcacgccaggacaaggaagagcgtgttggggatggtctggacgatgtccgaggggctctcgatgatggtgccgttgatcttgaactgccctcccgccatcacgacgacgatggcgccgaacacgagcatgttgatgggaatgccccagaagtttccgcggaccacggccttcttggagacggcggagcgggtgaagtcgcagaaattcaggacgaacgtgccgtagatggagacccagagggcgccgccggcgaagatggtcagccacatttccggcccttcaagggcgttgtccgaggaccaagcgattgcgccgccggcttccatgaagatccagacggcgatggcggccatggtgaccaggatgatcgggcctgcgaaggcctcatacttgcgtatcatttccatgccgaagctcacgatgaccagctggacaacccagaggatgacgaacgcgatccaccccagggtggacagccccaggatggagtccttgtccagtgctccgaggcccgggaacatggccacgagcatcacgcggaagacgaccgatgcgaggtaggtctggatgccgaaccatgctacggcgactgcgccgcggagcaggctggcgatctgggcgccgcggataccgaagctgatcctgctcatcaccgggaaggggacaccggttttgacgcccatgaatccggagagattcaggaggccgaaaagcagggcagctccgatgccgagtgccagcaggatctgccagccgcccagtcccagggcgaacagtccgatggcgaaggcgtagttgccgaggctgtggacatcgttggcccagagggtgaagatgctgtagccggaccagctccggccggcgcgtttggtgggggcaagatcgacgttgtaaagggtggggctgatggcctggccggaagctgcgctggctgattcacaaagagcttcgacgcctgtggcggagtgggctgaagagtctgacggcactgtcagctcaggagccttttcgacgccgaccgggggaggggtctgcatggggatctccggttcttgaaggattcgcagtggtgagcgctggtcggggtgaccggttctgttattccacattgcgaaaagtagatattgctaagtggaataagagtatgacctgggtcaccccgcggtcaaggatttcaaggggctaaagcagtcacaatcggttcgcaggcaccgacgttccgcacgcgcggtcggggcgccggttgtgcttgaccccacttccgcggactcgctaatctcgtatagcaataatgttttctcacaatacgaaaacatgagcccagcattcaaagacgaaaagaggctgacgtggctgcaggagaagatacctcccatatcctcagcgggttgactaaccagctgcctgatcgtgatccggaagagactgccgagtgggttgagtccctggattcgttgatcagggaacagggcactgagcgtgcccaattcatcatgcggagcctgctgcagcgcgcgggcgcgcagagcgtcggggtgccgatggtgaccaccaccgattacgtgaacacgatcccggtggaccaggaagccgaattccccgggaacgaggagtacgagcgccggtaccgggcgtatatgcggtggaacgccgcggtgatggtccaccgggcgcagcgggcgaacatcggcgtgggcgggcatatctccacctacgccggcgccgcgaccctgtacgaggtgggcttcaaccacttcttccgcggcaaggaccaccccggcggcggtgaccaggtcttcttccagggccacgcctcccccggcatgtacgcccgggccttcatggaaggccggctttcggaggaggacctggacgggttccggcaggaaaagtccaaggaaggccacgcgctgtcctcctaccctcacccacggctgatgccgcacttctgggagttccccaccgtgtccatgggcatcgggccgatgaacgcgatctaccaggcccagtccaaccggtacctgcacaaccggggcctgaaagacacttctgaccagcaggtctgggcgttcctgggcgacggggaaatggacgagcccgagtcccgcggcctgctccagctcgcagcgaacgagaacctggacaacctgaacttcgtgatcaactgcaacctccagcgcctggacgggcccgtgcgcggcaacggcaagatcatgcaggaactcgaagcgttcttccgcggcgcgggctggaacgtcatcaaggtcgtctggggccgggaatgggatgacctgctcaccaaggacaccgacgggtcgctggtgaagatcatgaacgaaacccccgacggtgactaccagacctacaaggcagaatccggcgggttcgtccgcgaacacttcttcgggaaggacccggccaccaaggacctcgtcgcggacctcaccgatgaccagatctggaacctcaaacgcggcggccacgactaccgcaaggtctacgccgcgtacaaggcagccaccgaattcaagggcaaacccaccgtcatcctcgccaaaaccgtcaagggctacggcctcggaccgcggtttgaagggcggaatgccacgcaccagatgaagaagctgacggtcgaggatctgaaggagttccgggactacctgcggatacccattaccgatacgcaacttgaagcggatccctattccccgccgtactaccaccccgggcatgatgcaccggagatcgtgtacctccatgaacggcggaaggccctgggcggcgccgtccctgaacgccgggcatcccatgatgccgttgcgctgccagatcccaggacgtttgacgttgccaaacgcggctcgggcaagcagcaggccgccaccaccatggcttttgtcaggctcttgaaagacctcatcagggacaagaacttcgggcaccggattgtgcctatcgtcccggacgaatcaaggaccttcgggatggacgcgttcttccccaccgcgaagatctacaaccccaagggccagaactacctctccgtggaccgcgacctcgtcctggcctacaaggaatccgcccagggccagctgatccaccccggcatcaacgaagccggcgccgtggcagcgttcaccgccgccggcaccgcctacgccacccacggcgtgcccctggtcccggtctacgtgttctactccatgttcggcttccagcgcaccggcgacgcgttctgggccgcagcagaccagatgacccgcggcttcatcatcggcgccaccgcaggacggaccaccctcaccggcgaaggactccagcacgccgacggccactcccccctgctcgcctccaccaaccccgccgtcgtcacctacgaccccgcctacggctacgaaatgggccacatcatccgcgacggcctcgaacgcatgtacggggaggccgcaagcggcgaaggaaccggagctgcatccgataaaaacctgatgtattacctcaccgtgtacaacgagccgatcacccagcccgccgaacccgaggaactggacgtcgagggcgtcatcaagggcatctacctgctcgccccggcgaaggccgaaggactgagggaaaacagcccccgcacccagatcctggcctccggcgtgtccgtcccctgggccctcgaagcccagcggatcctcgccgaagactggtcagtctccgccgacgtctggtccgtgacctcctggaacgaactgcgccgcgacggactcgccgccgaagaggaagccttcctcaaacccggcgaacccgcccgcgtccccttcatcacccagcaactcgaaggagccaccggccccgtcgtcgccgtgtccgactacatgaaagccgtccccgaccagatccgccaattcgtccccaacgaattcgccaccctcggcgccgacggcttcggcttctccgacacccgcgcagcagcccgccgcttcttcaagaacgacacccactccatcgtggtgaaagcgctgcaaatgctcgcggcgaggggcgatgtcgaggagggggcgccgtcgtacgccatggaccgctacaaactcctggacgtcacagccggaaccaccggcgcgaccggcggcgacgcctgacacaacaagagttcttgtccagatatgcaggcttcagggcctcgcaaccctgcatatctggacaaaaactccattgggctagcggctgatcacacctgcctccagcaactccgccaggccctgcttgaaaccggacctcccgccgtgggcgggatggcggaccttgggcgcgtccacgccgctggacagcaggctgcggtgcgcgatgttccctacggcaaccactgcctcaatcccgagaagttcaaccaaccactgccaaaacggtgtacccagccttgcttcggtgatccgcggcgtccggttggactgcggcttcccgggcacatgggtatgccacgggcaggcgctccacagcaggggcaggaaatccagttccgccaggacttcccacatcaccgttgccgttggctcggcagccactccctccgcctcagcaggcagggcataccctttgcccggcccgaacagtccaaaactgttggccggtccctggaacatggtgcggttggtaaaaggcacaccggtaatccgcatgcccctgaatccgggggcctcgcccagcagcagcaccttcggcgagcggtccagcatctcggagaggtaaagctccaggttgtgccggcgctgcgcgtttgccgcgatgctgtgatcaaggaagttgttgcgcccgtcatcggacggcaccgccgcaagccgctccacgaaagagctcatggaacgttctgtcaccggagtgctacccagcaaacggctaccagcgcgggtggatggactcgcggaagtagtggtcgtagatccagcggacgcctgcgtcgaactcttcgccgacctgcacggacgcagccgctgcgttggccgttgcctggtccacgttacgcgcgccggggattaccgtggtgacgccgtcctgggccgcgatccaggcgatggccgcctgggctgtggtggcgccggaaggaacaagctgctcgaactcggccacggccttcagcccgagctcgtagtccacgccggagaaggtctctccgacgtcgaacgagtcaccgctgcggttgtaattccggtggtcattctccgcgaacgtggtttccttcgagtacttgccggacaggaggccggaagcgagcggcacccgggcgatgatgccaacattggctgccttcgcggcgggaagaacttcgtccaggggcttgagccggaaggcattgaggatgatctggacggaggcggtgcccccatggcggatcgcttccagtgcctcgtccgtgcgctccacgctgacgccgtagttgcggatggcgccctcggaaaccagggtgtccaaggcgtcgtacacctcggagttgctgtacaccggggtgggcgggcagtgcagctggaccaggtccagggtgtcggtgcccaggttcttacgggaccggtccacccatttgcggaagttggccagggtgtagttttccggctgctggtccatgcgccggcccatcttggtggcaaccgtgatatccagcccggggttgtccgcgaggaacttcccgatggcctgctcgctcttgccgtccccgtacacgtccgcggtgtcgaagaagttcacgccggcctccgcggacgccgccaggatggcctgggcctgtgccgggtcaacgttgccccagtccgcgccaagctgccaggtgccgagtcccacgacggagacgttacgtccggtcttgcctaaaatccgctgttccatccctcgactatatggggtgcctcatgggaggccggaattccatggccccacagctgcccgaacatccattcggatactgaaaaattacttccaccctgatgtgtaagcttaatcacactgaggtacgtggtggacattccggcggtgatcgcgggtacatttcccagcaccagagggtttggttggcgcgtcggtctggttcgtacggggagcgtgaagcatggacggcattgaggtattcgtcaacgggcaggcaagggactgcagcacggccggaccccacacaagccttcttgattggctgcggggtgaaggcctgacgggcgcaaaggagggctgtgccgaaggcgaatgcggggcgtgtgccgtcttggtggccaggcctgacggaccccggggaagccgctggacatcccttaattcctgcctgccacccgccctggcattcgacggtcaggagatcatcacggccgagggcctgggtaccgtggccgggccctgttcggttgaaaaccttcatcccgtccagcgtgaaatggcggaccggggcggttcccagtgcggctattgcactccgggattcatctgctccatggcggcagagtattaccgtccggacaggagccccgggcaggctcacaaggccacgggtaccggcgccgtcggcgaacagcatgctaccgatcacgaatgcggtccgaatggtttcgacctgcacgcgctcagcggcaacctctgccggtgcaccggctaccgccccatcagggacgcagcctatgcactcgggaccccgcagaacgcagaccccctaatggagcggcagaaccggcccgcgccgcccaccaagtacaccggatctggaagcagtgcacagttccgtcgcccaaagacgctggctgaagcactgcgggtgacgcaggagaacccggaggcaaagctggtagcaggggcaacagacctcggcgtggaggtaaaccttcggcactcccggccgcccctgctccttgccatcgaccggctggaggagctgcggactttagcgttcgacgacggccgggttgagatcggcgcagccctcaccctttccgaggtggaacggggcctcgacggccgggtgcccctcctggcgcagctgtttccccagtttgcgtcccgcctgatccgtaacgcagccaccttgggcgggaacctttccacgggctcaccgatcggcgactccgcgccggcgctcctggccctggacgccacagttgtcctgtgctcgctcgacggcgagcgcgaagttccgctgtccgggtactacacggggtaccggcagagcgtcaagaagccccacgaactgctccgcgcagtgcggatcccgctgccactggccgaaagcaccgcgttctataagatctccaagcggcgcttcgacgacatctcaagtgtctcggttgccatcgcgctgcaggtggcagacggcgtcgtagattcggtccgaatcggcctaggcggcgtggcagccacgccgatccgggccttcgctacggaagaatccttgacgggccagccctggaacgcggcaaccgcagccaccgcggcagccactatggccggggagggaactcctatcgacgacatgcgcgccagtgcactgtaccggcaggccatgttggggcaggccctgctcaagttccatgcaggcaacgcgccggcactggaggcagcaaagtgaaatccctggcagaccgtcccgtcaacgccgtggtgggggtcccggtatcccacgagagcgcagccgcccacgtgaccgggacagccctgtacaccgatgacctcttagtccggtcccggaatgtcctgcatgcctggcctgtccaggcgccgcacgcccatgcccggatcatcggcatggacacccgggccgcactcaaggttcccggcgtggtgaaggtgctgactgcgtcggacgttcccggtgtcaacgacgccggagtgaagcatgacgaaccgctcttccccagcgaggtcatgttccgcggccacgcagtgtgctgggtgctcggcgaatcactcgaagcgtcgcggctcggtgcagaggccgtggaggttgagtaccagcccctgccttcgatcctgacgctcacagaagccatggcggccggaagcttccagggcaaccagcccacggtggcgcgcggcgagccggaccaggccctggcaggtgcggcccaccggttcagcggcgagttcgaatttggtggccaggaacatttctaccttgagacgcaggcgtccttcgcgtacatcgacgaaagcgggcaggtctttgtgcagtccagcacccagcacccgtccgagacacaggagatcgtggcgcacgtcctgggactgtccaaccacgaggtgaccgtgcaatgcctccggatgggcgggggcttcggcggcaaggagatgcagccccacggcttcgctgccattgccgcgctgggtgcaagcctgaccggacgcccggtgcgcctccgcctcaaccggacccaggacatcaccctgacaggcaaacgccatccgttccatgcgcgctgggaagcaggattcgacgacgacggccgccttcaggcgctcaaggcaaccctcaccagcgacggcgggtggagcctggacctgtccgagcctgtccttgccagggctatgtgccacatcgacaacgcgtactacatcccccatattgaggtgcacggccgggttgccaagacgaacaaaacgtcgcagacggcgttccggggcttcggcggcccgcaggggatgctggtgatcgaggacctgctgggccggtgcgcaccgctgctgggcatcgacccgggcgagctccgccgtcgtaatttctatgagcccgggcaaagcacgccgtacgggcagcccgtgcgccacgccgaacggctcacggcgatctggcggtcgctccttgaccgtgcagacgtgcaacggcgccgggcggacattgccacattcaacgcagggcacccgcacatcaagcgggccatcgggatgacgcccgtgaagttcggcatctccttcaacctcaccgcgttcaaccaggccggcgcccttgtccacgtatataaggacgggtcggtgctcataaaccacggcggcaccgagatggggcagggcctgcacaccaaaatgcgccaggtggctgccactgccttaggcgtgccgctctcattcatccggctggcacccacccggacagacaaggttccaaacacgtccgccaccgccgccagctcaggtgcggacctcaacggcggggcggtcaagaacgcgtgtgagcagatcagctcccggttggcagaggtggctgcccgcaagctcaatatccacccggatgatgtccggttcgacgacggcaaggtcaccgggatcggattccacgaccgccacctcagcttcgccgaggtggcgcgcgacgcgtacttccagcgggtcccgctctgggcagcaggttactaccggacagaggggctgcactgggacagcgcccggatgcagggcgagccgttcaagtacttcagctacggcgcggcggtcacagaggtggaggtggaccgcttcacgggtgcctaccggcagctgcgcgcggatattgtgcacgacgtcggcgacagcctttcgccgttgatcgacgtcgggcagatcgaaggaggcttcgtccagggtgccgggtggctgacccttgaggaccttcggtgggacacgtccgacggagacgggcgcggacgcctgaccacccagtcggcgagcacctacaagctgccgagcttctcggaaatgccggagcagttcaacgtccacctgtttgaacgcgccacggaaagcggggtggtctacggctctaaggccgtgggcgagccgccgcttatgctggccatcagcgtgcgggaggcgctgcgggaagctgtcgcggcgttcggtcctggcggcaccgccgtagaactggccagccccgcaactcccgaggcagtgttttgggcgcttgagcgggtaaatgcgccctcccccaaggaacatgacggtgcggtcctgccggtgacaacgtcggtgctgtgacatggactggctggaagccctgcagcacctacggtcggcgggcctgcccgcggtcctggcgaccgtgtccgaggtacatggccatgcacctcgggaggcgggagccaagatggtggtggggaccgggtccacctggggaagcatcggcggaggcaaccttgaggctacggtggtggaccaggccagggacatgatggcctgtggcatctccacaccccagaacgtcgagttcgcgctgaacgagcatgcccccacgcagcacgggcggcagtgctgcggagggaaggtacgggtgctgctggaacctttcctgtcccttcccaccgtggcgatcttcggcgtcgggcatgtcgggtacgaactcgggcgcatcctgtcccggctgcccatgaccctgtatctagtggacagccgcacggaacagctggatcccacccggctggctgatgtgacctcgggtaccgcggacgttcgggcagtgcacacgcccgtcccggattcgttccttggtgacctgcctccgggcgcacacgttttcatcatgagccacgaccactcggaggacttcctgctctgtcacgcggccctgcgccgcggcgacctcgggagcgtgggactcatcggatcgcgcgccaagtggctgcggttccggcagaagctggtagcggaagggttcgcggggccggacattgatcggatccagtgcccgatcgggctgccggacgtcaagggaaaggcccctgcggttattgcagtgagcgccgcggcaggtttgctcggggccctgccgtccgctcggcagtagcacacgcgcttaggccctgcggtcccgcgggcttacgctgactgctggcgtccgaagaccgggagcgcccgtaaccagcgcgagagcccgcgggcgggccggtcgcaatcagccgggatgtagaaatccgggtcggtgccgccatacgggtggtacagctcctggcccggcgccggaaagcccaccacttcttttgggtcctgcaggtccatctcgtcctccccactttcgttggttccttcaataaagtatttccgcatctcggaaagtaaatattgttatgtggaaagattacggctccgggaggatggcgtcaaggaatgagccggccttaggcctggcggccgtgggcccgcccggtcacaaatggatttttccgcttgtgatgtacaccaccgatttccggaggtacgctggatgtcaactcgtggcgcaagtcacgtaacctgggagcagcaggcagggtcgtaatgagctgacatcaatcgatgtcggctcttttttgtgggccgacggtacaagaaacgtgcgggaaacgcgcgcttaatttctatgcgggactgtggtcccacatacctgaagttgggaatctgaccatgagcagcaacatcatcctcggccacaaccagttcggaaaggccgaagtccgggtcgtcaaaatcacccgggacacggaccgccacgaaatcgaagatttgaacgtcacctcgcagctccgcggtgacttcgcggccgcccacctcgaaggcgacaacgcccacgtggtgccaaccgacacccaaaagaacaccatctacgccttcgcccgggacggtgtaggttcaccggaagcctttctgctgcgcctcggtgagcacttcacgtccagcttcgactgggtgaccggcggacgctgggaagccgagtcctacagctggaaccgcatccaggcccacggcgccgagcacgaccactccttcgtgcgcaacggccaagaggtccgcaccgcggtcctggtccgcgacggctccaccaaccacctcatctccggccttaaggacctgactgtcctgaaatccacccagtccggtttcgtcggctacccgaaggacaagtacacgaccctccccgaaaccaccgaccgcatcctggccaccgacgtctcggcccgctggcggttcaagaccggaaccgatttcagcaccatcgatttcaacaagagctacgacgacgtcaagggactcctgctcgaaggcttcaccgagaagtactcccacgcgctccagcagaccctcttcgacatgggtaccaaggtgcttgaagcccacagcgagatcgacgaaatcaagttctcgatgcccaacaagcaccacttcctcgtggacctctcccccttcggcctcgacaaccccaacgaggtcttcttcgccgcggaccgtccctacggccttatcgaggccaccgtccagcgcgaagacgccgccccggcggacatcgcctggtccggcatcgccggcttctgctaggcccgcagcacctctaacaccatccggtccggagtttttgtccagataagacgacttccgagcacctttagtccacatacgtggacaaaaactccggaccgcacccacgtctttcagcaacaccgttagccagacaacgttagccagacgatgacgtctgccatgaaccagaaagtctgccatgaacatcaagcacaccctcaaagccgacgccaaaaagcagggcaagcgcctcgcctcaaaccggccggaggacgaacgcctttccatcgggagcagctttgcctacggcttccagcacgtcctcaccatgtacggcggcatcattgccgtcccgctgattgtgggccaggccgcgggcctctcccccgccgatatcggcatcctgattgccgcagcactcttcatgggcggcctggccaccctgctgcagaccatcggagtaccgttcttcggctcccagctcccgctggtgcagggtgtgtccttcgccagcgtcgccaccatggtggccatcgtcagcggcggcggcggactgccggcagtcttcggggctgtgatcgtatcggcggccatcggcctgctgatcgccccggtcttctccaagatcgtgcggtttttcccgccggtggtgaccggcacggtcatcaccaccatcggccttaccctcatgccggttgcggccaactgggccatgggcggcaaccgcactgcagaaaactacggcagcatggccaacatcggcctcgctgccgtaaccctggtcctcgtcctgctcctgagcaaggtgggcagcgccaccatttcccgtttgtccatcctcctcgccatggtgggcggcaccatcatcgccgtcgccaccggcatggcggacttctcaaaggtgggtcaaggacccatcgccgccttccccaccccgttccacctcggcgcacccaccttcgaaatcgccgcaatcatctccatggtgattgtggtactggtcatcctcaccgagacaatggcggacattctggcggttggcgaaatcgtcggaaccaaggtcgattccaagcggatcgcagccggactccgtgcggacatgggatccagcctggtcgccccgatcttcggctcgttcacccagagcgcgttcgcacagaacgttggcctggtggccgtcaccaagatcaagagccgttacgttgtagccgcaggcggcgtcattctggtcattctcggcctgctgcccgtgatgggccgcgttgtcgcagccgtcccaacggccgttctcggcggagcaggaattgtcctgttcggcaccgtggccgccagcggcatccggacgctcgccaaggtggaatacaagaacaacatgaacctcatcatcgtggccgcatccatcggcttcggcatgatccccatcgccgctcccaccttctatgaccagttcccgtcctggttcagcaccatcttccactccggcatcagctcagccgccgtcatggccatcctgctgaacctgttgttcaaccaccttcaggcgggcaactccgaaaaccagtcggtgttcgtagccggcaccggacgggtggtccgggaagaggacctcaaatgcctggccgacggcgaccgcttcgaaggcggcaagctcatcgactgcgacggcaaggaagttccggtccagtcgtccgaaaaggcagcggaccactaggaacgccggagcactatggacaaaggcatgaaactgcggcggcggcccgtcccggaaagggcgggccgccgccgtcgtcagcgcggacgtgggtcaggtgcggttcatctccagagagatggcttcggcggcctcgcggaggacgggtaccgctttatcagcgaagtgctcgtccacgcgggacacggggccggaaaccgaaatggcggtgggagtgggggcgttgggcacagccatcgcgaagcagcggacacccagttcctgctcctcttcgtcgatggagtagccgcgttcccggatgagcttgaggtcggccaggaggtcatcaacatccccgatgctcttgggcgtgggggtgggcatcccggcacgggtgacgatgccgcggacaacgtcgtcgtccagctgggccaggatggctttgccgacgccggtggcgtgggtatgggcacgccggcccacctcggtgaacatgcgcatggcatggagcgagggtacctgcgccacgtagatgaccatgtccgagtcaagcacggccatgttggatgtctcgcccagccggtccacgagggtcttaagctgcggccgtgccacggcgcctagctgcttgttggctccctcgccgagcctgatgagccgcgggcccagggcgtagcgccggttgggcagctggcggatgtagccaagcgacaccagggtgcgcagcagacggtggatggtgggcagcggcaggtcggtggaggacgacagctcgctgagcgtgacatcgccgccggcgtctgtgatcagttccagcagttcgaagacgcgctcaaccgactgcacgcctccagcggctttttcagccatgaccagtctcctgtggactcggattccgacaagtcttatccgcatcgtgaaaagaattgccctagaagtcccaagatacagcagaaccccccgcaggcgcgatgaaaggcacttcggggttgtatttccacaaagtagataataatatccataatacgaaaacattcggattggaacagaagcccactgggcccaacaggaggacattcaatggcgaacccgagccccggaaattccatcaccctgcgcgtagaagcgccgtccagcttcagcgccaccagcgagctcgctgcggcagtaggtgcagccggcgctgccatcactgccctggacgtcaccgagtcccaccacgagaccctggttgtggacgtcacctgcaacaccaccgacgacgagcacgccggccgcgtcaaggacgccctcaacgcgctcgacggcgtcacggtccagcacgtctcggaccgcaccttcctcatgcacctgggcggcaagctggaagtcgtccccaaggtagccctgcgcaaccgtgacgacctctcccgcgcctacactcccggcgtcgcccgcgtctgcctcgccattgccgaggacccggcggcggcccgcaacctgacggtcaagcgcaacaccatcgccgtcgtcacggacggctcggcagtgctcggcctgggcaacatcggcccggcagccgccctgcccgtcatggagggcaaagccgcgctgttcaagcagttcgccaacgtggatgcctggccggtctgcctggacacccaggacaccgaggaaatcatcagcatcgtcaaggccctggcacccgtgtacggcggcgtgaaccttgaggacatcgccgccccgcgctgcttcgaaatcgaaaaccgcctccgcgaggaactggacatcccggtgttccacgacgaccagcacggcaccgcaatcgtcaccctcgccgcccttgtcaacgccctgcgcgtggtgggcaagaagctgtccgaggtccgcattgtggtctccggtgtgggcgcggccggttccgccatcatccagctccttaaggcccagggcgcgcagcacatcatcgcggccggccgctccggcgccatccactcagggcaggagtacggggacgagcaccgcagctggatcgccgcgaacaccaaccaggaaggcttcgacggcaccctgcacgaggccctcgtgggtgccgacgtgttcatcggcgtcagcgccccgcacgtgatcggcgaggagcaggtggcagcgatggcacaggacgccatcgtgtttgccatggccaacccgacgccggagatcgatccagtggtggcggcaaggcacgcggctgtggtggccaccggacggagcgacttccccaaccagatcaacaacgtgctggcgttccccggcttcttccgggggctgctggacgctggagcctcggacatcacgccggagatgctggtggccgccgcggacgccattgccaaccgggtagctgacgaagagctcaatgccagctacattatccccagcgtcttcgatccccatgttgccgccgatgttgcctcagctgttgccgcggccgcccacgcagcaaacgtggccaccgcggttgaaggggttgaagccgcggctcccgaagccgccctggccagcgcctgattcactgcctgactgcaagccacaaggaaaggaccagaaatggccatcactgtcacagatccccggcccatcgaccgcgcggaggagatcctcacccccgaggcgctggccttcatcgaggagcttcacacccgctttgccggcacccgcaacgagctcctggcggcccgtgccgtcaagcgccagcgggtggccgagaccggaaagctggacttcctgcgggagacgcaggacgtgcgcgacggcgactggaaagttgcgcccgcacccgcaccgctgcaggaccgccgggttgaaatgaccgggcccgcctcgccggcgaagatggccatcaatgccctgaactccggtgccaaggtgtggctcgcggacctcgaggatgccagcacccccacctggggcaacgtcatcgacgccatcctcaacctccgcgacgccgcccagggcaccctcagctacacctcggacgagggcaaggactacaggctccgcaccgacgcgccactcgccgtcgtggtggcccgcccccgcggctggcacatgcccgaaaagcacctgctcatcaacggtgaacccacggtgggcgccctcgtggactttggcctgcacttcttccacgtggccaagcagctggtcctcaacggccagggcccttactactacctgcccaagatggaaagccaccttgaggcgcggctgtggaacgacgtctttgtcttcgcgcaggactacctgggcctggaccaggggaccgtccgcgccaccgtcctgatcgagaccatcccggccgcgttcgaaatggacgagatcctctacgaactgcgggaccacgcctccggcctgaacgccggccgctgggactacctgttcagcatcatcaagtacttccgggacgccggcgaggagtttgtgctgccggaccgcgcctcggtggccatgacggctccattcatgcgcgcctacaccgaactgctggtcaagacctgccacaagcgcggggccttcgccatgggcggcatggccgccgtcatccccaaccgccgccaccccgaggtgaccgaggctgccttcgccaaggtccgcgcggacaagacgcgtgaggccaacgacggcttcgacggctcctgggttgcacacccggacctggtgcccacgtgccgcgaggtcttcgatgccgtcctgggcggcaagcccaaccagctggacaagcagcgcccggaggtcaacgtcaccgctgagcagctgctggacgtcacctccgccgaaggccaggtcaccgaggcaggactccggctgaacctgtacgtcgccgtggcctacacggcggtatggctctccggaaacggcgcggttgccatccataacctcatggaggatgccgccacggcggaaatctcccgctcgcaggtatggcagcagatccgcaacaagtccgtcctggcggacacgggcaacaccgtgacccgcgagctggtggagcggatcctggccgaggaaaccgagcgcctgcgcaccgaattcggcgacgaggccttccgccgctattaccagcctgccagcgaactgatcgccgacatctgcctctcggaggactacacggacttcctcaccaccccggcctacgaactggtgggctgaggcatggcggaaacacccaagccgtccttgtccgcaggcgacctggcgaacatcgacgggcagctcgccgcaacggaccgcctgctcgagcggaactacccgggcgacgacggctcccgccagcccgtccacacggtgtacgtccccgcggaccgcttcacggcgtcgttcgctgctgactggggcgcgcaggcgatggcgacggcggccgcgcacggaggtttcgaaaagctggggcggctcctgggccaggacagtgcgctggcggaagccgtcgcgccccgcgtcgaggccaagctgaacactgaaccgatcgaagacctgcggctcgatttcgaggacgggttcggggacaggggcgacgacgccgaggacgccgccgcggttgccgcggcatcggcggtggccaccgccgtcgcggccgggtcggctcccccgttcattggcatccggttcaagtgcttcgaggcgcccaccagggcccgcgggctccggacgctggacctctttgtctccgggctcgcagcggccggcgaacttcccgagggcctggtcctgaccctgcccaaggtcaccaccgtggcccaggtccaggccatggactatgccgtgtcccggctggaggaggtgcactccctccccgccggccggctccgcttcgaggtccaggtggaaaccccgcagctcatcctgggtccggacggcacctccccggtggcccaactgccgcacgccgtccccggccggatcagcggcctccactacgggacctacgactactccgcctccctgcagatctcggccgaataccagtccatggagcacccggtggcggacttcgccaaggaagtcatgcagctggcagtggccggcaccggcatccggctctcggacgggtccaccaacatcatccccgtgggcgggaacgtggagaatgcctggcagctgcacggccgcctggtccggcggtcactggagcgcggctactaccagggctgggacctgcacccggcccagctgcccagccgcttcgccgccacctacgcgttctaccggcagggcctccccgctgccgcggcccggctgcggaactacgtggaacagaccgaaggcagcgtcatggacgagcccgccacggcccgcgccctggcggcattcgtcctccgcggcgtccagtgcggcgccgtcggagccgatgaagtccaggcgcttgccggcgtcggaattccgcagctcactgtgctggcgcacccgcggctcgccaccacgtccaactcctaggtaaggatcttttttcatgggcaagtactactcccccaccggcggactgccaccgcagacccacctgaccaccgagcgcgccatcgttaccgaggcttacacggtgatccccaagggcgtcatgacggacatcgtcacgtccaacctgccgggcttctcgaacacccggtcctggatcatcgcccgtcccatctccggcttcgccaccacgttctcgcagctgatcgtggagatcggcccgggcggcggcgcccccaaggctgagttcgaggccggcgttgaaggcgtcattttcgtgacccgcggcaaggtgaacctcaccctcgacggtgaactgcaccagttggaggaaggcggctacgcctacctggctgccggttccgagtggggccttgagaacgtttccgaggacgtcgtgtccttccactggatccggaaggcctacgaacgccttgagggctacgaggccaagtccttcgtcaccaacgaaaaggacgtggagcccaccgcgatgccggacaccgacggcgcctggaagaccacccgcttcacggactccagcgacctggcccacgacatgcaggtgaacatcgtgacgttccagcccggcggcgtcatcccgttccctgaaacccacgtcatggagcacggcctctacgtcctggaaggcaaggccatgtacctgctgaacaacgactgggtggaggttgaggcgggcgacttcatgtggctgcgcgccttctgcccgcaggcctgctatgccggaggcccgggcgagttccgctacctgctttacaaggacatgaaccggcaggtccgcctcacctgacccgcccccacccaactgggtagcgctaagtgtcgttttggagctccaaaacgacacttagcgctacctagttgggggaagattggtggcatgggcacaagccggatccgcgggtggaagcgcactgccgcaggcctatgcgtggtcctgctggcggtatcctctgccggctgcaccggcgaaccggatcccccggaaccggagccgcccgcagcctttgcgctgctggaggctttcagcgcccggatgctcgccgaaggcgcccctgccgtcctgatcgccgccaggaccggaaccaccagctggacccatgccgccggggtgcggagcctggactcgggcgagcctgccacggtatccgatcccgtccgcgtgggcggcatcaccgaatccttcatcgcagtgtcggtgatgaaacttgcggcggagggcaggctggacctggacagccaggtaagcagctacctgccggagttcggcagcgtcctccatccacccggccccgtgagcgtccggcagcttctgacccacgaatcagggatccccgacttttccgtacccctgctggcgtccggaagctgggcagaaacgatgaaccggccgctcagcctcgagcagcagctggccctggctgccactgtgccgtgggacggccggctggcacggatcttcgactattcgcgttcgaactacgcggcgcttgccctgattgttgagcggctccgtggccaggggatcgatgaggtcctggctgaggacatcgccgctcccctgcgcctggaggcaaccctgatgggcggtcccccgcccaccggcatggtccacgggtacgtcacccttgagggcaggcgcacggatgccagcatgccggcctggcaggcggagtcgccctccaccggggccgtctccacggtggaggaagtgaacaggttctacgccgcgctgctgcagggcaggctgctgccaccggacagcgtgacggccatgaagggcggctactcgcagtactacggctttgctttgcggcgctggaacaacacctgcaacaaccgcttttactacggccttccgggggataccgacggctacggaatgatcgccatgaccagtgaggacggcagcagccaactggcgatgtctgtcgcctacccgcccgcgccgcccacccttgagaccaacccgctgatccatgaaatgcaggacgtcgcgcaggaggccctcaacagcctgtgctgagggcctcccgctggtaccttccggtgaaatcaggccccgggattcaggacaaccttgatgcagccgtcctctttcttctggaacttctcgtacagggcgggcgccccttccagccccgagcggtgggtgaccaggtccatcacgcccagcggatcggcgtcgtcctccaccaggggcaggatgtcgtcagtccagcggcggacgttgcactgccccatccggacctggatctgcttgtcgaacatggtcagcaaaggcatgggactggcctggccgccgtacacgccgctcagggatagagtcccgccgcgacggacggcgtcaatggaggtgtgaagtgcggcgaggcggtccacgccggccgtctccatcgccttctgcgccagcttgtccggcagtagtccgagggcctggtgggcgaagccggcaacaggggaaccatgggcttccatgccgacggcgtcaatcaccgcatccgggccccttccggctgtcgtctcccgcagcaggtccgctacgtccctgccgtagtcgagagtctcgacgccgtgccgctccgccatcgcgcggcgctcgggaacagggtccactccgatgacccgaaggccccgctggacgccgatccgtgtggcgaactgaccgacgggtcccaggccgaacacagccagggtgcctccggcctggacgtccgcgtattccacgccttgccaggccgtggggaggatgtccgagaggaacaggtaccgctcgtccggaagctcactccccactttcaccgggccgtaatcggcatgcggcacgcgcaaatattcggcctggccgccgggaacagaaccgtacagttccgagaaaccaaagagcgcggcgccggaacccttgcttttgacctgggtggtttcgcactgggactgcaggccctggctgcacatataacagttgccgcaggaaatgttgaaggggatcaccacacggtcgcccttgcggagattggtgacggcgcttcccacttcttccacgatgcccatcggttcatggccgatcacatcccctttgtgcatgtacgcgcccagcacttcgtacagatgcaggtcagagccgcagatggccgtggaggtgatgcggacaatggcgtcggtgggttcctggattacgggatcaggtacttcttccacgcttaccgagcgttttccttgccaggtcagtgctttcacgattggcctttccggtggtgttgccttcagttcgggccggagcccattactcgacggtatcggctccagcagaaaaaagtaagcaagctgactaaagtcttgtcctcgcggcccgtggcttctagcgtaggaagggccagatcccaggaaacgcgcgaaagaggaacgccatgacgctctaccagccggaaccggttgagatctccacccgcatacggcccggcgagtggacggaagagagcctggagacgctcgttgccacgtaccacacccggatcatggagatgggcgccaatatggcggaagtgagcacggacattgagcggaacgacgacgggtcagtcaaggtggccgtagtgtggaacaagcccgcgaacgcaggtgacgaggacgccgtcaccggcggccacacggtctgagccgagcagctggccaagggccagccgcctcagcgaacgcccagccaggcacttcagtgcgctcattctgtcttggcgagcagccggccaagagcgcttgagggcaggttccgcaggaggtcccgcggcccttcgtatacctctaccgcgcccgcatcccgcagttcgccggcactgactcccccgcatgtcacggcaatcgccgggatgcccagggctgccgcggccttcatgtcccacacggcgtccccgatatacacggcgtccgcagcctggacgtcaatggcctccagggcagccacaagaatgtccggggcgggcttgctgttcttggcgtcattggcgctggtggcggcgtcgataaaggcgtcagcatccaggatggacttcatgacgtccaggtctttcctgcgcgccgatgacgccagcgcaacagccagccctgcggcatggctttgggccagcaggtcctttgccccgtcaaaggcccgcagcgatggccagtgggacgcataaagcgcaccatggctggccaggatctccgggtcgagggagcggtcacgccctccgggcaggaggctttccaccaggcggtcaccgcccatgcccacatggcggtggatggaggccatcgggatgtcgtagccctgctgccggaaggcaccccaccaggcaaccgtgtggatataggacgaatcgatcagggtgccgtcaacatcaaaaagaaccccccggcgtcgtccgccagggggtacaaggctgtggggtgccatcagctgaccgctgcccgctttgacgccggcgccttcttctgccgggccgcgtcttcctttgcggaacttacagggcggacgcgttcccggaggaccgtccctgcgcctccgtggctcttgtcccggatcagcccggtccccgcaatttcccgtgccatcgccacgccggcaacggcagcccttttcgtgggaaaggtgaccgagatggccatcaggcttccggctccatccagcatccgcaccctgtagccgccgtcaggcgcatccacgagctcaaaatatccggccattcgtatcactcctccgtcagtcaccgcgttgtgctttgtcaggagcactgaggtgttagtaagtatacttatctgttctgcgaaggagaagccacccctggccgcgccgcctcagcacgtcccgccgtctccggcggaatgggggtgtcacttcgccgaaccgtatcctgatgcagctccagggcgctagtcacaagcgcgaagtgactgaaggcctgcggggtattgcccagctgccggccggccttcacagcccattcctcgctcagcagccctacgtcgttccgcagttccagcaggcgttcgaagacttcccgggattcctggtgccggcccgcacccaggagcgcctccaccagccagaaggagcaggccaggaagacgccctcatcccccggcagtccgtcgtcgctctcttctgggcggtaccgcaggacgaacccatcctcggtgaggtcgcgctggatggcgtcgatggtccctatcacccgcggatcatccggaggcaggaagccgacgcgcgggatcagcaggaggctggcgtcgagctccggccgtccgtaggactggacgaaagtgttgcggtcagcgtcgaacccgttggccataacgtcccggtggatggtgtcccgcagccgctcccaccgctccaccggcccgcgcagcccggattcacggacgcctttgaccatccggtccgcagctacccaggccatcacctttgagtgtgtgaaatggcggcggggcccgcgcatctcccacagcccgttgtccggctggtcccagatcgtttccaggtgcgccatcagggaaagctggacgtcccatgattcatccggatgcgtcagcagcgaattccgggtcagggccaggcagtccagcacctcgccccacacgtcgagctgcagctgctccgccgccccgttgccgatgcgcaccggggatgagttttcatagcccttcagccatggcagttccatctccgggaggcggcgctcgccgtggatgccgtacatgatctgcaggtcggcggggtcgccggcgaccgcgcggagcagccagtcccgccacgccgccgcttcggccgtgtagccggctgccatgagggcctgcagcgtcatggtggcatcccgcagccagcagtaccggtagtcccagttgcgcggaccgcccagctgctcgggcagggacgtggtcacagctgccacgatgccgccggtgggtgcataggtcagcgccttcagggtcaccagggaccgcatcaccgcttcctggtacttccccttcacggtgcactgggaagaccagccgcgccagaaggcacaagtggtgccaaggacttcttcagcgtccacgctgtgcggccggcccacgtggcttggagcccacgtgaggacaaacgggacgcgctccccggcgctgacggtgaagtcgctgaccgtgtgcatgttctcgccgtggagtggtgccggtgtcaccaggtagacggcgtcaggtccggcgatggcgtgcaggcccagtttgtcgctgcggacccaggggatgatgtggccgtagtcaaagcggagcaccagctcgctgtgcatcctgacgctcccgctcacgccctcaacaatgcggacaatgtccgccacggagtcgcgcggcggcatgaaatcgatgacgcgcaccgttccttccggtgtttcccattccgtctccagcaccagggttccctcccggtagcctctgcgcgtgcacggcccgccaccctcgggtgccagcagccaacgccccgcgtcaggggtgtccagcagggcattgaagcaggccggggaatcgaaccggggaaggcacagccagtcgatggagccttccttgctgatcaaggccccggtttggaggtcgccaacaactgcataatcctcgatgcgcgccatgtccttacactgccacagtccgccccgcggcgatgggcacaattcgatgtagcctgcagtcatggcagtccacatcggcacctccggctggagttacgaccattgggagaacgtcctctatccgcccgggctcccggcgaaggaccggctcaagcattacgttgcccgcttcagcaccgtggagctcaatgccagcttctaccggtggccccgggatactacgtttgcgggctggaaccggcgtttgcctgatggcttcagcatgtcggtcaaggctccgcgcggcctgacccacgcccggaagctgtaccagcccgaggtgtgggtggagcggattgagcggtgctggcacgagctcggcgacaagcgggcagtcctcctggtccagctgccgcccggcatggaacgcgacgacgcccggctggactacttcctggccaggatcccggaatggatccgggtgactgtggaattccggcaccccagctgggactgcgacgacgtctatgcactgctggagcggcaccaggccgcctactgcatcatgagcggcgccaacctcccctgcatcctgcgcactactgccccgttcacgtacgtgcggctgcacggccccgaccaccagcacctctacgcaggctcctactcggatacggacctgcactggtgggcagaccggatccgggagtggtccggcagcggccgggacgtctacgcgtatttcaataacgacggcggcggcaacgcagtgcgcaacgccgagaccctgcgctggatccttggggaagggtgacgtcatggaagaacggcaaggaccaaggtagctccgcgcggttcagcctgtggcagagtggtcccatggacacggccccccagaccccgccacagaacgcagcaacaccaccggacccggaaaggaaatccgagctttccggcaacacggcgttcaagcttgcccaccggatttccgacggcgtcaacggtgtgcgcatccagctggccaaacgctggaagttcgtgccgcagaccattgcctaccagggctacggatcaaccagcctggtgcgcgtcctgggacgggtcctgttgacccagaagccgatgccgggaagcaaggcagagcacgcagcgcagaacggcaaccagaacgtgcgcggctggcgggccttcaccagcgttcctttgcagttcaccgacgtcgagatcactatcggcgatgttgtcacccacgtacgggcggacaggggcgggctgatcgacacggaagtcagcgtccacctggagcccggctggcacaccgcggtcctgcgcgccgagggcacggagcccgtcgaggcaaggatccgggtcatcgcgccggatgtgaagttcgggatcgtgtccgatattgatgacaccgtcatggtgacggccctgccccggccgttcctggccctgtggaacacgttcgtgttgagcgagcgggcccgcatggcgacacccggcatggctgtgctgctggaccggctcacggtggagcatccggacgcaccggtgatctacctttccacggggccctggaacgccgcccccacgctggcacgcttcctgacgcggaacatgtatccgtccggggcgctgctgctgaccgactggggcctcacgcaggaccggtggttccgcagcggccaggaccacaagcaccggaacctggagcggctcgccaaggaattcccggacatgcagtggctcctgatcggcgacaacggccagcatgacgaagccatctactctggcttctcgcaggagcatccggagaaggtagccgcgatcgccatccgccagctgtccgtcagcgaatcggtgttcgccggcggccactccgaggacggggaccataccgcgtcccaggttccgtggatctattccccggacggcgccggcatcgccaaacagctgacggccctggacctgctctaggcgctggcacccagggcgggaacgtcgtcgtcgggcatctcactgcccatcgctcctgcgcccatgacctcgacgtccatggcgtcacccaccatggcctccgcgatcgcagtgcctgccgcggcggccaggtcacgctcctcgatgagttcctggagccagaagtaggaggctttaggcgtccgttccaatgtttcgaagtccacgtgcaggaggccgaagggctggttgtacccggcggaccattcgaagttgtccaggagcgaccacacgtagtagccccgaaggtcaaccgatgcagcatccccgcccggggcagtagccttcagggcggcctcgaggtggtccgagaggtacttgagccgccgctcatccgggatgaatttggtgttggtggacttgtcccggacgatgatgtcttcgaagctggcaccgccctccgtgaggatgaccggcggaaggttggggtagcgttcacccatctccttcagggccacggccatgtactcgggcttcaccggccagccgtaggcggtgatgtccgcttcgggccaggtttcaacatggaacggtgttccgccgttgccggccgcgctcaggtcgctgcccatggcttcggccatgctggccggcaccgctcccccgcccggccctaccgccaccttggtgggcatgtagtagttgagcccgtagaagtccaggggctgggagatgagctccatgtcctcgtccgggtgctcgaaggagctgaagaacttggccgcccggatcagatccgggtatttgccggtcagcacggggtccgcgtacagccggttctgggccaggtccatcaggccggcgctgatcctgtccagcgggttgatggagttcggcaccatgggcgagtacacgttggtcatgccgatctcgcccggcaccttggcggcgcggagggcctggacggcgaggccgtgccccagcagctggtggtgcacagtcggaaatgcccccagcatcagttccttgccgggtgagtgcaggccgagcgtgtagccgttggtgctgaccgtggcaggttcgttgatggtcacccaacgcgccaccctgtcgccgaattcctccgccaggatggcagcgtattcacctaggcggtaggcggtgtccctgttcatccagccgccggcttcgtccagcgtcagcggggtgtcccagtggtagatcgtggccatgggggaaatgccattggccagcagctcgtccaggagcctgtcgtagaaggccaggccggcgcggttggccgacccgcgcccggtcggctggatgcgcggccacgcgaaggagaaccggtaggagtccacgcccaactgcttcatgagcgcaacatcctggggcatgcggtggtagtggtcggtggcgatgacggggctgtggttttccacgatggcaccgtccttggccgcgaagacatcccagcccgccgggccccgcccgtcctcgtccagcgcgccctcaatttggaaggctgccgtggccacgcccagcgtgaatccggacgggataagggcagcgagttctttggcggtgatgtgcatctgcgggccttttgtaacggagcgtaaataaagtacgtctcaggatggcacagctccgggcgcctgacgagcaaaccggtgtccggctgccacgcctctcccgggcggccagctactgggagccgaacaggaactccttggcgtgggccaccgctttccggaaggcgtcgttccggagcgtcaccaggtgctcggattccccgtcagcaggttccaggtagcccgtaaagccgggccgcagcacccagatgtcccccgcgggcggaaggtagaacacgccaaaggaccgctgctgcttctcgtcggcagtccataccggcacaacggccagcgctgcgcccgtggcagggttgatccattgcgcacggggcaacggctgctcatgcgcttcagggtccaggaagggcgcagtgccctcaccccagcgctgttcaaagcgctcgtggaatgccgggatcaggtgtgaatcgtatcggcgccagtcgctcatccggttttccgcctcctcgcggtgttgttgttgtgttccattccccgccggaacccgtgccagggccactgtcagcatcactgttccacccaaggcccgctttcccaccgcaccggggtgatcctgatgagggggcccggggatccggcggggctgcgcaccttccggacgggaacgggctgtccggcagcgccggcccgctgcttgtcataggcagcgcgccgctccggatccctgaggacgtgatacgcctgcatgatcatcagcagctccccttccggggaggtaccgccgtcgacgtccgggtggtggctgcgcatcaaagcccggtacgcgcgcgagatttcctgttgtgtggcgtgcggctggacccgcagggtgtcgtagtagtcgggacttgttgtcatggtgggcccttttccgctccgccggcgcccgtagggggcacggacgccgtgcaggacagaatgccgggcgcgggcaaccgtggagaggttccccgcgcctgccggccgtggctaggttccgatctggtgcttctcgctttgctgggtctggatctcgatccttcgcggcttggccttttcagccaccgggatccgcagggtcaggacgccttggtcgtagcttgccttgatgttgtcagtatccagagtgtcgccgaggatcagctgccggctgaagacaccgcggggacgctcggaggccaccagttccacgttgggccgggtggggtccttgcgctccgcccggaccgtcaggacgttgcgttcaacgttcaggtccaaggaatccacatccacgccaggcaggtcgaaggccaccacaaactcgccgtcctcctgccaggcgtccatgggcatggcagccggacgggcggcggttccaaagacctgctgcgtgagccggtccagctcacggaacgggtccgtgcgcatcaacatcatttcccactccttcagcttcagtaggtgttccacctgtgccatatccgtcatttgcaatctatagtgacggatatagattttttatagcacccgtgcgaaactgaggcaagagcccggacggatactggagaactgatggcggaacaggaggcgggccggagtgccggccccagcagccgcgcgctgtacgccatctccgtggcggcggagctggctggaacagggcagcagaacatccggctctacgaaaccaagggcctgctgacgccgtcgcggacgtccgggggcacccgccagtacagtgatgacgacatcgctgtcctgctgcggatcggcgaactcctcgaacagggcctcaacctggcgggcgtggccaaggtgctggaacttgaggcggccaacaccaagctgcaccgcgccctcaaaagggccaggtcccggccgccgggctgaggggccggccaacagtccagtcccggagccagtcagtcccggggcgagtccgccttggacagttcaccggtgatccgctcgccgggaacacgggcggtgcgccacgtgtccagcgcaatgaccccgcccaggatgaccagggagagggacagcgaagcgagggcgtcgctgagccagtggtatcccaggtacagcctgctcagggcggcaagcacgatgccgatccccgcccctacgaaaccaaagacggccgctttggtgttgctgtgccgggagaacaccaggaaggcgccaaccaggaggaagtcgcacgcccccaggacatgccccgacgggaacgaaaacgtgtggtcgatcccgaacagcatttgctccacgggcgggcgcgagcgctggacgatccgcaggatgatctgggaaatgatgacaccggtgaccatcgccgacgccagaaggatggggcgccaggcgtgtttggcggcgaagccccaccacaagatgaccaccaggacaatgatgggcagggcgaccggaccgaagaccacggcgaggaaaatcatgaaggccgtgccggcgtcggaccttgtccccaggagccagtcgcggaccggcacatccgccgcggacaggccatcggcctgcagcacgcttaccagtgtggcgatgaacagcgcaacccccgccaccaccaggatgatggccgcgcggtacagcccgcgccggtcggcggggtccatgtagcgctcctccaccacgaacttgtcgtggaaggcccgccacctgccctgtctctggttggtggttccggagcctgctgaatcctgatgtcccactgtgatgcccgtccctgcgccgtcgagattttcctaggggaagagtatcgcgttccgcactggcggtagcctgtgtccatgggtgccatgaatgaactgattgacgctgctgccgttcattctgctgcggccatcctcacggaggccgctcccggtgtgcgatgggtccggacacccgccgccgcctccgcgctgggggacctcaacctgcgcgccaggactgatcttgtggcgcaggcgctgcaggacgatgtcctgagcgtccccggggctggatatccgacggcggctggcagcttccgtgcagcactgcggtttccggagttcacgggctggatcctgtggccggtatcggaggctgctgccgcccttgccgtggattccggcgcgagtgaggactttgccgacgcgctggccctgctggcggaactgacgcccaggctcaccagcgagtttgccgtccgccgcctgctgcgccacgaccttgaccgggcactggccgccgccctggagtggacgtcccacccgaatgagcatgtccgccgcctcgcgagtgagggcacccgcccctacctgccgtgggcggtgcgggtgcccggcctcgtggagcggcccgaagccaccctccccgtccttaatgcgctgtatagggacccctcggagtacgtgcggcggtccgtggccaatcacctcaacgaccttgcccggcacgcacccggccccgtggtggccacggcaaaggagtggttgtccgcagctgacggcaacacggaatgggtggtccggcacggtctccgcacgctcatcaagaagggccatccggaggcactggaactgctcggttttacgccggcgcaagtggcggtggccgggccgcacctggaccgggaggtcctgaccctgcccggcgaactgtcgttctccttcgagatcgccaacaccggcacgcacgatgtgcgcctggcagtggactatttggtccactaccgcaaggccaacggaagccagtccgccaaggttttcaaggtgtcaacactcacccttgccccgggtgagagcaggagcctctccaaacgccatgccttcaggcagatgaccaccagggtgcaccaccccggcctgcacgccctggagctgcagatcaacggcgcggttcatgggcgcgcagagttcctggtgcaagaacctttgaacgcaggaccttagaccgcgcacaattactgattgactccgatataactctgcagtaacctgcgtgttagcgctaacaagagaacattcaaggaaagacccggaacggggaacctgctgcttttgcgtccgccggaactcatgcccggctagtgccgggaaggcccgggtccgcatcaacaccaggtcctcctggccgccttacgccggcacgcgcagatgcttgccggcccagcaccacatcgcggaccagcctccgcgtaaggagaaaatcgtgagaattaggaaactcctgggcgccgtcgcggtcgccctcgcagtcacagtcggggccacagggtgcggcacacggggcggcgccactgaagcgggagcctccgccaaccccagcgactccctggtgggcatctcgatgcccacgcagacgtccgagcgctggattgctgatggcggaaacgtggagaagtccctcaaggacctggggtacaagacggatctccagttcgccaatgacgacattcccacccaggtctcgcagattgaaaacatgctgaccaagggtgccaaggccctcatcattgctgctattgatggcaccaccctgacggacgtccttgccaaggccaaagagcagaatgtcaaggtcattgcttacgaccggctcatcaacggctcaccgaacgttgactactacaccaccttcgacaactacaccgtgggagtgcagcaggcaacgtcgctgctgaccggacttggcctggttgatgccagcggcaacaaggtggacggcaagggtccgttcaacgtggagcttttcgcaggcagcccggacgacaacaacgcaaacttcttctggaccggggcgatggacacccttcagccatatcttgacgccggaaccctgaaggttcccagcggccagaccaagttcgagcaggcagccatcctgcgctggcaggcgcctgtggcgcagaagcgcatggaggacatcctcacggccgcgtacagctccgggacaaagctcgacggcgtcctgtcgccttatgacgggctctccatcggcatcatttcggcactgaccagcaccggcggttacacccagggcgacctgcctgttgtcaccggccaggacgccgaaaagggttcagtcaagtcgatcattgccggtgaacagtactccaccatcttcaaggacacccgcaagctcggatcccaggccgtaaagatggttgacgccgtactgaagggccaggagccggaggtgaacgacacggagacctacaacaacaaggtcaaggttgttccggcatacctgctggagtcagtgatcatcactggagacaactacaagaaggaactcatcgactccgcctactacaccgaggccgacgtcaagtagccgtaccccccctacaggttgtggccgggccggcgcggcccggccacaacctgtcccccggcacctgcggccgcaggtggccctctttccaaccagtcggcgggaattgacgcatgaacacacccattctccagatgcggggaattaccaagactttccctggggtcaaggccctgcaggatgtcaccctggacgttaaccgcggcgaggtacatgccatctgcggcgaaaacggcgccggtaaatccacgctcatgaaagtcctgtccggggtctatccggacaattcgtttgacggccagatcctgttcgaaaacgaaccctgcactttctccagcatcaatgacagcgaaaagcgcggcatcgtcatcatccatcaggaactggcgctgagcccgtacctttccatcgcggaaaacatctacctcggcaacgagcaggccaggaacgggtgggtggattggcgcaagaccaacctcgaggccgccaagctcctggcccgggtggggctggccgaaaacccggtcacgcccgtgcagcacatcagcgtaggcaagcagcagttggtggagattgccaaggcgctgtccaaggaagtcaaactcctcatcctggacgagccaacggcagccctcaacgacgaggactccgggcacctgctggacctcatcctgcacctgaagggccagggcatcaccagcatcatcatcagccacaaactcaacgagatccgaaaagtggcagacgccgtcaccattatccgcgacggcaagaccatcgaaacgctccggctcgacgaaggccagatcacccaggaacgcatcattcgtggcatggtgggccgtgacctcgacagcctctacccggagcgcacgccggttatcggcgaggaagtgctgcggatcgaagactggtccgtccagcacccgcaggaccacacgcgcatggtggtgtccaacgccaacctcacagtccgcaagggcgaagtggtgggcctggcgggactgatgggggccggaaggaccgagctggccatgagcgtgttcggccggacctacgggcgggcggtctcaggcaaggtcttcaagtacggcagggaaatcaacacctccaccgtgcccgacgccatccggcacggtcttgcctacgccaccgaggaccgaaaacactacggcctgaacctcattgaggacatcaagcgcaacatctccatggcggcgctggggaagctggcgaaacgtggctgggtcgacaagaacgaagagaccgccgtcgccaaccgctaccgcacaagcatgaacatcaaggcaccgtcagtcgcagccatcacgggcaagctttccggcgggaaccagcaaaaagtggtgctgagcaaatggatgttctccgatcccgatgtgctgatcctcgacgaacccaccaggggcatcgacgtgggcgcgaagttcgagatctacacgatcattgccaacctggcggctgaaggaaaagcagtcatcgtcatctcctcggaacttcccgagctgctgggcatctgcgaccggatctacacgttgtcggcaggccatgtcaccggtgaagtgcccatcgcccaggcttcacaggaaacccttatgcactacatgaccaaagagaaggaatagcatgtccgccctacgagaatcactcggcttcctgacaagccgcctccgccaggttggcatcttcgtcgccctgatcctgatcgtcatcctcttccaaatccttaccgacggcatcctgctccaaccgcagaacgtcaccaaccttgtagtccagaacagctacatcctcatcctggccatcggcatggtcatggtcatcatcgccggccatatcgacctctccgtcgggtccgtggccggcttcatcggcgccgtggccggcgtcatgatggtccagtgggggtgggcgtggtggctggccattcctgcctgcctggtagtgggggccctggtgggggcgtggcagggatattggatcgcctacgtcggcatccccgccttcattgtcaccctcgccggcatgctgatcttccgtgggctgacgctgatcaccctgaagaaccagcagatcaccccgttccccgacgaactgcgggcgctgggtggcggcttcctccccgacatcaccggaggcacctccgtcctggaatggctgaccgttatcctcggcgttggcggcaccgccgcgatcctcttccaggctctgaaggagcgccgcgtccgcaagaagttcaacctggagaacgagcccatggcatggttcgccatcaagactgcgttcatcgcgctgctcatgctcatcatcacgttcctcctcgccagctaccgcggcacccccatcgtgttgatcgtccttgccgtcctggtcatcgcctactcggcattgatgaacaacagcatcttcggacggcacatttacgcgatcggcgggaacctgcacgcggccgagctctccggcatcaaaaccaaggccgtcactttccggctcttcgtcaacatgggcgtactggcggcgctggccggtttggtctttaccgcccggctgaactccgcccagcccgccgggggcaccggcttcgaactggattccatcgcggccgccttcatcggcggagccgcggtccagggcgggatcggcacggtggccggagccctgatcggcggattgatcatgggtgtcctgaacaacggcatgtccattctgggcctcggcacggactaccagcagctgatcaagggacttgtcctcctgctggccgttggattcgacatcttcaacaagaaccggacaggtggcggcaccagcatcgccagccgtttcaaaaggaagccggcacccccggccgctgaagggacggctccccgcgggacggctacggaccagccccttcccgtcccggcgagcacgtcagatccccgctgaccttgacggctctgcagtgccttcagctgcctaagctgctgcccagctaaaggagtccgacggtggccggcaacagccgccgtcggactctgccgttagcgcggcgggccgcctgcggggttctgccagtggtcccgccaagtgtgctcaggctcaaagcccagcagccggcgcgccttgtcgatggacagcatggtttcgtgttcgcccagctccttgaccaccttgacgccggggaacacttccgcagccaggccggcgcttgaccggctcatgacggtatccgcgttggcgatgatgaacgcctcgaatcccggcttcccgttttcgagggcgcggaccaccgcctgggccccgtcccggccgtcgatgtagccccaaaggttccatttccggagggttgcgtcggagtcgaaggaagggaacttttcgtagtcttccacgtccatgacgttggagaaacgcagtcccacgatgctcagttccgggtcccagcgcgtcagttcggcagccatctgctcttccaggtgcttcaccagggagtaggtgctttccggccgcgccgggtactcctcgtccacggggatgtagggcgggtcgacgtcgaacggcagtcccagcaccgtctcgctggaggcgtacaccaccttcttgatgcccgcgcggcgcgccgcctggaacacgttgtaggtggacagcatgttgttttcgaaggtggcggcatcgggaatgatgcccggggcagggatggccccgaggtgcaccacggcgtcaaaaccctcgtgccggtcgtccagtcccaacaacacgtccagaacctgcccgtagttgcgcaggtccaccacaaccaggccgggactgcggctgccttcgcggtcaaggttgaggacctggtggccgtcctccgtgagcctgcggaccacgtgccgtccaagttttccgctaccgccggtgaccgcaattctcatcaggttgtcctttacgtttggtggcttgcgccggttcaggcgccggggcgcggggaagccaggaacttttcgacggcggcgatcgccagttcggtgatgtcgccgggatctccgctgccgtccacggaaacaagcattccacggcccgcgtagaccgagactacttcatgcgtctcgcggtggtagagatccaggcggcggcggaacacgtccaccgtgtcgtccgtgcggccctgctccgcggcacgccggagcatccggcgctccagaacggcgtcgggggcggtcagctcaatgaccgcatccagcacaaacccctgggacacaagcatgttgtccagctccgtcacctgctgagctgtgcgcggatagccgtccagcaggaagccctcccggaggccgctgtccagcaggcggtccttgaccatcgcgttggtgaggtggtccgggacgaaatcgccgccgtcgaggtagccggcagcctcggttcccagctccgtttcctcgttgacgttggtccggaaaatctctccggtggagacggtggggacgccgaagtgccgggccaggtgctctgcctgcgttcccttgccggagcccggcggaccgatgatgagcagcctggtcatgtcctgtccctcttcctgccccagcggggcgtgccagccgccggtttccggggtctgccgccgggagcaccggcacctgcttcattctgccggtaactccccggccggcgccagagagcccgtacccgcacgtgtcccagtgaccatttcccccgcctgaggatgtatatacttctggatatcggtttagcagcaggccgttggaaagttcctcgatccagcgaccttcacagcctgcccgcaccaaccggggagatgccggaagttgccgggttgtcctgagcgaatggcaccaaaaaatcgtggccggcgagtcaacagcaaaaactgatacatccattaccgagcacctgcatgaactggtcctcaacagctctgatgttgaggacttcctcaacgagctggctcaggtgtccgcacgtaacctctcccaacccggcgatgagatcatgtgcgccatcacgctcctgcggcagcgcaaggccgcgaccgtggcgagcagcagtccggatgcgaaggccattgcgcaccttgagtacgagttcagcgagacgccgagcctgacggcctccaccgtccaggagagcatccacgtccccgacgcccgcgacgacggccgctggccggaatactcctccgccgtgctcgcccagggcatccgctccgtcctcgcgctgcccttccagctggagggcgggacgaaggctgccctactgctgtactcccggcagcctggccgttttgagccgcgcatccttgaatttgccgaggacttcgtgggccagacttccctggccctgaggctggcagtgcgctttgcccactacagcgagacggcggcgaacctccgcgccacgctggagtcccggacggttatcgacatggccgtgggcatcatcatggcgcagaaccggtgcagccagcaggacgccttcgggatcctgaaaacggcgtccagcacccgcaactccaagctgcatgacgttgctgcggctgtggtgaattcgctgggccaaggaccggtacgcacgcactacgacggttagttttcacaggcccctcatatatccggcaaatccccttgcaagcttgcctccctagaaaagaggcatgactccgcaacaaaccagacaacgtaaacccggccgcgcccggcgggccatcatcgccggggccgtggccctcaccttttccgccgggggcgccacggcctgggcgctggaccggtttgtggtgcagcacgtcgagatcgccgacgtctcagcctacgaagccagccagaccggcagctccgttggcggctcgggcggcgccgccgtcaccacggacacctcctacgtctccgactcgtccaacatcagcatctctacggtgaccaccggcagcggcgacaacaccgtcacgtactatgttgccgacgtcgtactggatgacgccaccaccctccagtccgccttcgccaacgacagttacggcgagaacatcaccgaaaccacctccgccattgctgaggccaacaacgcagttttcgccatcaacggcgactattacggtttccgtgacaccggcatcgtgatccgcaacggcgtggtgttccgcgacgagggcgcgcggcaggggctggcgttctaccgcgacggcaccgtcaaggtctatgacgaaaccaccaccacggccgggcaactggtcgccgagggcgtctggaacaccctctccttcggcccgtccctgctggacaacggggccgttgccgagggcatcgaggacgtggaggtggacaccaacttcggcaaccattccatccagggcgaacagccgcgcaccgccgtcggaatcatcgacgacaaccacctggtgttcgtggtggtggacggccgcagccccggctacagcaccggcgtcaccatgaccggcctcgccgacatcatgcagggcctcggtgccaccacggcgtacaacatcgacggcggcggttcctccacgatgtacttcaacggcgggctggtgaacaacccgctgggtgagaaccgggaacgcggcacctccgacattcactacatcgcgcagtaggtccggccatgatcatcctgatcccggcttacgagccggaccagcagcttccctccctgatccgctccatccgcaccgccgagccaagcgtggcgatcgtggtggtggatgacggcagcggccccgggtaccgggacgtgttcgacgccgtcagggaccttgggtgccatgtcatcagttacgggcgcaacaggggaaagggcttcgcgctgaagtccggcctgggcttcattgcggacaacctgcccggccatgacgtggtgtgcgccgacagcgacggccagcacgggaccgcggacatcctccgggtagcccatgccctccaggaaaaccggactggacagggctggtccatgatggtgctgggcagccggaagttcacgggtgacgtcccggcgcgcagccggttcgggaacaccgcaacgaagctgctcttcaccctggccaccggcgagcgcatccccgatacccagaccggcctccgcggctaccccgccgccatgatcccctggctccggtccgtccgcggcgaccggtacgaatacgagctgaacctgctgctggaagcccgcaacgccggctacgccatccgttcggtggacatcgccacggtgtacctggaccacaattccggttcccacttccggccgctggctgactcggtgcggatctacgccccgctgctgaagttcctggtgtcatccttcacggcgttcctggtggacaccgtgctgttcgtgcttctcacgctgctcgtcgactccctgctccttgccgtgctgggggccagggccgtgagttccgccgtgaacttcacggtgaaccggcgcatcgtctttgaccacggcagggacaggccggccggcgccactggaattcgctacttcagccttgccgccctgctgcttgctgccaacttcggcctcatccgggcgcttgaaggcgccgggctgctggcgcttcccgccaagatcctggccgaggtcatcctgctggccatcagttttgtggtgcagcagcgagtgctgttcaccgcgcaagcaagcggaaaagcggccggcagaagctcccgtaccgggcccagggaaccgtcagccagcactcatatacccggctaggttccgtcacagcacccgcacagtttggcccggcatcgtgaataccagcccaccgaaaacatcccggagaatcccatgaacccccttattttcatcctcgccgacctggcagccatcagcatcctgacctttgccctgtacctccgccgccaccgccgccgcgacctggtggtgtcctacctgggcatgaacgtgggcgtcctggccgtggccacagcgctctcgggttccgccgccgggctgggcctgggactcggcctgttcggggtcctgtccatcatccggctccgctccaccgagctgtcccagcacgaggtggcctactacttctcagccctggcccttggcctgatcgccggcctgggcattgagcccctctggctgaccggctccctgatggccctgatcctgctggtgatgttcgtgggagaccacccacgggtcctgccggcccaccgccaccagaccgtcatcctggaccgtgccattgccgaggacggcgaactctacgcccggcttgaagaggtcctccacggcagggtccactccgccaccatccaggaactggacctggtgaatgacaaaaccatcgtggacgtccgttacgcctactcccccgcagcttttcctgcaccggcgtacctttcggacgtgacgacggcggcgccgcggcacgcagaacctgcctccgctgaacctgcactcagtgaacctgcctccggagaaccagcccccgcccgcctgtcagccacggcaggcgccgcgtgaacacccccgcaacagccgccgtcctcagcaacctccattccctccggcccgttgggctggaggagctcaactctgaagccgcactccagacccgggtggaccgcaagtacgtggtcccggtccggcttgcaggccaactcctcgccacgttccgcgccgacgtccgcgtcctggagatgtcgggctcccgcagcttcgcgtacgactccgtctacttcgacaccgccggcctggacagctacctgctggccgcccacggccgccgtcgccggtacaagatccgcacccggacctatgttgacagcgcggtgagtttcctggaggtgaaaaccgaaggcgcccgggaagcaacggtcaaggaacgcatcccgtacctcgctgaggaccgcgcccggctcacggccgaaggcatggaatacgtccgcgaaacgctcaccgccgcggtgggctcagtgcccgcaggccgcctccgcccggtcctggaaacccgctaccaccggaccacgctctacctgccggagtccgggagccgcgccaccatcgacacggacgtaacctggcagcgtcccggccagaatccatgggtgctcgatgatgctgtgatcctggaaaccaagtcgggctccacggccgggccgctggaccggcatctttgggcccacggcatccggccctcccggatctcaaaattcgccaccggcatggccgccctgtgcccgggcctgcccgcaaaccgctggaaccggacactgcgccgcagcctcgccctccggcccgcagcctgaccctgcctctcccaacttcaccaaaaggaacacacaccatgaaacgcttccgcacccacctgtccgtcaccgcgctggccctcgccctcggcctggccggctgctcggttgccggctcgactcccaccggggtttcggctgtcaccgcatcgggatccaccaccagcgccggaaccaccggctccgctgccgccaccggcactgcccaggcagtctcgttggacgccgtcgcagaagacacccactacgacgccgacgacctgacctgggatgccgccgccgaagtagccgtgacactggcggacggtgccagcgctgccgccggcggaacgtcgtcggacgctgtaaaggtcgacggcgacaccgtcaccatcaccgccgccggcacctaccgcctcagcggctccctgtccgacgggcaggtggtggtggctgccggtgaagaggacgtggtccgcatcatcctcgacggagcaaacatcaccagctccacgggctccccgttcgtggtgcagggcgcgaacgaggcgatcgtccacctcgaggacggaaccaccagctccctcagcgacgcctcaacctatgccgaccagggcacggacgcccccaacgcagccttgtactccatggccgacctcacgatcgccggcaccggatccctcacagtggacggcaacttcaacgacggcatctcctcgaaggatggcctggtcctggccgccggtaccgtgacggtggacgctgcggacgacggcatcgtcggcaaggactacgcggttctcctggacggcgcgtaccaggtgacggcgggcgacgacggcttcacgtcggataacggggaggacgagggccgcggctgggtgctgatcaacggcggcaccctgaacgtcaacgccggcgacgacggcatcaaggccttcaacacactcaccatcgctgccggcaccaccacagtggaggaatcggaggaaggcctcgaagcccagcacatcatcatgaccggcggcaccgccaccgtcaccgccaacgacgacggcgtgaacgcctcaggcggcagcaccacctccgcagcgtctgcccaaggcggaatgggcgggggcatgggcggcggcgagatggccgtgggcgactacaccgtggacatcagcggcggcctgctcaccatcaactccgaaggcgacggcctggactccaacggcaacgccagcatctccggcggcaccgtggtggtcaacggccccaccaacgacggcaacggggcgctggacgtcaacggtgaactggtcgtcacgggcggaaccctggccgccgcaggcagcgcgggcatggctgtcacaccgggtacttcctccacgcagtccggcgtgcaggtgacccttgattcatccattcccgccggcacggtagtacagatcgccgactcctccggcaacgtggtggcagcctttgtcgccaccaaggccacggcgtcactggtgttctcctccacggccatcagcgacggtgaggaatacaccgtctacaccggcgggacggcaacggtcagcgcgggcataggtgaagggtcgctcgacggcgcctcggagcagggtatggtcaccgcaggggaatacaccgcagcgcagggccccggcggcggaggcggaccccgctggtaacccccacccctctctcacctaccgcagcgtttcccccaacgctctatcacttaaagcagcgtttcccccaacgctcactcacgtccggcggcggcagtcatgccgccgccggacgttttgagtgtgctggacgtgccggggagggcagttgctacttggcgaggaagcgcaggagcgcttcgttcacttcggcggcgtgcgtccacagcaggccgtgcggggcaccttcaatttccagatattcggcgctgggcaatgctttggcgaacaacctgccggtggagtcgatgggcaggatgttatccgcggtgccgtggaggatgagcgccgggacgtcgatcttggggatgtcagcccggaagtccgtgagccacgtgggctgcgctgcaacggatgccgtggcgcccgcaccggcggcgaggttccagctggcgttcacggcctcctggctgagccggggcgtgcccaggaacgtgtccgagttgtagaagttcttgaagaactcggtgaagaaggcataccggtccgcggtgacggcctccgtcagcccgtcgaagacctcctgcgggacgccgtccggattgtcatcggtcttgagcaggaacggttccagggagccgaggaaggctgcccgcgccacccgggcggagccgtaggtgcccaggtaacggcccacctcgccggtgcccatggagaagcccaccagtacaacgtcgttcaggtccagggttgtcagcacggtgttgaggtcggcagcgaaggtgtcgtagtcgtagccttcggtggtcttgcttgatttcccgaagccgcggcggtcgtaagtgatgacacggtagccggcgtcaaggagcgcaacagtctgcttttcccaggaggatccgtccagggggtagccgtggatcaggacgacgggctggccggagccgtggtcttcgtagtaaagctcgatatcagtgctgttttcggttccaacggtgatgaaggccatcgcggcgggtcctttcgagactgtgggatcggtgcggccgccgaaggtgccgcggccgcgcagtacctactctagggcggtccaccgtccagtccagtcacactcgctcggttcccttcaagcaggttcagctactgcgaaggttgcggaagctcgcaggaaatctggggatttgctcccatatagttcaggggtccggcagcgatggtgacggcaatcgttccggcctccgcacagttgccgggcgcggcgccgaaatagccgcgctgccaggcggccacaccgccaataatgagccagataacgataagtgctccaagaatccgcatgattcctccattgggcggcgtggcggctatgtgaacaattatgcgcgccgccccggagagtgcgagagcgctagccgaaagtacgcatcaagtgagagagcgtcggcgggaaacatacatcaagtgagagagcgtcgatgggacaaaaacacctccggtcccggggatagtcccggaaccggaggtgcttttcaatgctctggaaaggcggtgctgtggttaagctttggccgttttgcctggcagtgccagcttgaagatcttgccccaggtggatccgacctgcttcagcagcggcccggtggtgtacttcaaaccgtagcgctggcagatctcacggaccttgggcgccacctcggcgtaccggttggagggcaggtccgggaacaggtggtgctcgatctggtgcgagaggttaccggtcatgatgtgcatgaacttcgacccggagatgttggcggagccgatcatctggcggatgtaccagtcgccgcgggtctcgccttccgccatttcctccgtgaaggtgtccgtgccctcggggaagtgcccgcagaagatcacggcgtgggcccagacgttgcgcacggcgttggcagtcagcgtgccataaagggcctgcttgccggagcccgtcagcatggcaacagcaggggttgcggcgtagtccttggtgaactgggtgacaaccttcttgccaagggccttgaggtccttgagcagcgcttccttggacttcttgccttccttgaactccgtgagctcaaggtcgtagatggcgatgccccactcgaagaggggcgccaggatggcattgaacagcgggttggccaggttaatgggcttccagggctgctgttcgtccatccgcaggaggttgtatccgacgtcgttgtccttgcccaccacgttggtccagcggtggtggaggtcgttgtgggtgtgctgccacgaacgcgagggggtgacgaagtcccactcccaggtggtggagtggatgtccgggtcccgcatccagtcccactgtccatgcaggacgttgtgcccgatctccatgttttccaggatcttggccaggctcagcagcgtggtaccggtgacccatgcagccttgttcttgctgaccagcaacgcggcacgcccggagatctccaggccacgctggatcttgatcacgcggcggatgtaggcagcgtctgccgccccgcgcttgccgaggatttcgtcgcggatggcgtcgagttcacgcccaagttccgccacctgctcgtcactcaggtgggcggcggccggcggccggacggtggggctgccggactcggcgagctttccggggcgcgtccttgaccctccggtcggcttgccttcggcgggggtggttttgctcggtgaaattacagtcataccgtggtgctcctcagatttcgaggttgacgggtccggcggctgccgagacacacgtttggatcaattgtccgggttcgccgtggacttccccggtgcggaggtcacggacctggccggacaggagtggggtcaggcagctgtggcagatgcccatgcggcaaccgctgggcatcagtaccccggcgtcttcacccacgtccaggatgggggtgtcgccgtcggcttccacctcacggtcggaggcctcaaaggtgaccagcccgccgtcgtgccccacgccggcgtcgaaggtggtgttgaagcgttcgatcatgaggttaccggggctgccggccaccgcgacgtcggaacccggcgctgccgtggtgagcgccgcgcgcttccacagcgcctcggcgtcgtccaggaagctgtccggaccacaggcatacgccgcgcgttccttccagtcgggacagatctcgtccagctgggaggtgttggtgaggtccatgcggccctgctcgccggtgaaccagtgggcgaggcggaagttggggaattggtccgccagctccgcaagttcctcgcggaagaggctgtcgccgggggttcgggccgagtggaccagcacgacgtcggcatccggacgccgcggaacaagggtgcggatcatggacatgacgggagtgatgccactgcccgcggtgaccatcagcagggggcgggggtgctccgggagcacgaaatcgccctgcggaggagccaggaacaggacgtcgcccggcttggtggtccgcaccagggtgccggatacggcgccaacatcagtgaccgtgatggcggggtccttgccggcaggggtgctgagggaataggaccgccaatggcggacgccgtccagctcgacgccgatgcgcgcccactggcctgccaggtgggagtgccagccgcggccgggccggaagaagatggttgctgactgtgccgtctcctgcaccacgcgggtgaccacgccacggagctggcgggcagagtagacgggattgaacagggctaggatgtcctccggcgacaaaggcgtggtgaggacagtggccgcctgggccagctgacgtaaccggatcatgggattaagcctagagcggcgcgagccatatttctctctctccgtcatatgaccgttccgcagtcacgctgtagtaatggcgctaagcccccaagccgcactctaagagtaacggttcggcaacgcggaaagttccgtggtggttcaataagcctgcttagtatatcgcggatagggcttgcaggggagaatttcttgccgcccaaggggcgttgcgccagttcagtagcccgggctccatcccagcgcaggcgcgacgtgccgggcaatattgcccagcagcttcgcgttgaagtcgacccccaattggttggggacggtcagcaggagggtgtcggccgcctggacggcggtgtccgcagcaagctgctccgccagcaggtccggtgcgcccgcgtagctcttcccgaaccttgcagtgagcccgtcaataattcccacctggtcccgaccgtcccgaagggcggcaccggcaaagaaacggctgtcttcctcttccacgattggcaggacactccggctgaccgacacccgtggcgtatgctcgtggcctgctgttgcccaggcgtccctgaacagctggatctgctcggcctggagttcgtggaagggcacgccggtatcctccgtcagcagcgtggagctcatcaggttcatcccgagttccgcggcccagacggctgtcttccgggtcccggctccccaccagattcgctcggcgagcccgggcgactgcggctggaccggcaggagcccggtggctccgcctgcgtagcggggatctgcttccgcgactcccgcgccggtgatcgccttccggaagagggcggtatggcgccgggccatatcggcgtcagtttcgccgggctccggcacgtagccgaaagctgccgctccctggctggcaggctcgggtgacccgcggctgatgccgagctgcagccggccgccgctgatcaggtccgcggccgcggcttcctcggccatatagagcgggttttcgtaccgcatgtcgataacgcccgtgccgatctcaatcctggtggtgcgcgccgcgatggcggacagaagcgggaatggcgaggcctgctgccgggcgaagtggtgcacccggaagaatgcgccgtccagcccaagctcctcggcggcaacggacaggtcgatggcctggaggagggcatcaccgggggtcctggtgcgggagccctgcccgggaccccaatggccaaatgagagaaatccgatgcgctccatacctggcccaacccgggcccggcccccggcattcccgcccttgtgaagccggctggcatgatggcgtcgtgggtatccctgatgaagctgtgagcatctccaagacggtggtgctgtttgtcctggctgctgcggcggagattggcggcgcgtggctggtgtggcagtcagtgcgtgagggcaaggactggtggtgggctggcctgggcgtcatcgccctgggggcttatggtttcgtggccacgttccagcctgatgcccacttcgggcggatcctggcggcctacggcggggtgtttgtggccggatcccttgcctggggaatgatttttgacggcttccggccggaccgctgggacatcgctggctcactgatctgcctgctgggcgtggccgtgatcatgttcgcccctcgcagcggggcatagcgcatcagggcacagtgcggcggcggacagcgcagcagaggatgcacgcagccgcatagctaaactggcaccgtgaccaaccgcgagcagcccgctaacgcccccgaaccgacgtcgcgcgggaaaatcgccgaacgcctgctgcctggcggagaggaaccggacccgcgcttcaccctggccaacgagcgcacgttccttgcctggatccgcacgtccctcgcgctgctggcaggcggcatcgccattgaagccttcacctcggacctcttcctggagccggtccgcaagggcctggcggtggtcctgcttctgctcggcatgctgttgagcgccggctccgctgtccggtggctccgggtggaacgcagcatgcgcaacaaggcaccgctgccgctgccgctcatcgtgccgctgctggccgccgccggcgcgctggctgccgccgtcgtgctgatcttcattctctggcgctgacccgtggcaccatcccgcggcgcaccactgcatgaggatcccggccttcagcctgaacggaccacgctggcctggggcaggaccatgctggccctggtgacagtcagcgcgatcttcctgcgctggctgccgcagcatggcctgcctatcctgctgctgttcaccgtgtcggccgcaacggccgccggcatctacttcacgcagcggcgccgctaccgcgtgagttcgcacggtatccgcaaggaaatgcacgacgccgatatcaccgccgtgctgtggacggcttttgccggggtaatgctgggcgccctcggcatcggcgtggtgctcattggctagtgccgccgtgcagagccgcctgtgcgaacgcgggcttagaacatgggcaggaagaagccggcaagaaatgcggccgcgccaatgcctgtcaggtaccggcccagcagcgccgctgtcctgcccgcctcttccggcgcagcagtttgccactgggtgggacgtttggggtggtagtacaccgggagggtgtcgcctacggccaggtccctgatgtcgtggggtgacatgggcgcgtggtgcacctggtatttgcggtcgaaccagcggaatcccacgccggtgctgtcggagtacaccacggcctcggccacggcccacggatgaacgaagcggcggaggaagcctgtgtagaagagcaatgcgagcccggcgggcaggcacaaccaggtcagcatttccaggattggacctgccatatcaagcacagtgggcatgattcagatggtacaggcgtacgctggggagaccggtccgggagtagagggaagccatgaacgatcaggatattttgacgcgcatccaagccctcgttgacgaggagcactcactgcgggaggcttccggggacggacaggtgccggacaaggcgcggctgaagcaggtggaggaaagcctggaccagtgctgggacctgctgcggcaacgcagggccaagacagaatccggtgagaaccccaacgatgccgaagcccggcccgtcagcgaagttgaaggctacaaacagtagcggccaaacagattggagcgtctatgcgtctggctgttgcccagatcatcagcagtgcagaccccgcagaaaacctggggctgatccgcgactacgctgcccaggcgaaagccgccggtgccgagctggtggtatttcccgaggccgccatgcgtgccttcggccactccctccgcgacgtcgcagagccgctcgacgggccttgggctggggaagtccgggccatggcgcgggaactggatattgcgatcgtggccgggatgtttactcccggaaaggacgggcgggtccgcaataccctgctggtcacgggccccggggtggaaacgtcctacgacaaggtccacctcttcgacgctttcggttttgccgagtccaagactgtggacgcgggtgaaacccccgtgactttcgagctcaacggcacggtcttcggactcgccacctgctacgacgtccgcttcccggcccttttcaccgccaacgcccgggccggggcggaggtcaacatcgtgtgcgcgtcctggggagccggcgagggcaaggcggaacagtgggacctcctggtgcgggcacgcgccctggacagcaccacgtttgtggtggcctgcggtcaaggagacccggaaaccatcggcgccggtccggcagggagcgccccaacgggcatagggcacagcgcggtgatcgaccccctgggctccgccgtagtggcgctgggcggcaagccggaactcgccgtcgtcgatatcgacccgtccgtggtggatgaggtgcgcagcaagcttcccgtgctggccaacgcacggcagttctgactccttcgctgccgccctcccgctgagcctccccacctttggcagcgcacgacgactgcgtgccgcaccttctccgcggcgcgccgtcgtcgttctttcaggatgggaatttcagcacccgggaggggtgagccaccggttacgcgcaggaaacctgccccgttcttcgcgttcgacgacggttctcaccagtgacgcggtgcgtcccccgccgttgcgctggcctgaggctatttgccgtcagggcatcgctgcaaggagggcagcggttaacaagcttgaaacatactcgacgcgtgaacttcacgtaagggcggattgtgtaacgcagccgcaacttttgcgcgcctttcccgaaacaccggaggacaaacatagacgccgggggaagtgcgagggccggcaaagagcgccccgctggcgcaacgcgaagggacccgcaggtggaaatttctgcccaacatgtctggctgatgatttcagccgcgatggtactgctgatgacgcctggactgggcctcttctacggcggcatgacccgcgccaaggccgccctcaacatgatcatgatgagcttcatctccgccgggatcgtcggtgtggtgtgggtcctgtggggctactccatgacaacgggcgacggcgtgctgggcatcttcggcaatcccttcgccaacttcggcctgcagaacctcatggactcccccgacctgatcaaagccggctacagcgccacgtttgcgatcatcacggtggcgctgatcagcggagccatcgcggaccgcgcaaagttcggcgcctgggcactgttcgtaccgctgtggatcaccgtggtgtactgcccactcgcctacatgatctggggcggcggcctgatgagcgccggcggagcagtcaccgccgtgttcggccaggtcatcgacttcgccggcggcgcagtggtggagatcagctccgggaccgcagccctggtcctcgccctgatcgtgggccagcgccacggtttcgccaaggaccccaaccaccgcccacacaacatccccttcatcatgctgggtgccgccatcctgtggttcggctggttcggcttcaatggcggcgcggcaacaactgccgagcaggcaggcctgatctgggtgaacaccctggtgactcccgccgcggcgatgctgagctggctggtcaccgaaaagatccgccacgggcatcccacgtccctcggtgccgcctcgggtgtagttgccgggctcgtagccattacgccctcctgcgccaacatcagcccggtggccgctatcgggctgggcttcgtggccggagctgcctgtgccatcttcgttgacctgaagtaccgtttcggcctggacgactcgctggacgttgtgggcgtgcaccttggcgccggactcatcggtaccctcgcgctcggcttcatcgcccttcccgtggacggccagggcggcggactcctctacggcgggggtgcgcagcagctgatagcccagacggcggccgtcgttatcaccctgctgctttccggcaccgggacctatgtcattggccgggccatcaacaaaaccatcggcttccgggtcagccacgaggcagagactgccggagtggatttggctgaacacgctgagagcgcctacgcgttcggtgaaatcggctcccgcttcaatccactgcactccgcttcccactcccccgcggcagagatggcagctgccgccgaccggcccagcaagagcggctcgcgtactaaagaagactccttcgcctgaccggcgaggcctttacggccggccaggcgggtcataactgccgcgtcagtcagccaggatcttgtagagcgcgcgccgggtctcatccattttttcgattgcggcagcgcgctgttcctcggtgacaccggtacggaactggtggatggcgcccatgagcttgccgatgctctggtggaattcgcggtcggagctgtccggcccggcattccaggcattgtccatttcctcaccgtgctcggccacgtaggcccggccccggtccgtgagcgtgaactccgtcccgcggccctcgctgagggctgagatcaggtcctcgtcgacgagttgctgcagtgtggggtaaatggatccgggactgggccgccaagcgccctccgtcttttcggcaattgtcttgatcaggccgtaaccgttggagggtgcctcggccaggagcgagaggatagctgcccggacatcccccctgctggcccgccgtgagccacggccgaaacccggaccgaacccaggtccaaaaccgggtccaaagcccggtccaaaaccaggaccaaagcctccgccgcggtgtccgtgaggccccctgcggcccctgccccgcccgaatggctccctgccgaattcagtgccgggaaatttctcctcgtgtatgcctttcatcgtggcattgtcctttcacgtgataagtccatcgaccttgtcgacgatagttaacgatatgtcgctaactatcgcttggtcaagaacaggagtgtgaccaaatcctgacctttcagcagggcaatgtgcggctggaccggcgtagtcttttgagacctccaagctcgagggctgaaagatggcgaagaaaaggaagcgcagaagcggtttcggcgctgccctgggaaggttcctagggttcctggcggcgagtgccatgtgcggggtcctggcggccagcctggtggttccggcggtggcggcagcgggattcggcgtcagtaattccattggcttcttcgacagcctgcccgaggaactcactgtccagccgccgtcgcaatccactaaagtcctcacctccgatggccagccaatcgctactttctttgccgagaaccgcgtcaggattccgctggaacagatgtctccccacatcaaggacgcgatcatcgccatcgaggacagcaggttctatgaacacgctggcatcgacccccaggggatcgtgcgggcagtggtgtccaacctgacacagggtggccagcagggcgcctcaaccatcacgcagcagtacgtcaccaacgtgatcaacgaagcacgcttgtcgcaggacaggccggacgaggtgatcctctccggacagaaggacgttggtgacaagctgcgggagatgaagctggccattgcgttggaaaaaaagttcaccaaggagcagatccttgaggggtacctgaacatcgtcttcttcaacagcgacgcctatgggatcgaggcagcgtcgcgctacttcttcagcaccaccgccaaggacctcacccttccgcaagccgcgctgctggccgggctcgtcaacagccccaccttctacaaccctgcgatcaacgcggacaagtcaatcgtccgccggaaccaggtgctctcggagatgctgctccagggcaagatcacgcaggttcagcacgatgaagcagtggccacgccgattgagctgaagatcagtccggagcggcagggctgcgcctacgcggccatggcgccgtacttctgtgactacatttcccatctcatcctgaacaacccggcgtacgggcccagcctgatagagcggcagcggaagctgtaccgcggcggcctgactattgtcaccaccctggacagcaggctgcaggcagccgcccaggcgcaggtggacggcacggccggaccaaacccggaccggtggggcgccgccctggtcaccgtgcagcccgggaccggcaagatcctggcgatggcccagaacacggtattcctcccggaaccgggcaagttcgacacgcacctgaacttcaacgtggatgccaaggacccgcaggggaacgacctcaacggagcgggcggcttccagcccgggtccaccatgaaaccgttcaccttcgccgagtggctgaaccagggcaagtccctgaccgcggaggtggacgcttcacggcgcgtttatccgctggactttccgtggcggtccagctgcgggaaggtgatgggtgcctacagcaccgcgcagaacaaccccacgctcggggctgctgacgacctccagaacgccgaggagggcttctaccggaagatgcccatcaattacgggctgtacaactcgatcaacacggccacgttcgccaccgccgcgcagctggatttctgcggtatccagaagatggtggacgcggtggggctgcacagcggactggatggagccccggtcaacatgcatcagctgggcaacattctcggcgctatcggcgtcgctccgcttcacctggccaatgcctttgccacgttcgccaatgacggccgctattgcacacccatcgcgctggcggacgtcaaggatgcaaccggcggcaatctgcccgcccagcccgtggagtgccgtgacgccgtaaagccggacgtggcccgtggggtcaacaatgtgctgcaggatgtgctcgtcaggggctcgggcgtctggatcaatcccaaaacccacgacaagttcccggtggcggccaagaccggcacctcgaacaacaacgggtccacctggatcgttggctacacttccgggattgccaccgcttcattcttcggcgacgcccttgagggacagaagcgggccggacagaacgtcaccatcaacgggaccttctatccccgccttgacggctacatgattgccggaccgcagtgggccaactacatgcttcaggcggcgccgctgtaccccaccaatgggtttccccctcctccgccatcgatgatgggcccgagtccctcaccgtcacccagccctcgtccctaagcccggctccagccagccgggccggcacggccaagtacctgcacggcgggttttatcttgggcccgtcttccttgactcgcggttgccccccagacgcacgtggctgccgatggaaatcacgacggcgggccggcttgcccgtgccgggtggcggcggggctgtggagtggtaggtgtggccggtgggggttttgagttccaccatgtgtcgtggtccggggacgggacgggctgtccagcctgggttttctttggtgtggttgcaggcttcgcagaggccttggccgttggtgctggtggtgggcccgtcctggtgccatgggacgacgtggtcgtgatggcggatgggcgcgtcacagtagggggtgcggcaggtgtcgtcccggacctggaggaaccggcggagcccgggcgggaagagccgggccttcgaatccatggcgaggagttcgccggtgccgggggcggtgtagagccgccgaagccacgtggtgagcgcactgggtccaggcgcagtactggatactcctgcgccgtggccggcagcggggaatgcggccgagtcgtctggctgcccgaggactgtttgcctggcccagtgggcggggacggtgccgtagcctgcgagccgtgctggttcgctgtcgccctggaagagggtgcggtcggtcatgacgagctggacttcgatgctgctggcccctcccggggtgcccgtgatgttttcgacgagctggtccgccatgagcgcgcccctggagcggtcatcaccgtgtgatctcgcggtgtctgcgtggcgggtcagggcggcgtaggcggcgacgccctgcgcgattgggagcagggcggtcagacgggccatggtgtccggcgccgggcgaagggtcacggtccgctcactcaccgcatgggcggcgcgcctggccaccgagtgcgggtcacgccggtacgcggccgcacggaccgcggcaataatggcccgatccccggcgcctgccagtgaaccagcgcctgccagggtcccggtgtcggcggcgagttcctcgtccaccgcgcaccggtcctcggcggacaggcacgctgtttccttcacgataagggtggcgcgccattcgttcagctgccccgactccagggctgccagggcgtggggcatctcggtgccgagggctttggccaggcccaggagccgaccgccgcgggccggggactcccgccgcgccaacgccacctgcgcggcaacaccggcgccgcgttccttggccgggataccggccgcggcctgctcccgccgctgttcagcgtcgaaagccacagcaatccgggcctgtttagcagccgccagcgacttcaaatcctccaaatcccgcaactgatcaatcatccccggaccgtcagcacacacagggacggcagcaaggctcgcccggatatcagcaacggacaggacaccaggaaccggcggcgcaacggagacaaggtgcgtggcggtagcaggcaagggccgagtcacagacaaatcaggccggcgccctgcctgccccgtatccaaaagcccaccaactgccataacccaaccctgccaaagaccaccgacaatatcgcgcccccaaatcttctatgtggaaaaccatgaaacagcagaagccgccaccgctctggcagcattggcgtggtgaagagccttgaaaccgatcggctaatcctccggcaatggaagcctgaggacgccggctttgtactggacctctactcgcgctgggaggtacagcgtttcattggcaaccatctccaggtgatgcgggaccggtcccaggccgacgagcgcatccgcgcctggcagcagatggacaaccccgtccacggtgtctgggcagtgcagctgaaagggcaacccacaggggaggccgggctgccggaccagggccagggcacgggccagggcacggacgagagccagggttacgaccaggctcccccgcttgccggcaccctcctcctcaagtccatcccggcctcaggcgcttccctgccactggaaccgtcaggggacaccgaaatcggctggcacttccacccggaccactgggggcatggctatgcaactgaagctgcggcagcggtcctgtcctacgcgtttgcaagcggcctggaacgagtggtggcagtgaccgccccagccaacaaagcctcgcagaacgtctgtttacggatcgggatgaagcactgcgggcagacaaacaggtattacaacgcgctgtgcgagctgtttgaagcgacagcccccgcaccaagccagggaccccactaaggcgaggaccaccaaggcgaggacgacgacggcgggacgcaacgccgtcgtacgaacggctaaattgcacctttccacagccgctgccaccaggggcgcgcaggctgcggttctgcgggaggctcggcaggccgggcggcacggcgctcgcgccaccgggccacttcttcttcaacgtcccgggtcctggtgatgaccggcggcccgccctgcagctggcgccgggcgtcgacgacgcgtcggttgaaatcctgcaggatgtcccgcacctgctgctccgtgtactgggcgtcgagcctggcatcaagctcggcgtcctccttccggagcaggatggccgccggaccgaggccgctgatgttttcccgctggataaggcccttgacccaccagtcgggatcgtacgactcccccagcccgggaattggcttgccggcgtacttgaggttgtcgaacttgccctgcgccatggcatcgcggacaaggtattctgcccgggcggagtcgctcaccttcctgcgcttctcccgctccttctcttcaagggcgtccagctccgcttcttcctctgcgctgatgcctgccccgcggtaggtgcggagttcggcagcacgctccaggcgcttccggtactctgctgcaccgctccccattgccgccaccgcctcacgttagtcccaacgccttcctttccagtattcagaagccattggccgggttcaacgcccacccccaaacaacggcatggaacgggggccgggcggcatccgcttcgcttaagctgggcaggcgggggccacacggaggaggcagtgccatggatgccaacggaacaacggaacgctcggcaactttcagctggacagatccgcgcgtgggccttgaacacctgtcccgcctgtccgggctggagtacctctccggcatgcgggacggaaccattccgcggccgcccatggcgtccctgatgaacctggcccttgttggggttgagccggggcgcgtggaattcgaatgccggccggccgaagcgcactacaacccgctgggcgtggtgcacggcgggttggcctgcacgctgctggacaccgttgtggggtgcgcggggcacagcactctggccgctggattcggttacacgtccatcgacctgtccgtcagctacctccgccccatcaccctcggacaaggagcgctgcgggccgaggggaccgtgaccaagccgggatcgcgggtgatcttcgcccagggtcgcattttcgggcgggccggtgaactcctggccaccgccaccagttcactcctggtcttcgcagcggccccggcccggtagtccctgccagccccggcaagacgtaaacgtacgacggcgggacgtcccgccgtcgtacgcttcagttacgcgggtggcgcggcaggccgctcaggcgttggcgtgttcggcgaggatcgcgtcaatctggccgacggctccggtcatgccctcctccatgcccatctggaccatctgttccatctgctcctcggactcgaagatggtggcaacggtcatggtggtgcggccgccgtcctcctcaagcgtgaccgtcacgtgggtggtccccatggcctcgacgggagcgccgttgtggtctgcgaaaccgtcgtcgaactccagcctggcgggcggctggatggaggtgaaacgccaccacccgccggccttttcgccctccggaccggtcatgtagtagccggctttgccgccggcctcgaagtcgaacttttcgaaggtggccggccaggtgggcggcccccaccagcgctcgagctggcgtgggtcttcccagagttgccagacgcgttcgacgccggcgtcgaactcggcggtgagggtgaagctgagcgcctcaagattcttggtggtaccagtaacggacattgcagaccccttccttatccttcagccaaaatgtctgcgatccggtcgacgcgctgccgccagatcgcctcatactcgtcgagcagccgccgggctttttgcaggccttcatggttaccccgcacaatctgctcccttccgcgcttttccttggtcaccagggacgcgcgctccaacaccgccacgtgcttttggactgcggcgaaactcatggcgtagagggcagcgagaccggaaaccgaatactcgcccaccgtcacgcggcggacaatatcgcggcgggtggaatcggcgaacgcctggaacaggcggtccagttcgtcttcgcggagctgatctacaaccatttggttgtacgatagtcctgcccgtcccggctgtcaacggtctgtggaatcgggcttgccgctaccccgggacggccgtcccggccggtatcttgaaggccatgagcatcttccttgcaggcgccggcccggaccaggttgcctttccggaggtctttgaccgcttcgcccaggccatccgccagcgttcccgccaggaggcggctgcccgggtggcggtggtggtgcatgaccgcggcgggaacccggaaagcctccttccggcgtacgttgatccgctgctcgcgcggactccggttgaggtggtgccggtcctgctgggtgcgggcgcgcctgcaggcccttcagtgttcgacggcgttgacgggctggtcgtaggcggtggactgacgccggggtactgggaagggctcgccgcttcggcaggcgccgtttccgccgcggtggccggtggcgtgccctacctgggcttttccgccggggccatgatcgcacctcagagggcgctgctgggcggctacctcagccgcggcgttgaggtctgcggcgaagaatgctcagaggggttggccgagctcgagatccgggacggcctgggcctcgccccgttcgcaattgatgtccacgccgcccaggccggcacgctcagccgcgcagtgggagccgtggctgccgggctggtggagagggctgtagccgttgacgagaacaccgcgctggtgctggcagcggcaggcgatgacagcttcgaggtgctgggccacggcaactgctgggacatccgccggtccggcacggcctgcgtggtctccatgctgcaggcggattaagggccgggaccgagcggcaccagggccgcaccttatgcgtcgaagtgggttttggccctgtcgccggtcagttgttcaatcagttccgccgcgacgtccctcagcttctggttgcggttgctggagaccttggtgaggatgtccatcgcctccgcctgggtgcacctgttctgggccatgatgacgccgcacgccaggttgatggcagtccgactctgcatggcagcttcaagattgtccgcccggctttgcgccgtatcgaggcggacggaaagatgaagcgcgttgtgcgcggccgcagcgaagcccagggccttctcatagacacccgcggtgaacatgcccggcttctgcgcaaagaaattcaaggcaacactggcttcgctgttgatctccaggggcacccccaaggaactgcggatgcttgcctctgccagctttcgggtcagctccggccaccggccatccgtggcgacgtcgtcaataatcaccggggacatctcccgcagcgctttgatgcaggggccgtcgcccacggcctgctcaacctcgtccagctccaccgcgcgctggctgctgccggcaacagtggtgggcttgcgccgtaatttgagtgtgactgcacactcgatatggtcacctgccgcttcggaaaccgatgccgcggcaagcccggccagcccggtcaggaactcaacaacgttttcagcgcccaccagaatgctctggagctcttctattggttctttctccggtgaactcgacatgggcccatcttactgtcccacccattattgggctgcgtcggctgggcagcggccggcaagcggaaccagcgatgaacctgagcggctccggcatatccatagttaacggaccggcgtaatgtcggcagtaggagatttctggacagcggacatctggtgacattctcgggccccatccagcaaacagggcagcggccgccgccaaatacaagcgatcgactatgacatcgcgcacggagccggggttcccgcacccgacagcgacggagggtaaggatgtatcccctggggcccgacggacccgagcagccagaccgggaagccgaagaacgcaagggagctgcccggcgtttccgggaaacggacctgcccctggacaagctgtggacctactactacggcatcggcggggagatcgatgaggtgtcccttgatgcctacctccacgaggctttagacataccggccgcgcaagtgaacctgatcgccacggcgatgacggaaatgacggaagaggacacagagtgacggcttacggacacagcacaagcttcggctcagggcagcacgagctccccgacgtggacatgaggctgcaggagctggtgctggacagccgtgacatcgcggagttcctcaccgatctctccgtggtggccgcatcccggttctccaccccgggcaatccggtccattgcggagtcaccgtgatacgccataagaggcctgaggccgtggccagcagcgatgcggaagcacactccctggacgagctgcggaacgggttcggcgacggcccctgcctcaccgcactccgctccaaggcgccgctgctggttcccgacctcgccagggagtgccgctggcaggactacgtgcaggccgctgtggcacgaggcgtttcctccatccttgccgtgcccatggatctggccggtgaggcagaggctgtcctgaacctttactccgggcgcgtcaacgggttctcggcacatgacctcgccaccgcggaggctttcacagggcacgcagcaggctcgctgaagctggttctgcgcatcacccagttgtccgaagccagaaatgacctggcactcgccctcacatcacggaccatcatcgacatggccgtgggagcaatcatggcccagaacaggtgcacccgggacaccgccttcggcatcctcaccaaggcttccagcacccgcaacgtcaagctccgcgaagtggccgcggccgtgatcgcctccatctccggcgagaaggagatcgacacctacttcgacgagtagggtcctgtctgccagggacaacaggttcagcgcaggcgggacgtgatgagactcacgcgcaacattcttgaggccggcccctgccgctgggcactatggaaaggcaccggcaggctggatctgcccggccaggggagtgtctgcgacgcccggtgtgcttggtcacatccggccagctccggttgccaacccccttcggcaacctgcaccattgaagtacgggaacgcgctttcccacgcagtaccgcctcatagacgaggccacggcctggtcaatgaagattccaggccgcccaccgcaagaaatggaagttgaataatgacgttcgatgccactgactccgtgaccctgaaaatctgggaccggtccgccctgcaccacacccttgactccgctgtcagcgagctttccgcgcggcacaacaccaccacctgccgcgtcgccgtaacgtgcagcgggcccaacaccttcaccctgagcttgcgcggcgaaggcaaggcactggcctccgcctaagcggccacccctgaaaggcaagcggacgacgccggcactccccggcgtcgtccgcttcctttaagcgaagcacggcatccttgcccggcccccgcacacggcaagtaaaatgtgttgagtccaagcggaagcgccgtccgagcatcaaaggtaaccatgaggcagcaaccacgggcgcaagccgaacccggtgcaccgggcccaggaaagatgagcccggcacagacgggcaaagaacagccggacacagctcagccgggcccggcgtcacttgtattgatcccctcagcccttgtctcggcgtcgggcttcctgctgtttgcccgggaggaccgcctctccgggttcctcctcctggccgccgcgctggtcatggccggtttcatcagcaggcgcctcctggtcgacctggccctgatcgccgtgggcctgacggccatgagcttggtccccatcaccacggacatcagcaccgagcacatgctggtcatgggaaccgccatgatcctcgccgtcgggattccgtattcggtctcaaggttcgtcaccaaggaccacgccatccgcttccccatcaggacggggcagccgtggacgcgcgccgaaaagtggtacctgcctgccgtcctggtgatcgggtatgcgctgatgccggtgtacatgatccggaccggcgtctacaccaactggccggctgtcagcgacccggacggcatcgcacggctcttcctcggcaccaacgtgctgggaatctgggacgaactcttcttcatctgcaccgccttcacgctgctgcgccgccacctgccggactggcaggccaacctgctgcaggcggtcctgttcacgtccttcctttgggagctcggcttccattcctgggcgcccttcttcatcttccccttcgccctgctgcaggcccgcctgttcacggtcacaaagtcgctgtcctacattgtcagtgtccatctgctgttcgacttcgtgctgttcctggtcctgatccatgcccacaaccgcgagtggatcgacattttcctgtactgaaacctgcagcatgaaagcgaaccaccatcatggatgctcccgccggcggcaacgcccgttttgatatagctaccctgccgttgccggttatccaggcgccgatggcgggagggccgtccacgccggagctggcagcggcggtgagctcccggggaggactgggattcctggccgccggttacaaggccgcggcggcggtgaagtcggagatcgaggcaacgcggcggctgaccggagcccccattggcgtcaatgtcttcgtcccgcaaccctcggcgatcagtcccggggcgctggaacggtacgccctctccctggctccggacgcagaacgtttgggcgttgccctgggggatccgcgccatgacgacgactgggacaacaagatcgacgtcctgctggagcaggtccccgaggcagtttccttcaccttcgacgtgccggaacccgctgtcatcgccgcactgcaacaacggggcgcgtgcgtcatcgggacggtcacgtcgcggcctgaagccgtgcgcgccctggaagcaggcgttgatgcgctgtgcgtccagggaccggaagcgggaggacaccgcggcacctttgacacagcgcgacgcccggagggtgaatccctacacggcctgcttgaagaattggcggacctcggagtgccgctgatagcggccggcgggatcgccacgggcgctgatgtccgggctgccctcgcccgcggagctgtggctgtccaggcgggcacggcgttcctccgcgctgacgaggccggcaccaagcctgcccacaggcgggccctgtccgcgggacgcttcaccaccactgcggtcacgcgggccttctcggggcggaacgcccgcggactttacaacgaattcatgcgccgccacgatgacgaggcccccgacggctacccggagatccaccacctcaccactcccctgcgcgcagcagcagccgctgccggggacgcggactggatgaacctgtgggccggaaccggtttccagcggacgacggcgggccccgcctcggccatactggcctccctccagccgtagcccgagggagtcaggcctgccctattcctcgcccgtgtcctgcgcttccaggaacctgtccatggcttcgcaggcccgtgtccagcgggcatgcagggcgtgccggctcaacggttcggacatgccgttgagcactttctcgatggcatcagatgcggcgtcccgggcccggtcctgcgccgccggggtgtagtagttcatgccggttattcgttacgcccgcagcagcggatggcgggaatacccgtccacgcacgacggcggccggccccttcacgggaccggccgccgtcgaacgcgctgtgttgctagagggtggaagtgtcgatcacgaagcggtagcggacgtccgaggcgaggacgcgctcataggcctcgttgatcttctctgcggggatgacctcgatctcagcaccgatgccgtgctcggcgcagaagtccagcatctcctgcgtttcgcggatgccgccgatcatggaaccggcgaaggaacggcgcccgccgatcagcgcgaacgcgttgacggggagcggttcggcgggggcgccaacgttcaccagggcaccgtcgagcttcagcagctgcaggtaggagctgatgtcgatcgaggcgctcacggtgttgatgatcaggtcgaacgtcccggcgaggtcgctgaaggtgttctcgtcgctggtggcgtagtagtggtctgcgccgagcttcaggccgtcttcctgcttcttgagcgactgggacagcacggtgacctcggcgcccatggcgtgggcaatcttgacagccatgtggccgagcccgccgaggccgacgacggcaacgttcttgccgggtccggcgccccagtggtgcagcggggagaaggtggtgatgccggcgcacagcagcggagcggcgacgtcgagctcgagtccttcggggatccggaccacgaagtcttcggtcaccacaacgtgggtggagtagccgccctgggtgatggtgccgtcgcggtcaacggcaccgtaggtgcccacgttgcccttgaggcagtactgctcctcgcccttcaggcagttctcgcactctttgcaggagttgaccatgcagccgacgccgacgcggtcgcccacggcgtgcctggtcacctcggagcccacctgggtgacgacgccggcgatctcgtggccgggaaccagcgggtactgctgggggccccagtcgccgcggaccgtgtggatgtccgagtggcagatgccggcgaacttgatgtcgatcaggacatcgtgggggccgacttcgcggcgttcgatggtggtgggaatgaggtcctcagtggaggacggggatgcataggccttgacggtagtcatgggtctcctggggttctgttgggggttattgaaatgctacaggggctgagttccgtcaaaccggatacagcggcccttagcggtggccctgttgtaactggttctggcagtcctacccttggcgaccctcgtactgggcgtcagtgatgtgctcagcccagagggtggtggctgcggggtcgtcgtcgttttcgaggatggccaggtgttccatgaaggtgccctgggccgaagcatgccaatgctcttcgcccggcggagcgtagagggtctggccggggtggacgtcgatgatgttgccgtcgcgggttccgaagcgtgcaacgccggaggtcacatgcaggtactggccgcgggcgtgcgagtgccaagccgtgcgggctcccggcgcgaagcgcaccttggcaacaacagcgcgctgctccggcccgtgagggagggcgatcatgtcaacccagacatcgccggcgaactgctcgggcgggttcttgagggtttcgcggacaggctcgatgttcatggggtttcctttcgaacgtgaactaccctccatcaaaccggctgtccgtgaaggtagcgagggccctgctgaaccgggttttggcagtccctcctttgggcgcagggattcgtcgtaacgtgtcctgtatggataaccgagccgaggtacggcagttcctctccacgcgccgggggcgcatcactccggaacaggcgggcattgaaccgtacggcgggcggcggcgcgtgcccggactgcgccgggaggaagttgcccggctcgccggggtcagcgtggactactacacgcggctggaacgcgggaacctctcgggtgtttcggaaagcgtcctggacgcgatcgcaggtgcgctggagctggaccgcgccgaacatgaccacctgtacgacctcgccaggaccgccaatatgtccggccggaagcgtgccgccgcccctgcaccgtcaggcgtgcggcccgaactgcggtacctcctggacaccatcaccggggcaccggccttcatcgggaacaacaggctggacatcgtggccgccaacacgctgggctacgccttgtactcagacatgtaccgggggcccgcccgcccggccaaccattcacggtttatcttcctggaccccagggcgcacaacttctacacggactgggagagggcggcgagcaccaacgtggccatcctgcggcgcgaggccggccgcaacccgcatgacaagggcattgcggaactcattggcgagctgtccatgcgcagcgacgagttccgcacccgctgggccgcccataacgtgcggcggcactatgccgggaccaaatttttccagcacccggtggtggggctgctggaattgaactaccaggtcctgggcctggaagaggaccccgggcactcgctcaccgtgtacccggccacgcccggcagcccatctgaggaagccctgaagcttctcgcgtcctgggcggtgacggaaaacatcgcggaactggcccaggcgaacgcgcggagctaggcgggcgtttcctcttgggccggttccgccggatcaagcacggattcatagccaatgagccagtggaggccgtgctggtcgatcacctggccgtccgatgcgccccagggcttgggaccgagcgggtccaccacccggccgtccacggcaagtttgtcgaaccacccgtggaggaccttcggctcggcggtgcccagcagcgagagcatgaccccttgaaggcggacgctgttctgcccttctgccgcgtccgaacccgccacggcaaccacacccttgagcactccatgggctattgcgtccggtggcccgtccgtgcgcccgaactcctcatagctgtgcaggaaaagttccccgccgaagacgtccgcgtagaaactcaaggcttcacgggctgtgccgggaaagctgacatagatctggggtgccgtcattcgcccagcatacagacggcaagctgggcatatggggacgactgccggctgcagagcaggctggctgggttggcgcgccggtgcttagctgccctcccgccgccagcggtagggcgtcgtggtggagaccttgaccagcccggagcgctccaggatgggcctggagaactcggttgaatcgctgtggatgagcgttttgcccaggccgagggccgactgtgcccggcgggcggtcaaagccctatagatcccgcggccgcgccattccgggcgcgtggcgccgccccagatcccggcgaaggcggtgccctccaccggttcaaggcggccggcactgacaatccggccgtccgcctcggccacccacagctgcatcccgtcacccagtgaaagccggttcagcagggcatcggccatcccatcggacaccggatcgccaaagacttcatcctgcatggcggtcatcgcccggacgtccggctcatccaccacctgacgcaccaccaccccatcggggagcggcacgggcacgctgagcgcctgcgtgcctccgatcatgatggattccggcgaatcagggacaaagccgtgggccagcagcccctcatgcagcccgggggcgtggtcatggctgcgcgtcttccattcaacccgggtgatcccgggatcagccaggaagtagtccaccgcctcccggaccagccggcggatggcatcagagccggcatccccaagatcccggtaggtcacaaagccgcggccgtcccggaatgccgccaggtgcaacggtccgtgccttttcactgcgacggcgccgggtgtctcggcatccgtgcgcagctgttcatcgtaggcagccaggaaccgtgcggattcactcattccgcgagcttcctggtgaccgccgggatggtgtgcttggccggcgcggacccgtcctgggttgcctccgcaggcggctgcggtttgtagacccaggccaccaggacaactgaaataatcatcagcaggaaccaggccacgagcttctccaacccaacgggctgccagccgtccacctggctgggatacagccaggcgccggaccaggtggcgatgttctcggccacccagatgaacagcgccaccagcaggaatgcgatcagcagcggcatcctgtggcgcttccggaacacccggaaatgcatcacgcaccggccaaagacgatcacgacggcggcgagcagcgcccagcgtgcgtcccagatgtagtggtggctgaaaaagttgacgtagatggccccagccacggccgccgtaatccagcgccgcggatagcgggcgaacctcaggtcgaagagccggtagacacggaccatgtaggacccgacggccgcgtacatgaagccgctgaagagcgggaccgccccgatccgcagaaagccctcggcctcgtaggaccaggagccggcgtcggtcttgaaaagctccatcaccgttcccaccaggtggaacaggatgatgacccgcagctccttcagggtttccagcctgaacgcgaccatgaggacctggatcagcacggcggcgagggtcaggaagtcgttccttgccagtccggccccgtccgggtaccagagccgggctgccatcagcaccgcgagcagggcggcgccaaagatgcacgcccaaccctgcttcaggccgaagaccacgaattcggtgagctttggccggacgcggctggcaggggcgctggccaggaaacggcgcgcccgctcgtcaagccgcgcctccagcggagtggagctaagcactcacgtgccctgcccggcgggagaaagtatccagctccgagaggcagtagttcttgaaccagtgccggaggggctgcggcagcctggggtaggccacggcgagggctttcatggtgcggtggaaccggcgctcgtggcgcccgctccacggcaggccgaagtcattgcgcagctggtccgggaggaggccggccgtcaggaacctggcgaacggcatgatggtgcggtaccagagtgctgcatgctgcggatacaggagtccgcggcccacacggacggcagcgtcgcttgcacggaggccggccatgcgtgcgtcatagtaccggccgaacgcgtcacggtccttcggccacatgtccggcggcagctgcagggctgtgcccagcttcgcgtagtcccggtacatggcgtctgcggactcgtcgtcgagcgggccgtagattttctcgatgatgaccagggcagtgtcgtaaagcgttgccgtgacccacagctgcagctcggggtcgtaggcgttgtacccgggcgtttcgtgatcggcatcccggcggacggggacgtgggcgcggttcaccctgcgccggacctctttgacctgctcgtcagtcccgtaggtgacggcatacacgtaggtcagggtgcctttgagcctgttgatggggcggtccgtgaaggtgctgtgctctgcgacgccgcggccaacaccgggatctgcaagctgcagcagaatggcccgtcccgctcccgcgagcaggatgacctccgcgttcaagtccgcaagttcccgcgccattccctcagggtaccggagggggggaagggatggagccggcctgggaagcctccttacttggcgaacctggcctggaacgcgatggctcccgcgctgagcgccagctgcgcgagtaccagcatcggcgacgcggcgtccaggaacagcgcaagcatcaccgggaccataacaaggacagtcaggtccgtgccccgcagcagggtggacaactggtcacggggaaccggcccgaacggggtttcaaccggcggcctggaccagtccgtggcaggacgtgcagctgcgcggagcgtgccggcggccatgccggcgccagctgccacccccagcgcgacgagcagcggaccggcagcgcccagcgcagcgaggatcccggtcagtccgcccatccagaaggccaatgccagggcaggcatcacgagccggctcagccgcaccagccacggggcaaggggaaccagggcatccagttccggaatgagggcggtcctccggatcacccttccagtccccgcagccgtggcgcagcctgcgatgaccatcactgcgatctgcagcagtgcaggcagtgcgggatggatcaggaccacgccgacgcaggtggcaagcgacagcagcggcccggcaagcggcggccgcagccggaagaaagccaccacatccgcgcggaccaaggcatgaaaggctccgcggaccggcctggcgtggagccccgcaccccaacggcgttgccgggaggcccccggttccaccgcaagggcgcggtggagttcgttggcttccaggaagaacacggaggcgtggacatgcccggagaccgcaccgccgcgcatcaggtcggcgccaggtaccgagccggcacgggctgccacgcaggcaagcatccaggcggcagccgcgagcgcggccggcagcggccagaccgcctgcaccaggaacggcaggaccgctcctggcaacaggcccgccagcaggagggcccggcgtcgcggttcctgccgctgcagcgtcaactgcagggcggcggcgccggcgacggcgatgactgccattgccccaaaggtcgccgctgccagcaggtggccggcggcctggcggtccagggcggtaaggacactgaagggcaggtaggcgacggcggcggccaaccccgcggccagggtcctgcgaaggaaagcgggcagcaccaaggggcgccggtccagcggcaggggcagccaccagaccgcctcggcagggctggccgtgactggccccagccttcgcgcgagcacggcaagggaagccaggcccgcgtaggtcagcaggacccagagaacctcggcagggaggacctgccaccggccgtccacaaggctgcgctccaccacgccgcgtccggcaatctggtcccgcagtgccaggacgaaggacaccgcgatggcggcaacgcatcccagggccaggacagtggagtacacatcgaggaggacgtcccgcagcgctgaacgggtccggttgtaccggcgcgcagtcccccgggtgaaggccacgatctcccgggcgaggcccggccctgccgcggagctttgaccacgtgttgccggacaagccgccgtctcaggatcccgcaatggctgacgccccctgcatcgggtccacaagttccacaaaatcgccgacaaccaggcactgtgtggctgtctgcacgagcaggcgtggatcgtgcgtcaccaggaccacagcggcgccagctccagcgtggcctcggatccgacggcccagggcatcccgcatgacgggatccaggcgctgctcaggttcgtccaggatcagcagggacgacggccggatgaaccccgccgccaggaggagccgtcgccgctgccctgacgacagggagtccgggactgcgtccgccctgcccaggagtccaaaaaatttcagctcggcggcgacggccttgtcaggcgacgccaccgaatgcccccgcgccacgagcagaaggtgctcgcgcaccgtaagcgacgggaagaaaacatcctcgtcaaaaaccgcagcaacctgccggcggaacagcacggcgtcgggcattaccggaagcccgtgaaccagcgcgtcccctgccagaggcagctgccgcccggccagcgtccgcaccacggtggacttgccggcgccgttgaccccaaccaccgccaggacctcacccggttccacggcaaccgtcacctcgccacacaccggtgtatccccgtagcccaccagtaattccctggcctccagcactgcccccacacctgccattccaccaccctaaaccggccgggcagcaacggattgcaacagacaagtttactttacagtcaagttcgctttacgctgaagcatcgaataacgacaacggctggggcctgacatgacggagaacaagaacagtgcggcagggaatcgggtgcgcaccgcctggggacaggcccggtttggtacccgcagagtgccggccatggcgcccgccatcccactgggaatccttcttgccgccctggccgcggcagctgccgccctggcgggctttgctccgcagcggcctttgctgggtgcggtcgtcgtggcagccctcatggtcctgcccctgtgtgcactcgcctgggcgttccttgttgaccgggattccctggcgggggcggcctcccgcccggaggaatccgtagagtcgcgctggtatgacaatgccgcagcaggagcattccacgacctgctgatcttttccggcctaggaacagcggtactcttcctgacgcccctggaaatcgacggttcagtagcgctgctggccgtcagcgtcgtgggaatgctgtccgcaggagtgcgctacaccgtcaaccggagacgagggtagccttggagaacacccttccggaactgcgcagggagcatggctggtcgcagcaaaagctggctgatgccctgagagtctcgcggcaaaccgtcatttccattgagaagggccggttcgacccctccctccccctggccttccgcctggcatcactctttggctgcaccatagaggacatcttcacgcccggaagctagcacgagcaacgcccgcagaaaatcgagtacccaccactcgtgccctccatccccgctgcccgtagcgtcctacgaaagcccgcgggcatcaccgcgggaattccggctgcgaggggggtcatgggctgcatcgaggcaccgacatgacccagccgggcgattacgttccgccccttctggaccccgcagtgctggagcggctgcgcgacgaactcgacgatgacgagggcctgtggaaggtcttcgtggaggccttcatcgcggagatgcccccaaggctgcaaaaggtacggctggccttgaccaccggggacctgccgggtgccatggatgcggtcctgagcctcaagacctccagccagatggtgggggcggaaaggctcgccgccctcgccctggagcttgaaaggtcgctgcgggaggaagccaggacagccgaccccgccattgttttgccccggcttgcggcggagcacctgcggcggctcaagcagtgcgcccagcgcaccatctatgtcctccaggaccacctgaggaaggggccctgaacgaaggcactgagtcccgtggactaagacggggccttgcaacagcaaggcgtgcgacggcggaacctcccgccgtcgtacgcctgcaaattgggcctaaagacaccagcaaaaagtgctggggacagtgcatactggcgccatgactgctgcagcgcgaaaaccggaccggatcctcttcgtgctgttgggggtcatcggactgctggtggtggtggcccttgccgtggtgttttcccgtggagatccggaacccctcgatgaggccagcccggcaggagttgtccagcggtacagcacggcggtcatcgacggcgacctcgaaactgccgaaacatacctcacggattccgcccgcaccatctgccgcggctcgtacttcggtgagccccggcccgcccgggtggtcctcgtgtccacgtcggaacgggaccagtcagccaccgtgcgggtctcaatcgtcaactcgtcccaggacgggcccttcggcccctccgaatacgagtcggaggacatcttctccctggtgaaggcggatggagactggaagatcagccaagcgccgtaccagctgatggcatgcaccggaacgcagatcaaaccatgagcgccccggcaggcatcacggtttcgacggcgggcctcgcccaggtgacgctgcgccggctcatccagtacgccctgttgttcgccctggtggtgattgcggccagcggccttagcgggctgctggaccggctgttcacgtcaggcgcggtcctcgcatccacggacgtggccgggctcgcccggtccctggccttcaccctgatcggcggtcccctcgccctgcttctgtggtggtttgtgtggcgcaggctggacgacgaggcggaacgcatgtccgccgggtggggcctctacatcaccgccatgtacggtgtttccctcatcgtcttcaccacctcgctgttggggatggctgcctcactgatagggcggcgggacagtgactgggcgtcggcgcttgccaacgccatcgtatgggcggccatctgggcgtggcaccggtggatgtggaagcacccccggaagcccaccgtccacctggacgacgtgcgggccgtcgtcggatccgtgtttggcctgctgctcggcgccggtgccggcatcgccgcgctcagcggcctgctcgacgtcgccatccgcggctttcccctgacggtgaccgttgagccctggtggtactccgtgttccgctcgctggtgtgggcggcgggcggaaccgtggtctggtggtggcactggttcagggagggcggacgccgcttccagaccagcctggttgacagcatcatgatcatcgtgggggttttcgcggccggcatcactgccctcggcggggccggtgtggtcctgtttgtgttcctgcggctggcgttcgaccgggacaaccccatgaacgacctgctggagccgctggctccggccgtggccgcaacactcgttggggcgctggtgtggcgctaccaccgcaccgcgtccatccgccggtcccccgccaccatgcgggcgagcctcctggtgacgtccgcggttgccctggctgcatccgcttccggggtgggcgttgttgtgaacgcgctgctggcagccgccgtgtcgccgctggcgggaggggccacgcgcaccctgctccttggcggcatcagttccctcctggtgggcgggccggtctggtggctggcatggaagccccggaaccagccgcaggccgccgagtccatcccgcccggacgccgcgtgtacctcatcgcattcttcggggtcagcgccgtggtggcactcattacgctcctggtgatcggctaccgggtcttcgagttcctgctcggggacgtcacgggcggcagccttcttgaccgcattcgcgccccgttcgggcttttggtggcagccgcccttgtggccgggtaccacttcgccctgtggcggcacgaccgtgccctcctcgcagccgcccagccggcgacgaaacggaccatcgagcaggtcaccctggtcatcgggcaccatccggatccggacaccttggcaaagggcgttgcagaggccacgggtggcgcccgggtcaccgtctggctgcgggcggacgacggcggcccggcacttccagcgtcgggttcagcttcagcgggggcagcttctcaagcgccgactgaaacggtgagccaggtggccgccgccctggacggagtcacggcgcagcacgtactggtactcgtgggcgacggcaggctggacgtcatacccctgcacagcccgccaagatagcgggagtttttgtccagatatgcaggcttcagcggcacttatccctgcatatctggacgaaaactctaggcggaggtggcggctggatggctttcgccgaagctcagcagcactttcccggactcggccgagttgcgcgccacgctgaaggcctccagggcctcccctacggggtattcgtgcgtgatgaccggatcgatctgcagtgagccgtccgccagggcggcaataacctcgtcgatctcatcattgaagcgaaacgagcccttgagctccagctcccgggtgatggccagggagatcagcaccggctgggggccggtgggcagcagccccaccatcaccacggtgccgccgcgggtagcgccctggatggcggaggcgaggccatgatggttgccggaggattcaatcacgacgtcggcctccacggcggcgatcgcctcgctgtcaccggcggcgagcacgtggtccgcccccacggctttggcgatgtccaacggcttttcatgcatgtcgacggcggtgatccggctcgcgcccgcccgcttcaggactgcgacagcaagggcgccgatggggccgctgccgatcaccagcgcggacttcccggcaacatccccggcccgcgccactgcgtgccaggccacggcggcgggctcgatcagggccgcgctgcgcaggccgatgccctccggcagcgtccggagcatccgggtggggaggttcacatagcggctgaaagccccgtccttgtgcgggaaccgggcagcgctgcccaggtaggtgcagcccggcgaaaggttgggcctgtccgccgggtaccgggcagcaccggggccgggtgttgccgggtggaccgccacaggagtagcggcggcgggtcccgtcccgtcagctgcggcccggacaactgtcccggaaatctcatgccctagcaccagcggcgccttcaggatggattcgcccgcggcgccgtgcagccagtagtgcaggtcggagccgcagatgcctccgtagtgcacctcaatcacggcttcatcctgggcgggtggagcaagggtcagttcgtcgatccgcaggtcgcccgcggcatgggccaccacggccgggccggtcacgggaaggaccggggagggaagggctgcgtcggccagcatcagaccaccaccgtcattccgccgtcaataaagatggtctgtccgttgacgaagtccgagccccgggacgccagccacacggcgggtccggcaaggtcctgcactgtcccccaccggttggccggggtacggcccaggatccaggagttgaactgctcatcgtccaccaggttctgggtcatctccgtgtggatgtagcccggcgcgatcccgttgatctgcagcccggacgccgcccactcagccgtcatggcacgggtcaggttccgcagcccgcccttcgccgcgacgtagggggcgatggtggggcgggcgaggtctgtctggaccgaacagatgttgatgatcttgccgtggccgcgcgggatcatgaaccgcgcagcctcgcgtcccaccaggaaggcgctggtcaggtccgtggagatcacccgttcccagtccttcacgtccaggtccagcatgggcacccggtgctggatgcccgcgttgttcaccaggacctccagcggccccacgtgctcctccacccaggcaaccccgcgggcggcctctgcgtcgctcgtcacgtcgaacgcgacgctgtgcacccgcccgggcgcgaagtcggcagccatcgcggccgcggcatccttgagccgctcctcgttgatgccattcagcaccaccgtggccccggcgtcggccagcgcccgtgccagcgcgctgccgatcccccggctcgaaccggtcaccagggcaacccgccccgtcaggtcaaaaagtgaactcatgcgaagggacctgcctgcaccaggttggccggggcctgtcccgccgccagggcctcaagctgcctccggaggagcttgaggatccgcggctggaaggccgaggcgttgccgcccacgtggggcgtgatcagggcattgggcgtggaccagagcgggtggtcctgcggcaagggctcaggatcgacgacgtcgatggcgcactgcaggcgccccgacaggacctctttggtcagggcagcggtgtccaccaccgagcctcggcccacattcaccaccagggcgccgtccgggagggcggtcaggacctcttcgccgatcagccggtgggtatgcccgttcagcggcagcaccgacaccaggacgtcgtgcgaggccgcgagcgcggccagttccgaggacgcgtgcacctcaccgtgttcatcggtgcgggccgagctgcccacccgggtgacggtgacctcaaacggctcaaggcggcgggcgatctcctgcccgattccgccgacgcccaccagcagcacccgccggtccgccagggactggcgccgctcaggccgccagaggccgtactgctggtcacggaccgcctggtcgataccgcgcagcttggccaggatgagtccgatggcgagctccgccgtcgccgccgcgtggactccggaggcattcgccacaccggctgccgggccggcggcctcaatcacgccgtcgtaacccgtggactgcgtctgcacgtacttcagcccggaaaccttggcgagggatcccaggaccgcgccggcgttgatgtacggcaggatgacgccgtcgatctcagccagcgtcccgccgtcgggatccgtctccaggtcccagaccactccctgcagccctccgggcaggggtgagagatcgtcgaggagctgctggtcggggaagctgacggtgcggactgtttgcatgggaagaacctatcaatgggtgcggtcaggtggtggggcggcggtcagcgtcggtcgaaggtgaggccgccggggacctggaaggtgggcatgagctccagcatgccaacattcacgtgccggggtgtttcgatggcgtaatccatggcgttgacaatgtcgtcggtggtaagcgattcgtagccctcgtagtaagtcctccacgcttcctccatcgcctccggggtcccgcccatgttccggccgaagatctcggtctccacgcgtcccgggcagatttcggtgacgcggatgcgcttgcccacggtgtcgttgcggagctgccgggagacctggtgcaccgcggccttggtggcgtgataaaccgtgtggccgtagaagttgtaggtgccggcgatggagctgacgttgatgacgtgccccaggtcgcgttccaccatgcccggcaggaccagtcgggtcagctgcagcagtccccggaggttgacgtccacgagttcgtcaatgtcgctttcgctggagtccaggatattgccggggcgggagactccggcgcagttcaccaggacgtccacctggaggttcccgacggcggcggacagcgccgcggtgtccgtcaggtccaccacgtggggcaccgcgccggtcttgtcggccagttccttcaggcggtcttcgttgcgggccagggcgtggacggtgagtccgcgcttggccaggcgttcggcgatcgcggcgcccatgccggtggaggcaccggtgacgagggccgttgagtaatcggaaaaggacatggaggtctcctaggaaggtgcagcagcgtgctgcgcgggtagtggaaattcggaaaagcgtaaagtcaggcgtcgcggaggggcaggtgcgcccggtccttgaccgtgctgaccgcggccagcgtgcccagggcggtgatgaccgcgtagaaagcgggcatgtagatgttgcccgtggaggagatgagccaggtcatcagcagcggcgcggtgccgccgaagagtgcggaggagatgttgtagcccagaccgtatgcggagtaccggacgcgggtggggaagagttccacgatcaggatgtggattaccgcggtgtgcccggcgaagaccacggccatgatggaggcccccaggatggcaagtgccatctcgccggtggcaatcagcgcgtaggaggggatgcccaggacggccatggcgatggcggaaccggcgatgaccttcttgcggccgatgcggtccgagagtgcgcccatgaaggggatggcgatgcagatgaccaccaggctgcaggcggtgaccagcagcgcctcgccgatggtgaagttcagctgcttgcccttgaggaaggtgggcatgtaggagaacaggacgtagtaaccggagccgttcatcagggggatgaagagtgccagcagcatggcgcggcggtgctcgggcgaggcaaaagcctccttgagcgggttggcggacagcccgccctcttccttgagcttttcgaagttgggggtatcgctgatgaccttgcggatgtaccagccgatgatgcccatggggatggccaccaggaacgggatacgccacgcgaatgatccaaagccgccgccgtcgatcgcttcctgggttagccagggggacatggaataggcaaccagggtgccggtcaggagggccgcgaacgaggcgatctgcgcgtaggaggtgatgacgccgcgcttgccctcgggggcgtgctcggcaaggaaggtcattgcgcctgcagcttcaccgcccacggaaaagccctggagcatgcggagcagcacgagcaggacgggggccgcgacgccgatggccgcgtacggcggcagcaggccgatgcccgcggtcgcaacgctgatcaggaggatgacaaagaccaggagcttttgccgcccgatccggtcaccgaggtaaccgcaaacgacggcgccgagggggcgcacgaagaaggagacggcgtaaccggcgaagacaaacaggagggcgttgtccgggtttccgggggccaggaagacgagggcaagcgttccagccataaaggcgaagatgccgttgtcgtaaagttccacgaaaatgccgacgcagccggccgtgacgaccttgcgggtctgcttgctgctgagccgctcctggtgcggctgggccgcatgcgttgaggtggacatggcgttccttacttaaggggatggtaacaatgcttttcgggggaagcgagagtcttcagcttccggccgccggcgcgagccggggcgggtccggggggccgcccacgccgaggagggaaaacacggtgcccaccgtggagcggagggtttccagttccctcagcgctgcccggtgtttcgctgttgcctccgggacggtggttttgcggaacgtgattttgtggccgggccgggcctgcgccaggacgtccagcgagcggctggtgaccacggccaggacggggtagccggcggttaccccgcgtccacggtgcagcaccaggagttcctcccgggagggcacttcgatagcccctacagggacaccgcgggagagcacctcggcggtggactggcgttccggaagtgcacctcccagccgcaggccgatgtggttgctcctgccgctgacggtgtactccgtgctgtagagcaggtccgccgtatccccgaactcttccacgtccggaccgtccgttacttccaccactgcggtgctgtggaactccgggcgggtcaggcccaggcggaacagcgggaggtcgaagtacggctgccggatgggcgggacagttgagaaggtttttagttccgtgccttccgtgagccgcagcccgaatccaacgacggtgtccggcgcgcagctgcccaggaggaccggcgcgtgcactgacccgtggaccgctatgtaggcccggaggccgccgtcgagcctgcgtagcgccactgtctcccctgcccgcacggacaccggctcccactgctggcactggcgcccgcccactgtgaggtgcaggggtgcgcctgtgacagcgatgagaatgtccgtggtggcccgcatgcggaagtccagagcggtgatttccagcaacggggcgttgtcgccgttaccggcgaggatgttggcggcgcgggcggaaaactggtcaagcgcgccgttcacgggcagcccgaaccgtgggccgcggaagcgtcccaggtccgtgaccacggagtggccgggctgctggatgatcaggctcatcgggctgcctccagtttccggccggcgaaggcggcgaactcttcaagctggatctggtgaaaccggagccggtcgcccggtacgtaaggaaccagcggctcggctgcggcatccaggacagtgagcggggtctggccgatgacacaccagccgccgggtgcgacggccggagcgatcactgcctggcggccggccacggacacagccccggcagggacggagaggcgggggtccttaagacgcgggaccggcagcgggaagtcggggccgtccatcatgggcgaaccggcgggtgcacccaggcagcggatcacataggacttggccgtgtgcagcgtgatgatttcctcgacggacagctgctgttgttccgctacgcgttccaggtcgggtccgtactcgccgccgtaaaccaccgggacgttgaactcgcggggggcgcgggcgggggcgccggtgaattcgagctggcgcaggcccagcagtacgaaggcccggacctggcgggcggacgtgacgccggggtcgaattccacgagcagggagtcgtacgtaggcaccgcgccgtggacgccgtcggctccggcggcgtccagccattcggcaagggcatggacggtggcccagttggcctcccggtccgcggacgatgcgacgacgcgcagggcagcgtccccggattcgaagacctccaccggaggcagcgctggtgtgggagcggcggtcatgtcaggcggcttccgctttggcggccaggacttgggcgagcggggcgatggtcacgccggcgcgttccagttccgtgcggacctgccgtgccagctggaccgcgccgggggtgtccccgtgcagcaggatggtgtccgcgacgatcggcaggtcggttccggcgacggtttcgatcaggccctcgcagaccatgcggatggtgcgttccacgatggcggagggatcgtggatgacggcgccggggcgggtgcgcggtaccagtgtgccgtccgcctcgtaggcgcggtccgcgatgcccacgatgcccacgggcagctggcgcgcttttgcggcgtctgcgagttcgccgtcctgggccaggacaatcaggtccgggctgacgcgggcggcggcgtcggcaacagcctgggcgtagtcgggccgggtggctacaaggttgccgaggcgtccgtgcggtgcgaggtgtacgacggcggtgccatggtaggcggcgaaggcgccgagggctccgaactggtacaggacgtcgttgcggacttcgtcagcggtgaggtccatggcgcgccggccgaagccgcgcaggtccgggaagctggggtgggcaccgatgctgacgccgcggcgcacgcactcggcgaccgtggtgttcatgatgtccgggtcccctgcgtggaagccgcaggcgatgttggcgctggacactacttccaggagggccgcgtcgtcgcccatggagtacgtgccgaagccttctccaagatctgcaacgagatcaacgatgggtcccatgtgagccctccttgggggtggtggcgcggcgctggccaggggaagcggcagctgccggaagcggaattctgtggaccagccggaggcggcctgggtcccggggcccggaataccgggcttgtagaaaaagtctgacaccgggactttgatcacacaaagacgtaatcggtgtcacgggataggtgccggttatgacctgcgcctcttgtggacggcgtcctgcccggcccgctggtgcggaccgggcaggactgtttcgttgtacgggcaggtgggacaggaggagtcagcgcagggctttgcgcagtcccatgacgcgttccacgaccaccaccacggcaagcgagatgaggatgaggatcacggagagggctgcgacggcggcgtccgcggagttttccacgtacctcagcacctgcacggggagagttggcaggcctgattcggccacgaacagtgagatcacggcttcatcgaaggagacgatgaaggcgatgacgccgccggcgatcacgcccggctggatgatgggaagggtcacgcggcggaacaccgtccaggagtcggcgcccaggatgcgtgcggccgcctcgcaggacgtgtccgtcgtggccaggctcatcagggtggtcctgatgacaaacgggatggtgatggccacgtggccgatgatgatgccagcgtaggtgttgttgagttccagtggaccaaaaagcagcaccatgcccagcgccaggacgatgctggggatcagcagcggcgagaggaagaacgactgcacggcggcctttgccctgaattcgaagcggtccagcgccagcgccgccggaacccccagcaccaggacgatgagcgtgacaatgacggcaacgatcaggctgaccttcatgccctccatgaacgtgctttcctgcggaagcatttcataccacttcagggtcagcccctccggcgggaaggacaggtactggttggacgcgaaggaaaccacaaacacaatgagcagcggtgccagcaggaacaggtacagcaggaacaccagcacgccgaaggcgggtttggcggggttgaagcgcggtttgaagattttggcgctgcttgcgttggcactgctcacggtcagcctccgattttcttggtgaggcgctggtagacggcgatgatgaggccgaagagcaccagcaggatgacggacagggcggcggcgaacggccagttgagcaggccggtggtctggtcgtagatctcggtggccaggacctgcacgctgccgccgcccaggagccgcggggtgatgaaggtgctgatggagaggacgaataccagcaggaacgccgtcaggaggccgggcaggcacagcggcagcgtcacccgggtgaacactttgaacttgctggccccgagggaaccggccgcctcctccaactgggggctgagccggccgaacccggagatcatggccaggatcgcgtacggcatgaagatttccaccagcccgatcgtcaccccggtcatgttgttggtgagcttcaggggtgtgtcgatcaggcccaggccgccgagcgaggagttgatcaacccgttggttcccaggatgaccatccacccgtaggtgcggaccacggcggaggtgagcagcggggcgatggcgatggcgacgagcaggccgcgccatttgctggtactccgtgcgaggaagagggccaccgggtaggacacgatgacgcagaggatgccgacggtgacgcccatctggaaggtgtccagcgtgacccgccagtagtaggggtcggtgaggggctggatgtaggtgtccagggtgaacgtctcaacgatgacaccgtccggtgcgccctgattgaaggacatccggaccatgtacgccagcgggaagacgaagctgaccagcaggccgagcaggcccggaagcagcagcgccaggtaggtgcgccggttgcgccgctcggtggcccgttccagctgcccctcgtcctgggcactgggccgttccggcgcggcgggggcttccaggaccgtcatgctgccagcctcaccggctgggcggctgctgggaggaggtaggcgtcgtcggccgcccaggagaggtaggcggcgtctccgatgcggggcaggtcgccgctgctggtcagcatctgcgcgtgcagctgctggtccccgatacggaccgcgacagccagagcgtcaccggtgtagctcactcgttcgatggtgcctgcgaggggtgcctgcgccgcccccgggtgcagggacacattgagccggtgcgggcggatgaccagctcgtggctgctgcctgacaggccggtggagccgatggcgccgaactggcccaggccgtccacctccaccttgtagtggctttcgcctgccaggtttgcccgccccgtttccgcgcccacgcgggcggccaggaagttggcctggccaatgaagttggcgacgaagtgcgtgcgcggccgctcatacacctccgtgggcgaaccgaactgctcgatcaggccgccgttcatcacagcgatccggtctgccatgtccagggcctcgtcctggtcatgggtgacgaagagcgtggttgcccgggtgcgctgctggatggccctgatttcggtgcgcatggtttcgcggagcttggcatcgaggttggacagcggttcatccaggaggagcagggtaggctccaccaccagggcgcgggccagggcgatgcgctgctgctggccgccggaaagctccttggtctggcgcttgcccaggtggcccagctggaccatgtccagggcggccgcaacgcgcgccttctgctcagccttggtaacctgccgcatttccagcccgaaggccacgttctgctccacgttcatgtgcgggaacagggcgtaggactggaacaccatgcccatgccgcgcttgttcaccggcgtgtgggtgatttccttgccgtccaccacgatggatccggcggtgggatccatcaggccggcaaccatccggagggtagtggtcttgccgcagccggacgggccgaggagtgccaccaggtgcccctcctcaacttccatgttcaggcggtcgacggcggggtccagatctgctgcgtatcttttggtcagatcaacgatcgacagtttgggttcagtcacggtttcagttctcctgaaggggaagttggggagggggcgccggcaggcgctagttggtgatgatctggcgcttccaggtgtcggtccacttgtcgcgggccgaggacaggaattcgacgtccagcgggacgatgttgagggagccgtcggtgggaaccacgcggtccttcacatcggcgggcaattccgcattggtaacggagggtgcgtagaacagcgccttggcgaaggccgtctgtgcctctgcggacagtgcgtagtcaacgaacgtcttggcagcctcggagtgcggggcgtccttcaccaggttgatggtgttgatctggtagacggtgccttccttggggaaggtgacgcccatcttcttgttgctctggtcgctgtagaactggccccgggcgttctggccgaggccaaggacggtctgtccggtgatgacgttctggtattcgtcggggttgggtgcgaacgtctggactcccggcgccatttccttgaggcgggtcacggcggagtcaatgccctgtgtgtagtcctcgccctccatcttggaggtgatggccgtgagggacaggcccaggagggaaggcggggcattgacgttgatcttgccggcgtaggccgggtcccagaggaccttccagctgtccggggcctcggggaacgtagcggtgtcgtacaccaggcccacggcgtcgagcatggctacggggccgtacgcttccttgtcccggaacttttccgggacgttggcaaggttcgggacgctttcctcgtctaccttctcgaacaggccctgcttgtttccggtggtggacacggagttgtccatgatggcgacgtcggtggcggggttgttcttctggccctggagcgcgctgagcatctcggcggaggaccgtttggaggcgtagttgatcttgatgtccgggtacttggcctggaagggttcaatcactgcggcggtgtactggtcctgccatacgcctgagtaggcaatgaggttcacttcgcccgaggtggcgcttccgccgctgcctgctgcctcgctgccgccgccgcagccggaaaggaccagaaccgctgcggagagggcggccacagccgccattttgcctttgatagttgctcgcatttgctgtctctttctcaagaagaatccgggctggtagcggattcttggatgctttgaagctattgagtgcatatttcggatatgtaaaagaaaacgcctattccggtaaacaccggctttatgcagaatgcgtctgacgtcatcgttaaatcgcatgcctggccggggtagaatgaattgctcatgaaatagcgttctgggttcaacctagtgtcagagatatgcatcacacaaagaccagttgcgtatccctccatagcatccggttatgaccttcaggggttcaggacgccgcaaagagagaaggcggccatggatacgcggaagcttgcgtacttcgtgcagattgtggattcaggaagcatcaccaaggccgcggctgcgctgcacgtggcccagccggccctgagccagcaggtttcggcacttgagaacgacctcaagcagcgcctgctgatccgcagcaagcagggggtaaagcccaccgccgccgggcacacgctgtaccggcatgcccagtccatcctgcggctggtggaccaggcacggcaggacgtcgccaggtccggggcagcaccgtccggccgcgtgtccattgcgattgcgccctacagcatggcctcaagcctgaccccgcggatcatcagcgaggtggccagccggtacccggacatcgtcctgcacgtcacggaaatctacggcggcgtgctcagcgaggccatcaagaacggccgcctggacatggcactcatctacgagcccggccccatccgcggcgtgcagttcaccacgatgatcgtggaggacctgcacttcgtggtcaacgcggccagggcaggggtgcagcaggccgacggcggcatcacccttgaggaggtggccagccacgggctgttcctgcccgagcagatccacaccctgcgccagacggtggaggccggcttcgccagcaagggcctgaagctccggctggtgggggaagtggagtccgtcccctcccttgcccggctgctgcgggccgatcttggtgccaccatcatgcccaagtcggctgctgacgccctgttccatgaggaggacttccaggtgctgcgcattgtggatccggcgttgcagtgcaagattgcgctgtgcacccccgatcatgacccgctgtccgaggcggcgtccgcggtcctgctcgttgtgaaggaaatgctgcaggaaatgctcagcagcaaatattcacggtagctggtccataggttccacttatcgcgtcactcatcattggtcttagtattcccgctcccccgatcctagaatctaaaaaaagccggacaattacggcgaattaattcttgtgcggatcaatgggagtgcgccgtgaaaaagataaacacctcggcgagaaattcgggtaaaagcccgggtttcatggccaaaaccggattccactgccccgccaatggtttttggcggcccgaggaccggtccgttgagcctgtgtttgtgttcgaaggcagcatcatgccggcaggcggccgggggtccaccgcgtggtacctggaggatgcggccttcggtccgccggagtatccactgcccgcgcagtaggccgcatggtcgtatggcccatcccggactagagatgccgaaggtaccgctggggcgcatcaaggaacgaacgccaactgcccacgaggtccagttcctcccagccccgagggcgtagtccccacagccccacttccaggatccgggctcccggaagggccgcaagaaccggcgagtgcgtggacatgatcacctgggattccccggacgccaggaggtctttcaagaccccgaggagactcaggcatccgctgaaggacaatgcggactccggctcatccagcacccacagcccccgtccgcggaatctgttgacggcgagttccaggaacgactccccgtgagacatgtcgtggaagcggatatcgtcccggcccgaggtgctggggtttttctcgaggtaggtaaagaagccatgcattgtttcggcccgcaggaagtacccgcgcctggtggtgcctgcattcctgacaagctgcaggtgatcggccagtagcgattcgctggacctggtgctgtgctgcgcaccggttgagccgccttcgggagacaacccgtaggcaagggctatcgcttccacgagcgttgatttgcccgacccgttttcgcccaccagaacggtggctgacgtcagttcgagcccgtcgtccagtacctgcgccacgggcggcaggactgccggccactgccgacggtcaaggacgttggacgggtcctcttccagccggcggatcggatatcggtggaggggcatgcgcccattctcgcagccggcgcggcggggaaagcgcaggccgccggccgttgcccggccggcggctgacgctcgtgctctgctggaaagccctgctaggcctgttccaccagcaggcccttggccttcaggacgtccgtaaggttgcagaggtcgatggtggtgccaccggctttgtacaggccgatgagctcacgctcggcgtcgtcacgttcctgggagaggcggatgacctcctcgatctcgtccttgcgcaccacgactacgccgtcggcgtcgccgcgcaggacgtcgccggggtagatgatctcgtcgccgaagaccaccgggtggttgatggggccgatggtctccttgactgtgcccttgatggacacactgccggagaacacgggcagtccgagttcaataaggtcctgggtgtcgcggacccctgagtccgtcaccaggccggccaggcccttggccttcatcgcgttgcccaggacgtcgccgaacgtcccggcttcctcgtactcccccgcggaagcgaggatgacgtcccccggctgcgcgtagtggatggctacctggagcatcaggttgtccctgggtgcacagcggacggtggtggcgggcccacagaaggacatggccctgtcgatgggcttgatgcgggagctcagtgcgcccttgcgaccctgcgcctcgtggatggtggctgatgagaacttcgcgagccggctgacggcgtcggcgctagggcggttgatggtggttttgacgtggatcacggcgtttgtttccttcggtggggttggatcaggtgagggcctggacggccttgtcgatggcagcgatggattcctcgatggtgtccaggctggtggcgtaggagatccggaagtacgggcccaggccgtaggcggagccctggatgaccgccacggaggcggcatccaggaggtagagggtgaagtcctggtcgttactgatgacctgcccttcgggcgttgttctgccgatgacccccgcacagttgacgtacgtgtagaaggcgccgtccggcgtcgtgcatgacaggccgtccacggcattcagggcggcgacggcggtgtcacgccgcttgcggtaggtctccacgctgtcccggacgaagccctggctgccggtgagggcggcagcggccgcggcctggctcacggaggacgggcaggaggaaatctgcgactgcagcttgttgatggccgcgatcagcggcgccggccctgcggcgtatcccagccgccagccggtcatggcgtaggccttggacacgccgttgacggccaggacccggtccttgagttccggggccacctccaccaggctggccagcttgccgtcgccgaagtagatctggtcgtaaatttcgtccgcgaggacagagacgtgcgggtgaacggcaaggacgtcggcgagcgcccgcagttcggcacgggagtagacggcgccggtggggttggacggtgcgttgaggatgacccacttggtccggccgttgatggcacctgccagggcctccggggtgagcttgaatccggagtcctcgccgcagggaacgacgaccggcgtgccgtcgttggccagtaccatgtccgggtaggaaacccagtagggggcgggaacaatcacttcgtcgccggcgtcgagggaggccatgaaggcggtgaagatgacctgcttggctcccccgccgatggtgatctcagccggcgcgtagtgcaggcccgtgcgcagttcgagggtctggaggatggccttctgcagcgccggagttccggtgaccgacgtgtacttggtttcgccgcgggtgatggcctccacagcggccgccttgatgtgttccggggtgtcgaagtccggctctccgactgtcaggtcgaggatgcggcgtccttcggccttgagctcacgcacccgggccgcagcagccacactggccgaggacttgatgcgggaaacccgcgaggcaggtacaaattctggcatggtctcttcctagggagtcaggagcgggcggtactcgtttccttcgacactagggaaatcccgttgctgtggataagacctaaagtgcgtgggcggataagcgtcccttatggctggcccacccacacgttccggttatgggtccacgcactattggtatttccgccccggcgccttactgcctagccttctaggtacgtcggcccgttcagcggcaaaccgaaccgaggagtgatcgtgagcgttacgcaccaggacgatgccggttactaccgctaccgcggaacgccgaaaccccacccggccgcccgtcaggcggacaagctccgcaggctgctcaaggcgaaccggcagcgcatcgccttcaacgccagcagcagccgttcgctcttcgtccgcctgaaccagcacatcgcgcaggcgctcggggacgggatcaaggtgacgcacctggccgaggctgccgggctttcccgctggaccatccgcaccatcggccggtcctttgatgacctgctgccctccgggacacacccggaccagcagctggctgctatcgcggggctgaagtccgagctcgctgaactggaggaagtgaaagctgccctggaggagcggcggcttagcctcctggcggctgcgcgccgcctcggcctcatggatgacttcgagctcgcagcgctcagcggactacaaagtggggacatccgcaaaatgacgtggggtcttcagccccgacttccctagactggccagtggacgttgaaccacggacacagagcgaaggagcacagcatgagcggagtagttgttgtaggtgtggacggcagcccgtcggcacggaaggctgccgaagtggcgctgggccttgcgaaggcgctgggaggttcccttcacattgtcaccgcgttcgacgtggaccggtccgaaacctttggcgtcggctcggatgaagtgaaagtttggaactcagaagccgccgaaacggtcgccaagtccctcggcgaaacgcggccgggagtggagatcagctacttcgccgcccgcggcaagcccgccgacgccctcatcaaggaagccatgcgcctcgacgcccggctgatcgtcgtcggcaaccggcgcatgcgcggcatcggccggctcctcggcagcgtcgcgaacagcgtggcgcacaacgcgccgtgcgatgtctacatcgccaacacgtacgaagactagtcctacccgcccctcccatagcgtgggcaaaaagagagcggacgacggcgggacctcccgccgtcgtccgcttgctttatgcgcctcttgatcaagatttgccaagtttatcccgtcgatagataaaccctcttccgttgccgccgcggcctgcctaccgttgactccacaagcacgccaagggggatttatggaacgctcggacgacggtacgcagacgacccgtgaggaacttcagcagcctgatatttcggatccgctggagggccggcagcgcacagtggccgagtggaccggcgacctcctgctcggcatccggcagcccgtccaattcaggctggccgactggccgtaggaatttccaggaccggccactccaaagtgcgggccacctggaccaccggtatgactcccccggcaagggcttcgggagccatgcgcccaacacggccagcgcactgatccaggttgttgcctgccgtttccggcccgcacgcctctgaaccggaaccctagcttgaggcgtccttttcgatctcctcggcgagatcgtccacggcttcgggacgcagcgtgatgcccgcctcatcgaagcgttcctcgagcacgtggctgacgtcgtcctggacgtggcccagccggatttcgtcccggatctcgtccgcgatgctctccgccgtcgccacgccgtcaacctcctccgcgccatcgtcgccagaaggggcacccgcggtatcagctccggtgtcagtcatacttcatcgtggccaattacgggtgggcggtcaacacccgtgcctagcccttgatctccaccttgacgaagtcctcccggtggaacatccggcgctcgcgccagccgtccaggaccacccagatgatggagccgtccggtgtggtcccgtccaccacgccgcagccgatggcctgcccgtcctgcgagaggcgcaccggttggcccgcgggaagggcggtccaggagacccgtcgccagctgtgtgcttcgctcggtttcatggcgcctaccgcaggacgacggtccggttgcccagcagcaggatcctgccctcgcagtgccagcggacggcgttccgcagtgccacgcactctgcgtcccggcccaccgccaccaggtcgtcagccgtgtacgtgtggtccacctcgatgacctgctgggagatgatggggccctcatccagctccgcgttgacgtagtgcgcggtggcgcccaccgtctttacgccgcgctcgtacgcctggtggtagggcttcgcgcccttgaagctcggcaggaacgagtggtggatgttgatggttttgcccgcaagccttgccgagagctcgtcgctgagcacctgcatgtaccgggccaggaccaccagttccacgtcgaactggtccacgagttccaggagccgggcttcggcgtcggccttggtgtccctggtgaccggcacgtggaagaacgggatgccgtgccactggaccaggccttcctggtcgcggtggttggagacgacggcgacgatctccaccgggatatcgccggtgcgtgcgcggaacagcaggtcgttgaggcagtggcccattctggacaccattaccagcacgcggcgcttccggccgtgcggctccagctgccagttcatctgccacttctccgcaacgggcgcgaagccgcggcgcaggtcaggggtgctctgcagttcctgcgctgaggcgaagtggacgcgcataaagaagtgcccctgcgctttgtccccatactgtttgatgtcgatgatgtcgcagccctgctgcagcaggaattccgagaccgcgtgcacaagcccgggcgattcaacgcagtcaaccgtcaggacgtgttcgacggcggcagccggatccggtgccaaggcaccagcggcagtggttgggagggtcgtttccacggttgtgctcactttttggctccatcaaggtcgcggccaatggctgaagcctcggcatccaggtcctgggcgagctcggacttgaacgtggcgtaccgggccaggtgcacggggcggcggcggagcaccagccaggccgcaccgaggatcaggaaccataccggcgtgacaagcagcgccagcaaggtgtcctcctgcgtggtcagcgcccacaggacgaaggcgaagaacgcgaacaccacccacaccatgggcaccccgccgggcatccggtacttggaggcctcgtgcaggtgggagcggcggcgccggaatgccaaatagctggccaggatgatggaccagacgaacacgaagcagacggcggatacggtggtgaccatttcgaaggccttgccgatgtcctggcccgcgtacatcaggatgacgccggaaagcagcaggacgcaggagaggaacagggcgttctgcgggaccttgcgggcggacaggtggcggaagaccgacggcgcgtccccctcctgcgccaggccgtagaccatgcgggacgtggagtagatgccggagttggcggaggacatggccgagctgaggacaaccaggttaaccacggtggcggcggcgccgaggccggccagggagaacatggcgatgaacgggctgtggcctgcctggaactgtgtccacggggtgacggacatcaggatgatgagggcgcccacgtagaagagcaacacgcggatggggatggagttgatggcccggggcaggttcttctccgggtccttcgcctcggcggcggtggtgcccaccagctcaatgcccacgaaagcgaacaccgcgatctggaagcctgccacaaaacccatgaactcgttcgggaacatcccgccatggctccacaaattcgtgaaggtggcagggccggcgtcggactggaagcccgtgaagatcatgaacatgcccacgatgatcagcgccgcgatggcaatgatcttgatcagcgcgaaccagaattcggtctcgccgaatgccttcacggtgaccaggttcaggagcaggaggatggccaccgtggccagccccgggatccacagcggcaggccgggccagagttctttggagtagccggcgatcgcgatcacatccgcgatgcccgtgatcacccagcagaaccagtaggtccagccggtaaagaagccggcccaggggcccaaaaggtccgccgcgaaatcgctgaaggacttgtagttcaggttgctcagcagcagttcgcccatggcccgcatgacgaagaacagcatgaagccgatgatcatgtagacgaaaatgacggacggtccggctgcggaaatggttttgcccgagcccatgaacaggccggtgccgattgcgccgccaatggcgatcagctggatgtgcctgttggtgagctgccgctcaagatgcggttcctggagggttttcacagggttagttgtcacgtgctgctcctcgaatcaaagctgtctggagtgcggaaggggaagatgcggccgcttcgttggggaccgcatcgaggctgttgaagctgtagaggtggatgccggcgatgttgccgggcgtgttttcgagcccggccaccagggcgtccggcgagtaacggtcgccgctgaggagtttgcgggccagcgggcccttgcggctgaggaacttcagggaacttccgacgccgatctgcgtggcgagtgccacaagcttggtccgcgggacggaccctgccacgcccgcccagagaggcaagtggacgccttcgcggcgcaggagcgcggcatagtcatggatctttccggccgaaaaacacatctgcgtgaccacgtgcgaggcgaggtgctgcttggccagcagcccgtccagcaggtccaaagggctgacggcggggtggccttccggataacccgcgacgccggcccgcatcatcccgccgctgtactgggcgatgtcctcgaggaccggaagcgccgaggtgtaggtgccggcgggctgcttccggtctcccccaatgacgaagacttcgcggatgcctgcagcatcgcagccgcggatgatctcggtgagctcggcgcggctgcggatactccgggcggcgaggtgcgggatcacctggtagccggcgtcgctcagctccacggcggtgcgcatggtccgctcgatgccgtggtgcggcaggcaggtgacgctcagtggcgtggccgcggacacccgggcccggacctgctcaacgattccctcggagggaatgatttcgattctgacggggaacatcattggtcctgtctttgcttcagtttttaagggcttcagcggtggctattccgtcatgcagtgttggcgagcagggagctggcttcctggcgggtgctgccggaggactcgatgtgggcgagttcggcggggatgtcccagcctttctttcgcatcgcggtggcccagagccgcccggcacggtaggaggaacgaaccaaaggaccactcatgacgccgaggaacccgatctcggtggcctcgtcctggaggtccacgaactcctgcggtttgacccaccggtccaccggcaggtgccgctcactcgggcgcaggtactgggtgatggtgatcaggtcgcacccggcctcgtgcaggtcccgcagggcctctgagatctcctcgcgggtctcgcccatgcccaggatcaggttggacttggtgaccatgcccaggttccggccctgcgtgatcacatccagggaccgctcgtaccggaacgccggacggatccgcttgaaaatccgcggcacggtctcaacgttgtgcgcgaacacctcgggcttggaatcgcagatcgcggcgatgtgctcgggtttgccggagaaatccgggatcagcagttccaccccggtgccggggttcagctcgtggatcttccggaccgtctcggcgtacagccacacaccctcatcagcgaggtcgtcgcgggccaccccggtgacggtggcgtagcgcagctgcatcgcctgcacggaccgggccaccttggtgggctcgaacatgtccaccggggaaggcttcccggtatcgatctggcagaaatcacagcgccgggtgcactcggaccccccgatcaggaacgtggcttccttgtcctcccagcactcgaagatgttggggcagccggcctcctcacacaccgtgtgcaggccctctttcttgaccaggttcttgagctggacaaactccgggcccatctggaccttcgccttgatccactccggcttgcgctccaccggaacagcagaattgcgctgttcaacgcgcaaaagcttccggccttcaggtgccaatgtcattgttgtacttccttcagcattcgacgacgttgacggcgaggccgcccatggccgtttccttgtacttggagctcatgtccttgccggtctcgcgcatggtcacgatgacctcgtccagcgacacccggtgggacccgtcaccccagagcgccattttcgcggcgttgatcgctttcgccgcggcgatcgcgttccgctcaatgcacggaacctggaccagcccgccgatcggatcacacgtcaaccccaggttgtgctccatcgcgatctccgccgcgttctccacctgcgccggagacccgcccatcacctcagccagcccggcagcggccatcgacgacgccgaccccacctcaccctggcaacccacctcagcccccgaaatcgacgcctgctccttatagagcacccccacagcggcggcggcgagcaggaaacgcaccacaacgtcgtcccggtcctgctgcgtggctttctccatccccggcgcgaaatgcagcgcgtaatacagcaccgccggaataatccccgccgcaccgttcgtcggggccgtgaccacccggcccccggacgcgttctcctcattcaccgcaagagcgatcaaattaacccactcctgccaatacttcggatcatgaaactccccagcgccggcgtcgttcccggaaccgtcctggccgtccacggcagggcgtgcactttccttccgcaaccggtcataccagtccggggcacggcggcggaccttcaacccgcccggcagcacaccctcacgcttcagggacgtgcccacgcacccctccatgaccgagtaaatgtgcagcaacccctcccggatctcccccggggtgcggctgtcctcctcgttgacccgcatcacctcactgatgcccaggccggtcacccggcagtgctccagcaactcggcggcggtccggaacggcaacggcagctcctgcttggactcctccagctcctgcagcgccgcgtcctcctcaccctcccggacaatgaacccgccacccaccgaaaagaacgtcgccgcatgcagaacccggccgccggcgtcggagaccgtgaacgtcatcccgttcgtatgccgcggcaggacagtcaacggccgcagcaccatatccttcaccccgtacggcaacgccaccgcaccggccaactgcaacaaccccgtttccgcgatcgcggccagccgctgctccacctcatccggcaggatcagctccggatggaacccctccaaccccaacaaaatcgctgtcatcgtcccatgcccatgacccgtcgcagcgagcgacccataaaggtccacccgcaacgaagccacctccgccagcaagcccgaagccttcagctcccccgaaaaaacggcagcagcccgcatcggccccacggtgtgggaagaagaggggccaataccaatagagaaaaggtcaaagactccaacagccattacttgtcctaactaagaatgtgcgtgggttgcgtggtgggtgaccgaattcctccgcgtgctgctccttcgtcgctctgacgcacgcttccggaatccgctcacccaccgtcggcctgtcaccttcgccgacacttggcaaccaaggactgtgaaaggtgacggactgttgcccctgtgggaccgacatccggaagcgtgcgtctaagggagcgtcacgtccgctcagcgggcgtcttcgcgaccgagcacgcggaggatgccggacccaccgggccgaaggtgacaacagagcagcacaggtcagctgaggtttgcgacgcccgggtacagggggtgggccttcgccaactcttcgacgcggtgacgcaagcccgaaaggtccgtcccggcgtcggccgtcaacgcctcggcgatgatgtccgcaacctcgcggaaggcggcttcgccgaaaccgcgggtggcgagagccggggtgccgatgcgcaggcccgaggtgaccatgggcgggcgggggtcgaacgggacggcgttgcggttgacggtgatgtcgatttccgcgagccggtcctcagcctgctggccgtcaagctcacagttgcgcaggtccaccaggaccaggtgcacgtcggtgccgccggagatcacgctgatccccttggcggtgacgtcgggctggaccaggcgctcggccaggatccgggcaccggccaggacgcgctcctggcgctccttgaactcggcggatgcggcgatcttgaacgccacggccttgcccgcaatgacgtgctccagcgggccgccctgctggccgggaaacacagccgagttgatcttcttggcgatgtcggcgtcgttcgtcaggatgatgccgccgcggggaccggcgagggtcttgtgcgtggtggacgtggtgacgtgggcgtgcggcaccggtgacgggtgcagcccggcggccacgagcccggcaaagtgcgccatgtccaccatcaggtaggcgcccacggaatcggcgatccgccggaactcagcgaagtccagctgccgggcgtaggcggaccagccggccacgatcagtgcgggcctggtttcctgggccaggcgctccacctcggccatgtccacggtgtgggtgtcctcgcggacgccgtacgggaccacgttgtagagcttgccggagaagttgatcttcatgccgtgcgtgaggtggccgccgtgggcaaggttcaggcccatgatggtgtcgcccggcttgatgagtgcgtgcatcaccgaggcattggcctgcgcaccggagtgcggctgcacgttggcgaattctgcgccgaacagtgccttgatgcggtcgatggcaagctgctcgatgacgtcaacgtgctcgcagccgccgtagtagcgcttgcccgggtagccctctgcgtacttgttggtgagcacagaaccctgggcctgcatgacggcgacggcggtgtggttctcggaagcgatcatctccaggccgtcgcgctgacgggtcagctcgtcgtcgatctttgccgcgatctccgggtccagggcggagaggtccgcgtccagagacggggagaccacctgctcgaaggctgctgttgtggtcatgcccgcgccgctcacagttcgccgccgttggctgccgcgtactcttcggcggacaggagcgggccttcttcggtgacggccaccttgaacagccagccggcgccgtagggatcgttgttgatcagcgcggggtcggagacgacgtcgtcgttgatctccacaacctcgccggtgacgggggcgtagaggtccgagacggatttggtggactctacttcgccgcaggtctcccccgctgtcacggtggagccaacctcgggcaggtccacgtagacgatgtcgcccagggcttcggcggccaccgcggagatgccgatgttggcgggtccggatccgtcagtagcaacccattcgtgctcggcggagtacttcagttcagcaacaacttttgccatggtgtgtttccttcaatctggtgtgtgaaaagtgagagagcgtcgggccaaaagccgcatcaagtgaaagagcgtccggataaaaccgacatcaagtgagagaacgtccggtcaaaacgcgcatcaaatgagagagcgttacttctggcgcttgtagaacgggagctctactacttcgaagggctcgggtttgccgcggaggtcgatgtccagggcggtgccgggttcggagtgttcgacgtcgacgtaggccagggcgatcgggtagccaagggtgggtgaaggctggccggaggtcacctcgcccaccacgttgccgtccttgaggaccggatagtggctgcggccggcgcggcggcccaggcccttgagtccaacgagcctgcggccggaggtggaaccggcgccaagttccttgagctcggccagcacggccttgcccacgaagtccgactccttcttgagcgagacgaccgggcccaggccggcggcgtacgggttgccctcgcgggaaagctcgttgccgtagagcggcatgccggcttccaggcggagcgagtcgcggcaggccaggccggcagggatgaggccgtggcctgcgccaacttccagcagcgcgtcccacaaaccggcggcgtccccgttcgggacgtagatctcgaagccgtcctcgccggtgtacccggtgcgggccaggagcaggtcctggacagcgccgttgactgtaatgcctacttcaacggccgcgtagtacttcagctcagtcaccagggagtgctgctcggcaggaaccagcgtcaggaggatggcctcggcatggggtccctgcacggcgatcagggaggtctcggcagacacgtcgtcaacaacaacgtcgaagcctgcggcccgctcggcgagtgcggcggcaaccaccgcagcgttgccggcgttggggaccaccaggtacttgtcttctgctcgacggtaggagatcaggtcatcgatgatgccgccgtcctcctggcagatcagcgagtacttggccttgcccacggccacggcggacagcttgccggccagcgcgtagtccaaaaaggcgccactgtcggggcccgtaacccagacttcgcccatgtgggagaggtcgaacaggcctgcagcgttacggacggcgtggtgctcggccagttcggagctgtacttcaggggcatctgccagccgccgaagtcggtgaaggaggcgccggccagcttgtgctggtcatagagcgctgtgtagttctcagtcatcaggaattccttagttctcaaagtcggaaagaggcgggcaggagcagaccaggttgcggtcccctgcggcgccgtcgatgcggcccacgggcgggaagtacttgtcctgccgcagggaggacacggggaaggctgcctgctcgcgcgggtacacgcggtcccagtcggaagagacgacggcggcggccgtgtggggtgcgttgcgcagcgggctgctggtcacggtgaagtcgccgttggccacctggtcgatttccttgcggatggtgatcatggcttcgatgaagcggtcgatctccgcgaggtcctcggactcggtgggctccaccatgagcgtgcccgccaccgggaaggacagcgtgggggcgtggaagccgaagtcgatgagccgcttggccacgtcctccgcggtaacgccggtttgtgccgtcaggtcgcgcaggtccaggatgcactcgtgcgccaccaggccgctttcgccggtgtagaggacggggaagtgctcatccagccgtgctgccacgtagttggccgccaggagcgcggacttggttgccccggtcaggccctggccgcccatcagcttcacatacgcccacgaaatgggcagcacgcccgcggagccgaagcgtgaagccgaaatggcaacgccgtgccccgcctcatgagccgctttattggcatcgcccggcatgaaaggtgccaggtgcgccttggcagcgaccggtccgacgccgggtccgccgccgccgtgcgggatgcagaaggtcttgtgcaggttcaggtgggacacgtccccgccgaacttgcccggctgcgcgagcccgacgagggcgttgaggttggcgccgtcaacgtacacctgtcccccggctgcgtggacggcgtcgcagacctcacggacgtcggcgtcgtacaccccgtgggtagacgggtaggtgatcatgatggccgagaggacatccttgtgggcctcgatcttggcttcgaggtcggcgtggtcgatcgttccgtcggcagcggtggccaccacaacaaccttcatccccgcgaggacagccgaagcggcgttggtgccgtgcgccgaggcggggatcaggcagacgttgcgctgctggtcgccgcgggagtggtggtagccgcggatcgccagcaggcccgcaagctcgccctgggagccggcgttgggctggatggacacctggtcgtacccggtgatttcggcaaggtcggcttccagcccggcaatgagttcgcgccagccggcagtctgggaatccggtgcaaacgggtggatcgaggcgaactccggccaggaaatggcttccatctcggcggtggcgttcagcttcatggtgcacgagcccagcgggatcatggtgcggtccagcgccaggtcacggtcggagaggcggcggatgtagcggagcagctgggtttcggagcggtgggtgttgaacaccgggtgctgcaggtaggtggaggtgcgcagcacggactccggtagttcaaagccctgtccggacacaaccggaccggcgccaaaggcgaccgccaccgcggagaggacctccggcgtcgtggtttcatcaacggacacgccaaccgtgtccgcgtcaatgaggcgcaggttgatgccgcgggcttcggcggcggtgatcaccttggcagccttgccgggcacgcggacggtgatggtgtcgaagaaggtgtcggacaccagttcgcggcctgcgtgcttcagcgtggcggccagggcgcgggcactgccgtggacggtctcggcgatcgccttcaggccgtcggggccgtggtaaacggcgtagaaggacgagacgatggccagcagtgcctgcgcggtgcagatgttggaggtggccttctcgcggcggatgtgctgctcgcgggtctgcagggccaggcggtaggcagggacgccggcgttgtccttggagacgcccacgatgcggcccggcagggtgcgttccatgccgtcgcggacggccatgtaggcggcgtgcggtccaccaaagaacaacggcacgccaaagcgctgggtggagccgacggcgatgtccgcgccctgctcgcccggcggggtgatgagggtgagggccaggaggtcggcggcgacagtgaccagggcgccgcgctccttggcgctggcgatgacggcggactggtcccagacccggccagagacgccgggctgctggaggaccacgccgttgatgtcgccgtcgggcaggccgttggtgaggtcggcgacctccacctcgaagccgagggcttcggcgcggcccagcacaatagcgatggtctgcgggaggaggtcggcgtccaggacggtcttgccgtctttcgcagtcttgttcttgttggcgcggcgcatcagcagcaccgcttcggccacggcggtggcttcgtcgaggagggaggcgttggccaccggcagcgccgtgaggtcctggaccatggtctggaagttgagcagcgcctcgagccggccctgggaaatctcgggctggtacggggtgtacgcggtataccaggcgggcgcttcaaggatgttgcggcggatcaccggcggggtcacggtgccgtagtagccctggccgatcatctgcacagccatcttgtttttcccggccagcgtgcggagctcggcgaggacctggacttcgctgagggcgccctcaagggtgagcggcttgtcctggcggatggaatccggaaccgcgctgtccacgaggccatcgaggctgtcgtagccgacggccttgagcatggtgtcgacgtcggactgccggcgcgcgccgatatggcggtctgcaaaggtggttggggacgagtgaaccgtcatgaggggaactccataactcaggtagcgccttagcaccacgttgattcgggttcctccccgctctgtattggacctgagagttttgcgttgccctgcagttcagcgggacgccacttgcaccgtcggtgagcccggttgcccggactgctttccagagttgccttgccgcggcggtacgtgggcctgagagattcctggggaggatttgctcctacggcgcctgctgaacgtaccggcaggactctcccgccgcagatcataagcatgtgccactggtgggtgacacgactcacaccataccaagatgcgcagcgggatccaaacttcggtccgcgaaaggcgacttacgacggcggtacgcgccgccgtcgtcatcccgttgtcactgttccctgcggctggctttccggccgatgttgtacccggcccaaaaagcgagcagcagcaggcccacgacggcgattgccaggcccgcctgcgttcccggactgagaaaggccatgcctgtgccggagaagggctggttgctcagcggcgcgtaggcgaaccagccgacgtaggtgttcctgttgagccaggccaccgtgcaccccaccaacaggatgacgagcccggctatgggcaggaccgcacccggtatccgggcgggtttccgcggttcatgttcttcagtgctgttttcttcaggcgtgctgttgtcccccatgcaggcgagtctagccgggcttcaaaggacgggattaggctgggcccatgttgaccctcggcagcaccgtcctcggcgtcaatgacgttgcccgcgccaccgccttctggcacgcagccctcggttacgtcccgcgtgaacccggtgacgagacctgggtaatcctggttccggcgtcgggcccgggcgcacagctggcactgatgctgagcgagacgcctgcccaggaccacccgcgcatccacctggatttgtatgcggacaaccaggaggccgaggtggaacggctgatctcgctcggggcctcccgcgtcgactgggacctctacccggaagacccggatttcgttgtgcttgcagacccggacgggaaccgtttctgcgttgtcgcccacaacccgcagtagccccggccagcaggtgcggccggggctacgggggtctggcaatttcaggaagcgtcacaccttggcgggttcggccaccttcaatggttcgatcttgcccatcacgaacaggtagttggcggcgcccaccagggccaccccgccaatgacggccagcggcgccacgaaggaaccggtctggtccaccaggacaccgatgaggatgggcgtgaagatgccggcaaggttggaggcaaagttctgcagcccgccgatggagcccacgtggcgggagctcggggccacgtccgcaggcagcgaccagatgccggtggctgcgaccgtcaggctggagtaggccactgacagcaaagccagcgccatccatgcctcgggcaccagggccgcgaacataatgaccgaaccgcccgccagaccgccggcgatggcggtcttgcgtacacgcgtaatggagactccccgctgcacggcccggtccgccacgtagcctgccagccagccgaacaggacggcgcagattccggggatggcaccgaagaagccgagcttgagcaggtcgaaaccgcgctcctttaccaggtagctcgggaagaaggtgatgaagaagtagatggcgctgttgaggcagaagaagccgaacatcatgctcaggacagtccggtacttgaacagcgagcgccacggaagcttcgctgcaccctcgtcgtcgctggcggcgctgcgtgcgccgccttcgcggatgtaggcaacctcggccgcgtccgccgtcgggtgttcctccgggctccggtagaccttccaccagacggcagcccagatgattccggcaataccgataatgatgaagacggcgtgccacgaggtgaaggcaacaatcagggtcacgatcggcagggcaatgacagctcctacccgtgagcctgaatcccagatgctggtggcgaaggcgcgctcccggaccgggaaccaggtggcaaccacttttgccgcggtactgggggccgggctttcgcccacgccgagcaggaaccgggcggcgaagagggaccagaagctggtggcggcggccgtgaccatggtgaagatggaccaccacactgccgcgagcgagaaggaccggcgcggacccactttgtccacgtaccagcctgcggccagctggcagaagtcgtaggcccagaagaaggcggcgaagataagcccctgctgggttgccgtcagttcgaaatcctcacccatgaagggcagggccacgctgaggctggatcggtccaggtagttgatgctcagcccgatgaaggcgagccagatgatcatccatcgtttgcgggtcatggtgcggggtgccttgggggaagttttgggggcaagcctactgcctagagcagtcatacggtctcctttgacgtaaagacgggctttgggcgcaatggcacggggacggccaggcgcaaggtttcaggggaatgatcgtataggaatctggttaatcatatatagaaagtgatccaggacaagtcctcgccgggaaaaacttcggctcgggcccgaatccggcgggtggcttatgattcccacagcgactccggcccccatgcaaagaggtaaaaagcgtgcccccacgtcaaccgtccgatacgtcccgcaccaaggcagccgttaccgacgtctatgccgccatgcgcacgtccatcctgaacggcgagatcgagccgggtacgcggatcaacatcgacgcggtatcacgcgccatgggtgtctcccagactccggtccgggaagtgctccagcggctggagggtgacaacctggtggtctacacgccgggccggggttacagcaccactcccctgctggggctcgacgaactgcgctccctctttgaattccggctgctggtggagccgtgggctgcccgggcggcggcagtggaccggctggccaatcctgcgcgcgccctggagaaggagctggccgccttccagtccgtgatgcgggacggtcacgatcttcggcaggacctcgttgcccacgacacccgcttccatgacaccatcctggccgcggcagggaatccggtagtccggcatgccttcgcccagacccactgccacctgcacaccttccgcctctacccggcggacgtggacggggccatcacggtgggcgagcactcggcagtcagggaggccatcctggcctgccggcccgaggcggcggaggaggcgatggcacagcacatcaggaactcgttcgcccgctttgcgcaggccttcgaggggaccgtcgaccttgagccgctcgaggagggcggaccacccaggacccgcatcgtgtgacacgaacagaagccccggccaccaagccggggcttcttttttggcctcagcccgcacgcccttgattcacgtcacacttcctatatgattaagaagattcgtataggaattgccctcactcctcagatttcagagagaagaacagcatgccttccattacttccatccatacccaggacgtccgctttcccacgtccctggaactcgatggctccgacgcggtcaacgttgaccctgactactccgccgcttacgtagtcatccgcaccgacgcgggcgacgaaggccacggctttgtgttcagctgcggccgcggcaacgaaatcatcacccacgccatcgattcctatgccgccctcctgcgcggccgggacatcgacgagctcatttacgacctcggcaacgcctccaagcggctcatccacgattcgcagctgcggtggctcggcccggagaagggcgtcacccagatggcagccggcgccctggtcagcgcactgtgggacatccgcgcccggcgggaaaacaagccgctctggctcctgctcagcgaaatgcccgccgaggaaatcgtcgacgtcgtggacttcacgcacatccgtgatgccctcaacccccagcaggcgctggacatcctccgggccggtgaggacggcaaggtcgcacggatcgcttccctcaaagcggacggctaccccgcttacaccacgtccccgggctggctggggtacagcgacgaaaagctcgtaaggctgagcaaggaagcggcggcggacggcttctccatgatcaagctcaaggtgggcggggacatcaacgatgaccgccgccgcatggccctggcccggcaggccgtgggcgggctgcccatcgcgatcgatgccaaccagcggtgggaagtctcggaagccatcgagtgggtgaaccagctggccgaattcaacccgtactggattgaagagcccaccagcacggacgacatcctgggacacgcggacattcgcaagggtgttgcgcccgtccgcgttgccaccggcgaggcggtcgccagccgcatcgtgttcaagcagctgctacaggccggttccatcgacgtcctccagctcgattcaacccgcgtgggcggcgtcaacgaaaacatcgccatcctgctgctcgctgccaagttcggggtcccggtatgtccgcacgccggtggggtagggctctgcgaactggtccagcatttctccttcttcgactacgcggcaatcaccggcacccaggacaaccgcatgatcgaatacgtggaccacctgcacgagcacttcgccgagcctgtccgcatcaccaatggccgttacgctgccccgcagctgcccggcaccggcgccgaaatgctcagcgcctcacggtcccgctgggaattcccgggcggcgccggctgggccgaagtaggcacccgcgccgccgtcaccggcgccacgctcgcccaggcgggaggcgcccgatgaccaccggcgccgaagagctgggcgccgtcgtcgaggccgcccacgccgccttcgaaaaagcgcgcacggcggatcctttcacccgcgccgcctggctggaggccgtggcaacagcgctggacgcagacgctgacgcgcttgtggcgctggcggaacaggagacgcacctaaccgaggcgcggctccgcggcgaactaaagcgcagcaccttccagctgaggctgttcgcggacgagatacggcgcggcgaacacttcgacgccaccatcgaccacgcggatccggagtggggcatgggaccgcggcctgacctgcgccggtacaacgtgccgctcggcgtggtgggcgtttttggcgcctccaacttcccctttgccttcagcgtgatgggcggcgacagcgcatccgcgcttgcggccggctgcgccgtggtgcacaaggcgcatgacggccacctgcagcttgccctgcgcaccgcggaggtggtggtggctgcactggacgccgccggggcgccgtcgggcctgtttgccctggtgaccgggcggccagcagcagaggcgctggtagaccacccgatggtcaaggccatcggctttacgggctcgacggcgggtggccgcgccctgttcaaccgtgccgccgctcggccggaaccgatccctttctttggcgaactgggcggcatcaacgctgtcttcgtcaccgagaacgcctggtcagcccgccgcgacgagatcgtcgccggctatgccgcctccttcacgctgggcatgggacagttctgcaccaaacctggcctgctcttcgttcccggcgggcacacggacacggtccgcacggcactgaacggagcgcttgggggattcgcccctgccccgctgctgagcgaccgcctgcacgaggggtacgccggcgccgtcggccatctccgtggcacgcacggcgtggaggtgcttgttgagggcgacttcgccgaggcaccctcacccactgtgctgcgcacctcggcggacgcggtgcgcaccgatccctccatcctccggcaggagatgttcgggccggcaagcctcattgtggagtacggggatgagtccgagctcccggccctggccgggctccttgaggggcagctcaccaccaccctccaggcggaagcgggcgacgacgtctccgacctcgccgcgcggctcaccgacatcagcggccgggtgctgtggaacggctggcccaccggggtcaccgtcagctacgcccagcaccacggcggcccgtacccggcaacctcgtccaacaccacgtccgtgggcaccgccgccatccgccgcttcctgcggccggtggcctaccagtccttcccggagggacggctgccggaaccggtgcaggacggcaacccctggcgggtgccgcagcgcgtcgacggcgaatggcggcggcccgcagccgtgtccgcttcagcggctgggggcggacagtgaacgggttcccggacctgagcccgtcatcggtcctgccggaggatgccgggtcagccctcctgattggccgggtgtgggacgtggaaacgtcagggccacgcgtcatcgcggtccagggcggggacgtttatgacctccagccgctggccgggacggtctccgaactcctcgagcgcccggacgtcgtggccgatgtccgcgcggcaatgacccggccgcggtggtcaacaccggagatcatcgaggcatcgctggcgcgggacacaacgcggccgtacctcctggcgccggtggacctgcaggtggtcaaagcctgcggcgtgacattcgtggacagcatgatcgagcgggtcatcgaggagcgctgcggcggagacgccagccgtgcccggcagacccgtgagctggtgtccgcggccctgggcggaagcatcgcctccatccggccgggctcccccgaggctgcccaggccaagaaggtgctgatcgcggaagggctgtggtcgcaatacctcgaggtgggcatcggaccggaccccgaggtgtttaccaaggctccggtgctggcctccgtagggcttggcgcgcaggtggggatcccgtcgttctcccactggaacaaccccgaaccggagctcgtgctgttggctgcgtcggacggttccgtcgtgggtgcaacactgggcaatgacgtcaacctgcgtgatgtggagggccggagcgcgctcctgctgggcaaggccaaagacaacaatgcgtcaagtgcgctgggcccgttcatccggctgtttgacggggccttcacgctggacgcgctgcgcgacgaggagatcctgttgcgggtggagggtgcggacggctacgtgctggagggccggaattcagtggccaggataagccggcccttcgaggaactcgtggccgccacgcgcgggcgccaccaccagtatccggacggcttcgccttgttcaccggcaccctctttgccccgacccaagaccgcgacgtaccggggcagggcttcacgcacaaaatgggtgacaccgtgaccatccgcagccggcacctcggtgcgctcatcaaccaggtgggccgcgccgaggaactgccggaatggcagttcgggcttcggcagctgttcgaatacctgcaccaccagcgcgagcctgccgggtccgccgccgccggacgctaggccgggtgccgcggggctcccaaggaggccggacgacggcggaacctcccgccgtcgaccgcttacggggcctgccctcccggttcggtccgcttctgtccgcttccgtccgggaacaagcccgtcgggcgcggcgttgggatacctacgacagttccgccgccaccgcggcacccaacagaacggaaccacatggtcagggctatctggaacggaaaagtcatcgccgaatcagcggacaccgtggtggtggagggcaaccactacttcccgcgtgacgccgtcaacgccggctatctgcgggacagcgacctttactccgtctgcccgtggaagggccgggccagctaccacacgctggaagtggacgggaagctcaacgtggacgccgcctggttctacccggatcccaagccccgcgccaagcagatcgaggaccggatcgccttctggcgcggagtgaccatcgagggctgactgatcctcttaccagccgggatgcccgggcggtaacgtggcgatcaggctgataaccgttcaaggaggaatccggtatggaagtcatcaccattgaaacgccgcaactgggcgaccgcacctacctggtgcacgacggcgctgtgggtgtggtcatcgatccgcagcgggacaccgacagagtggaaaaggccgtctcggacgccggcgtgaggatcacccacgtggccgagacgcacatccacaacgactacgtcaccggcgggctgcagctggcccaggaccacaacgccgcctacctggtcaacgccgcggacgacgtcccgtacagccgccagccgatctccgacggggaaacggtgcaggtgggacggatggtcctcaaggccgtggccacgccggggcacacccaccaccacctctcctacatcgtgaccgacggcgagcgccaggcggtgttctccggcggcagcctgctttacggctccgtgggccgcaccgacctggtcagcgaggaagacaccgtgccgctgacccaccaccagtacaggtcggtccggcggctggtggacgaagcgggtgaagacgccgggctgtacccgacgcacggattcggttccttctgttcgtccggcccggccagcggcgcggagtcctccaccatcggcgagcagctgaacgacaaccatgccctgacggacccggacgaggaccactttgtccgcgagctgatccacaacctcacagcctatccgtcctattacgcccacatggcccccatcaatatggcgggccccaccgctccggacctggacctgcccgactcgctggaccaggacgagctggcatcccggctcgagctcggagagtgggtggtggacctgcggaaccgcgttgcctttgccagcaaccacctgagcggcagcctcagcttcgagtatggcgacggcacccagttcaccgccttcctgggctgggtcctgccctgggacgaacagctgacgctggtgggtgaacgccaggacgtggagaacgccatccgggacctgtcccgcatcggcatcgacaacccggatgcggccatcggcgccggacccggcgacgttgcgccccgggcggaaacctcgtcctatgacagcgtcggctggcaggaagtgctgcagaagcccaaggatgatcccatcctcgatgtccgacgcacggacgagttcgaagattcccacatccaggatgcggtgaacatcccgctccacgagctgctccggcgcatggacgaggtacccgccggacggctgtgggtgcactgcggctccggctaccgctccgccgtggctgcgagcctcctgcagcgtaccggccgcgacgtggtccacattgacgcgagcttcggcgacgtgaagaaggccggtctcacgctggcgtgaaccggcagagatgagcggacgacggcgggacctcccgccgtcgtccgtttgcgtcgtgccccgcctacaggttggcggcttcctcctccgccagcctgatcatgcggagttcatcctccaccgcgcgggacggccagtagtccttggccagctcgctggcccggacccggtccgcctccgggaaaagcttgccgagcagcccggccgcctgcatcagggcgatcagcgctatggtcctggcctcgggcgccgtggttgcaggctctttggttcccggcttcgaggcatctggcgtggcttccggagttgcggcttcagccgcgccggtttccggcggctgaaggtcggacggcgcagcccggagtgctgtccggatcttttcaagcagcgcggcctccggggcatggtccttttccggataccgcacggcccggaaccggcccagatgcttctcgccgacatgctccacgatgcccgccgccgccatctgctcgtaaatgcgctgcgtttgggcgcggccttccatcatggacacccagcgccgggggctgtgcggccgtgacttgccgcggatgagctccagctcgtgctgaagctccgtgtcaggtgtggtgccggcagcccggacgtgcttgccctgcagctcgatggcaccgaggaggtccagctcggccaggattgcccctgccaccgtggtccgaagtgcgaacaccggaacttcgggtttgccgtctttgtcatcggtggccaggagaaggaaggcctggggaaggctcagttcaaccgcttggggtgtttccgcgttcatagcattatggtgcgcccgcacagcggcaaccactacggccgaagtacctgttttctcccggatctgcggacttaagctggtaccacaaatgtcccttccagcgccgcggaggccgccgtggacaccgaaacagccggcgtggttggccatgacgtcaccaccatcacctgcgtatgcgggaacaccgtcagcaaggacgggctgatccaggccaacgcgcagggcgtccccgtttactcaggtgaagcccctgccccgccggagctggcggagtggcccgcggacgaggacctttacaccctgtgcccctcctgcggccgcgtctaccgcgacgccgtcatcgaggaaacaggaacggcgcccgtcgctttccgggttgacgtgaaggcggcaccgattgccgaggccatccgcgtccactggaacctcagcacctgagcgcagcgaagaggaaagccagcgaagaggaaagccagcgaaagccaagggggaagcggaggacggcggaacctcccgccgtcgtccgcttgcgtgtcgcacccggaggggctgcccgggcgccgcgatactggcacactaagccaatgaacgaggcactctccccctcccgccgtcccggcatccgggcagcgatgtttgttgatttcgacaacgtcttcaccggcctgcaggccctggatcccctggctgccaagcggtttgccgaggaccccaagcattgggcggacgccttgtcagcgggagggtccggggagggcgcccgccgcttcctgatccgcaactgctacctgaaccccatggtgtactcgaagtaccggacctactggacccgcgcaggtttccgcgtgatcgactgcccgtcgctgacccagcggggcaagagcagcacggacatcaacctggtgcttgacgcgatggacgccttgtccggcagcggcggaatcgaagaattcttcatcgcctcggccgatgccgacttcacgtccctgatccagcggttccgcgccgccgacaggatgaccaccgtgatcgccgccggcgccgtggccttcgcataccgggaaatggcggaccacgtggtggagtcgcacgacttcgtggcgatcctccacggcaccaccgcagagcccgtccatgcgggggcggccgcgaagcagccgcaggccccagccgctgccaaggcgaaaaccaaagccagctcccctgccatccgcgaggtgctggacttcgtccggtccgcgccgggaccggtggtgggcgcgatggtggcacaccgggcactcacggccgacccctcgctgaagacggactggggcggcttcgggaagtttggcacgtgggtctcgcagatcggcaaggacgtggaatattcggcagcgcagggcggctgggtgtgggacgcgaagcggttttcaaccgaggatcttcccctgccagcggacctccagccgcgcatcgaggagcaggtcacccgggtgacggacgtgccggcgctctccgcagcccagttccggcagattttccagtccatggcggcccggctccgggaacatccgccgctcaaccgcaccgaactgtcccggcaggtgcgggacgactgcgtcagcgcgggccagccggtctcccggaatgcggtgagttttgtgctgcagggcctcgcctacgccaatttccagctgagtgacaaggcgacggcggccgagctcgcggcggcgtggacggcgaacgtggaggaactctgccgggtggcgttgctggagttcgacgccggcgagaagcttgcggtgcggcgctgggcgagcggcgggctgctggagaacggacaggcttaagcggacgacggcgggtgtttggctccaggggtgctgggcctcgggatgttcggcacagggatgtacagcacagggactttcggcgcagggacgttcggctctgggaccgtccccggcatgttgaaagactggctgcatgaagtttctccaaaacccgccacggttcctgttcttcacgggcaaaggcggtgtgggcaagacttccgtcgcgtgcgcgtcggcgctctcccttgcgcgtgccggccggaaggtgctgctggtcagcacggaccccgcgtccaacatcgggcaggtcttcggcctggccgttggaaacaccgtcaccgcaatcccggacgtgcccggcctcgctgccctggaaatcgatccggaacaggcagccgaggcataccgggagcggatcctcaccccagtccgcggagtcctgccggatacagaactcgccgggatagccgagagcctttccggttcctgcaccacggaggtggcctccttcgacgagttcaccagcctgctcggggacggtgcttcctatgcggaatatgaccacatcatttttgatacggccccgacgggccacaccatccgcctgttgcagcttcccggctcgtggacggatttcctggccacgggtgcaggggaaccgtcctgcctgggtccactgtccgggctggacaagcacaaggaggtgtatgccagggcggtccaggccctcgccgatcctctgcgcacccggcttgtcctggtgacccgtgcccagccgtcctccctgaaggaggttgagcggacctaccttgagctcaaccagatcggcatcagtggcgggtaccttggtgaacggaatcctgcccgaagcagcaggtggggaggagctggcgaaggccctgcgcgcccgggaggccgcggccatggcggctattcacggggtggtcgcggggctcccccgcgacgtcctcgagctcaagcccggcaacatggtggggattccggcgcttgaatccctgtttgctccctcgttgcacgccgatgctgcggagggaccgtcgtcggcccttgacatcgaggacgccccgctcgctgcgctggtggacggcatcgagtccgacggtcatggactcgtgatgtgcatgggcaagggcggggtgggaaagacgaccgtggccgcggccatcgcggttgccctggccaggagggggcacgcggtccacctcacaaccaccgatccggcggcgcacctgtccgagacgctgcacgggtccgtcgcaggactgacggtctcccgcatcgacccggcggcggccatccaggaataccgggcccacgtgatggacaccaagggccggagcatggacgatgaaggccgggcggcgctggcagaggacctgatgtcgccctgcacggacgaggttgcggtgttccggcagttctcccgggtggtccaggagtcccggcggcacttcgtggtgatggacaccgcacccaccgggcatacgctcctgctgctggatgccacgggctcctatcaccgggagatttcacgccaggtggggaactccctggggttcgtgacgccgctgatgcggcttcaggatccggtggggacgaaggtcatcctcgtgacgctggctgagaccacgcccgtgttggaggccgaggaactcaaggccgacctggagcgggccggaatccatccgtgggcctgggtcatcaacaactccatcgccgccgcccacccccgctcgcccttcctccgggcccgcgccgcccatgaggcggaccagatcacaaaggtgcgggccatggcggagcgggttgccctgatccccctgctgccggaagagcctattggagaggcgaagctgacggccttgacggctttcaccacccagcgcgtctagctggaaggcaggacggacgacggcgggacgtcccgccgtcgtgccttgcctctgacaacgcttatgcagccagcggcatgtcaaagagctgctcggcaaggctgatgaggtgatggggcgcgtctgtctcttcgccagggtccacgtggcccaggaatagggctgtcccgtggatggtgtcgtccagctcgatgccggcttccctgatgaggacttccgcccgcaggttggggaaggaccggcttccgtcattgttcaggtaggcgcgccaaccgcggccggcgatgtatccgatgtctccggcagccactcgctgaagtgctgtgacatccaggtccaggggtttgagatgtaccgggtgggccaggcgggccggaaccaccagggcgttgcaggagaagttcatggcgtgtccttggaactgagaacggggtatgcaccgaggtggagcgcgggcagccgggcgggctaggagttccggtcccggctgcccgcgggcttgttagcgctggttcttgcgcggctttgcgaaattcagttcgctgttctcgtttttggcccttttgtcggcccgcttttcaagaattgtcttgccggccttttttactgcgccgcttttgggagattttccagacatcggaatcacgcctttctgtgctttgcgatacccagtaccatacctacttttattttttaagccagtccgtggaaacccgcgggatgtagggcttgccttggtccttgagccccgtccgcgagcgtgactaaaccgttaggacgggttttcttattatgaccggaaaaggtcccgaatatctttcggcatcaggccttttcgactacgtaaacgcatcatttgcacgtctgtgccaggaaagcgccgcgcttcatgcggccgccctcccactccgggacgttcggccctacggcctggtgccgctcgttggcagactggcgtgtgccggcgaccgacaatgcgaggatcccaatcatggccgttatctacattccctacggaaccactgagggccaggccgccaagatcgccgagttcatctcggatattgttcacgcacatggccacaaggcgcagacggcggacatcaagcaggccgggaacttcattcccgactggtacgacgcagtgattgtcggcgggtccatccataagggcaagcacgaggactacgtcctggagttcgtgcagaagaacaaagccgtcctggagagcgtgccgtccgcgttcttctcggtcagcctctcagcgcacggggacacggagagcgcggagggctacgttgaggagttcgagaaagtgacgggttggcggccggcacaggtggggcttttcagtggggcactggcctacacgcagtacggttttatcaagcgcctgatgatgaggaggatcgccggcagcaagggcttgccggacacggacacgtcgcaggactacgtgtataccgagtgggacggcgtaaagcggttcaccgaagacttcctggagagggctacgacgccgggcgagatgctgtaggcgaacgggcatttacaagatgccctcctcgccgctacgacaaccggaacaggggcttcgtcgaacggcaaaccgccagaggctgcctacctaccaggtggtcgcctcggagcgtgaggcaagccaggtgccgttacggcgggtgaagtccatgctgagctggaggcgccacttggccctggcgccataaacggtggcgtcggtgatgatcctgccgaccaggcgggcggtgctgccctcgagggcgatagacgtgtccttttcctgcgcgtcgtgatactggaactggccggagcgcatctccgccagccactcctgcttgggctggaagtagccggtcatgtgcgtcagggagaaatcctcggtgagcagttcgcccagggccgcagtgtcaccgtccaccatggcctggagctgggcgcggtaattgcgcaggatttcggcgcgatcctgttcttcagtcatgtcctcaaccatagggacgaggcgctcatggaggcaggccctgccggtacctgccagcggaaagcggtcgacggcgggaagcacccgccgtcgaccgctttctgtttttcagagctgcccggtggggccgctgtccgtgactccgccacgccagccgccggtttcggacccgcgcgattcgatgaagtccttgaacttccgcatgtctgccctgacctgcatttcatcgatcttcagagccgcgcctgccttttcagtgacggtttccggtgcccactcgaaatggactttgaccttcgtgtggttggcatccagcggcgtaaacctgatgatgccggcatgggacttgccgtcgatgctgcgccaggcaatcctgtcgtcaggctcctgatcgacgatctcggtgtcgaattcccggtggacgccacccacattggtcacccaatggttggtggtgtcagtcagctgggttacggattccacaccggacatgaactgcggaaaggattcgaactgggtccactggttgtacgcggtccgcaccgggacatcgacttcaacggtctgttcaacgcgttccatctgcttcctcctcatgacggacggccgcaacggcggaccggcagagcttgccatcctgccggtcaggcagccgccacctttgcaccataaatccggcggctgccggtgtccagagcttcggaattcccgggatgtcggccggagacgtggacgacggcgggagtcgcccgccgtcgtctgcttccctttcgtgcctaggagctgaaggggaccttctcccagctcaggacgtcaccgccgtcagccttgttgcccgcgaccgtgaaccggacgtagttggtggcgttggcagagccgtccacggtgatgcgctgcaggtcatcggctgcaacctggccgtagatctccagccagggtgagccggcggcgagcggctggttctcggcgaaaacatggctgtcgccgttgatgaggtacaccggtgcatcgaaggtgttggtctcctcgacgatggccgccacgatctcccggaagccggacatgatctccgggttggcggtggccgcggtgagcagcgacggatcgaacatgtcggcctgtgccatgagcaccacggcgcggctgttgcggcgccctgcgtcggcaaaggtctcgcggatctgggccaggacggcgtcggtccggtgctccacctcggccacctgttccggcgttgcggtggtttcgcccaggccggtccacggctgcagtgagttgttgctgccctgaacgttcagcacggagaaggccacccggttctgctcgaaccggacgttctccggcaacccgaggttctcctgcgtcttgaccggcatggtggcacccagggacttgccgggctcattgaagaagacctcccggagcttgtccagccgttccagcgggttgtaggcgccgttgttggtgcggtggcagtccacccattcgttgtcgcccggggtgaagaccagcgggtgctcgaacgtgtcgaactgggtgcggatggtggcgaagtactcgtccgagcagaccgaggagccgttcttgatgtcgccaacgtgggtgacgaacttcaggctctcgtcagcgttgatgtcctggatgcgggcagggaacttggcgatttcggcgtcgccgtaggggatgtcgccaatgacgccgaaggtgaaggcctgcttgcccgaggtgtcatcatcggcataggcgggctgggacgcaaggaggccgagcgccaggacggctgccgccgccgtcgttttcaaggtctttgaaggcatggggatgtacctgagtctgttgggaagggcttaggccgtgcgggcggtgaggaactgctgcagcgcggcgaggtcgtcggtgttgatgtggtccacgccggcgtcggcgagttccgtccagacggcctcgcgggctgcgccgggctggtccggggtggcccagaagcggacgcggtagccgttggcatgggcctcggacacgtactcattcagcttggtgcgctcggcttccggcatggggccgacgccctgccaggtgaagagtttggtccagttgtcgctgaccagcggcatgagggcggcgggtttgccggtggtgagatcggcggagcggccatcgtagaagctgaaccgcttctcctgtgcctgcatggtggcaagcgggcggttgccgctgatcacggcggtgacggggccgctcttggtagtgccgttggtgtagcggctcatgatgtcgcggtgctcagccagttcctgctcgatggcggcataggtggcctcgccttcgctcttgatgtcgatcaggagctgcaggctgccgtcccagtgcgggaagacgctgtggccgggctggctgcggaccaggtcctggagcgggtcaaggtagaggctttcgagcgtgacgccgggctggacgtcctccaggtcgtgggccacgagcagttcgccgtccaccagccacacgtccgcttcgacgctggtgaagccgtgctcgagcgcgtcgaacaggggacgttcatgctcgtagtcgttgtgcgcatgggcctgggcgaggggctggccgacgacgacgggagcgggcttaattgcctcggcttgggccggggctgctgccgctgttcccgccagggaggcgaggacagcgacggcggcgagggtgcttttcacgaacacggagtactcctacgtacagctggaatgtccgcccggctgtttgggtgccgggcaaaaggtggcgtagaaagactgctggttgcgggagaacgcttcggggccggcgggttgccggcgaatgaactgggcgggacatcggcggggctcccgggttttgcccggtggcgcatccgcacctggactactgccgggtcaggtccacgctgaggatgcggtcgtcatcggcgccgggcctgccccggccgtcggtgttgttggtgacgaaccagagcctgccgtccggagcttgcgtgacgtcgcggatgcggccgaattcgccgtcgtagtacgtggtcgacgtggaggggttggccacgggaaccgcccggaggacctgtccgcgcaggttggcgatgaacagggtcccgtcaatgtgcgccatgccgctggggctggcctcggtgggctcccactgctgcgcggggtcggtgaagtcccctctggtggctattccttcaaccgttggccagccgtagttggctcccgcggtgatgatgttcagctcgtcccaggtgttctgcccgaactcggtggcgaacatggtgccgtcctccgcccaggccatgccctgggggttgcggtgtccgtagctgtagacgagcgaatccgggaagggattgtcgcccgggacgccgccgccgggggtcatcctcaggatcttcccgttcagggaatcgaggtcctgggaactgtcgcgccggcctgcatcgccagtcgcgacgtagagcatgccatcgggcccaaaggcgatccggccgccgtcgtgatagctcgcggaggcaatcccgtcgaggagcgtttcgggctgtcccagcgccaaggcccctggttctccggtgacgtcgaagcgctggagccggtttccgtccgttccggtggagtacacgtacaggcggccctggctgtccacagccaggcccagcagcccgccctcccccacagccgccacgccgggaatgtctccaacggtgcgcgtggtgccgtctgggctgagctcgaggatccgcccgctgtcccgctcactgaccagcggggtgccgttgcggaacaccacggaccagggagcctccagcccggtggccccggcctggggcgtgcccgccggggtggcatttcccgccgtcgccgatgtctctgctgaggagggggactgggacgggacctccgacgtcaccggcggagaaaccggcgttggggatgctgccggcggcgtggcggtgcaggaggccaacatcaggcccgctccgataaagactgccaacagggctggcgtgcgggtggctttcaaggctttctcctgatgcgtttgaggatgtttatttgcagtgctgtcggcgggcgccgcttgctggctacctgggaaatgctgtgcggcgtccggcaacagcgataacaagcgcgacggcggcaaggcccactagggcggccggcaggaccagcccatcaaagctgctgatcaccaccgcgcccgccacacccgcagcgaagattgccaggttgaacgcgacgccgagcatcgagttggcaacgtcggcgttttcaccgctggcagcgctgatggccgtttgcagctgtgctgccgcgccgccgaaggcgatgccccacaggaccatcgcggcgaggactgccactaacgacgcgtggccaacgataaagatcgcaacggccagcatgaagctcccgaggctgaacaggaccaggcgtcgaaggcctttgtcgatcacgaaaccggtgatggcgatccccgcaatggcggccgcaccgaacgttacgagcgcgatttccaccgagagatcaaggcttgccccgcggaggtaggagccaatgtaggtgtacatgatgttgtgcccaagcatccagctgacgatgacgccaagaacaaccgccacgcccgggatggcgaagacccgtgcgaggggtacccgtgtcccggctcgttgaccgggcgcgtcagggaccaggaagaccgccagcagcaaggtgacaacagtgaggattgcgaggacgccgaaggaccagcgccagtcgaaagtcgtacccagccaggagccgaagggtgtccccactgccaggcctaccggggttccaacagacgcaacggacaaggcgcggccggcatgttggggggccgtgatacgccgggcgtagccggcagtcattccccacagcaggccggagaacgcaccggccaggagccgcgctcccagggagagggcaatgtccgtggagaatgccgtgatgaggttagcggccaggaagcctaggatcccgacgacgaaaacgggcttccgtcgcaggccacgtgtcagcgcaattgccggcattgccacaatgactgttcccagggcgtaggcactgacaaactgccccgcggttccctctgtgacgtccagtcccgaagcgatctgcggcaacaagccggcgggcatggtctcggtggcaatcaggaggaatcccatcagggccatgaccagaagggctgcccagggaaagcgcccggccgggacggaaggatcgcttgccggggccgaatcctttgtttcttcagtgatgctgatgttctcggatggcagggagtcgacgggcgcttcgcgggcgccgtcctcaagggttgctcgagtcaaaacggttccgttcttttgtggagaatgttcggagcggccgtgtcatcccgctcagttagtgggagccagcctggcggtaaaaccgcttgtttggtcccggatcgccgcgaggtcatcgaacgatccgatccgcactattccgcgggagtacccgacgctctcgtagtagaggacgagggcttggtcgggtgcgtagtagccgatggtcagtggttctgcgctgtcgccggcgggcacgccgtcaagcgaaagcgcctccggcagttctgcgatcttttcctggccgccgtagtccctgaaggagagcgtcaagggaagctgcccgttcagggagcgtgcagttgcgttgccggaaagggtgcctgtcactgtctcgccatcgatgtcgatggtgatcggtgtgctgtctgccgcggcctcggaggacgggacaggtgaaggctgcgacgacgacccctcgggcgtcgtcgatgtttcggtcggggaggacggccgctcagtggtggaggccgggccgttcgaaggggtgctgcacccggccaggggcaacgcgagcaagaaaatcgcagccagggctaatttcttcaggtgcatgggagatgatccgttccaatcatgaaagttcggtccattccagcaaagcagtcggcaaagaagtgtgggagcccctgctgtgaggggtactgccagggacccctcggtgaccccggcggtgatgcccggcgtcggccgttctttcgtagctggtggccggtgccctcagccgtccgtccgcgtcctttcggatgcagcctggacagaatttccatactcgctggccgcccatgaggcgagtagttgcatgcgctcagccgacggcgaccccggctccgcggtgtagatcgtgagagtcagcccgggctcggcggccatctccagcccctcgaaagcgagagtcatttcgcccacgacggggtggttgaacgtcttgaacccagtgccgtggtggcggacattgtgtgcaccccagcgtcggcggaactcgtcgctgcgggttcccagctcaccaatgaggtcgtggagttccttgttatgggggtcccggccagcctccgtccgcaggatggaaacggtcacctccgcgaaggcatcccagtccgggtagaaccggcgggcacgttcgtccaggaacgtgaaccgggcgatgttggctggctggccgggtatgtcgtagcagtccatgtagaacgcccgggccaagggattgacagccagcagatccatccggccgttgcgaacgaacgctgggccggccgtgatcgcatcgagcacccactgcaggctctggtgcggcacgtaggacttcgaggtccgccgccgcggcggccgcgcaaccgggctggccgcctgggcgaggtcgaacaggtgcgcccgctcggcgtcgtccaggcgcaaggccctggcgatgctctccagcacctggccagaagcaccgctgatcgcgccgcgctccaggcgcgtgtaatactccacgctcagaccggcaagggtggccacttcactccggcgcaaaccctttacacgcctgttggtcccggcgggcaatccaacctgctccggggccacctggccgcgccgcgagataaggaattcgcgtacttcagctcggttgtccatgccattcacgctaagccaagtcttgcggtggagggagtccctttcaggaccccctccccgaagcccccttccttcctagagctgtgtacggaagaagtccgtgagcttgtcaaagggaatgaggccggtgcggtcgtagaggtccacgtggccggcaccgggaacccagaagagttccttgggcccggtggcgagccggtaggcctcttcgctgaactcccgggagtgtgcctggtcgccggcgatgaacagcagcggccgcggggcgatcaggtccaggtcgttgaacgggtggaagttcatgaacttggtgttggtggccagggcggggtgcgtggtggtgttggggtggtagccgcgggcggtccggtagaagtcgtagaactcccgatctacggcagtggagtctgcggtcagtatttccggcgtgccgccggtgtactcaatcgccccaccggcgaactcgacgtcacgctgtgcagcagccgtggcgatgaaggccttgcgctgttccaaggtcacggatttgttgagcccgtcgcggttggcggcgcccatgtcgtacatgctcaccgtggcgatcgccttgatcctgggatcggtcttggccgcgctgatcacgaagctgccgctgccgcagatcccgatggccccgacgcgttccttggcaacgaaggcctgcgcccgcaggtagtcgacggcggcgctgaagtcctcggcgtagatatccggtgaaacggagttgccgggcttgccggcgctctcgccccagaaggagaggtcgaaggagagcgtgacgtaaccctgctccgccatcttggtggcgtagaggttggcgctctgttccttcacggcacccatggggtggcccactaccaatgccgggtgggtggtcccccggttcaggctgttggggacgaagaggttgccgacgaccttcatctcgtacttgttcttgaacgagattttcttcaccgtgacctggtcgctggtgtagaagttgtctgcgccgttggaggtgtcgcccggttccaggtccttccgcgagacgggggcggcgaaagccggcccggctcctgccagccctgccgcgctggagagcccgatggccgccgctcctgcccctgtcagcttgatgatgttgcggcgcgacacgccagcctggatcccctgagttgttgtgttatttgcgttgctgtccgtgctcatcgtcttcatccttgtgatcgtcggttacgtatgtggtggacttcgtcgtcctttcgagcagaccacggccggaacggccagcgggagtccctgctgaggctggttctgccagagcccccatggggtgcgaagcgaaagggctctgctgcaacccgtcttcacggcgcccttgttaccgcaggccgctggccttgcatggaggcgtgtgaggaacgacggcgggaggtcgccgctggctccaggaaccggacgtgggttggtggagtcatggagtccgtcgcgtcagccggtacattagagccgatgatttccattgaccgggacgacccctcacgaggcgacgtccatcagctcctcagcgaacatctggcggatatgttcgccacctcgccggccgaaagcgtccatgccctggacccctccgcgctgtccgcgccgtcgatcacgttttggaccgcccgtgacgacggcgggctgctgggatgcggggcactcaagctccttgattccccttccggctcgccggtgcacggcgagatcaagtcgatgcgcaccacggcaagcgcccgcggacggggcgtagccaccctgatgctccgccatatcctcgacgacgcccgaacccggaaccttgagcgcctctaccttgagacctgtaccgaggactactttgcccccgcgcgccgactgtatgcccggaacggcttcacagagtgcccgccgtttgccggctactccttggatcccaacagcgtgttcatggagctccccctgtagtcaggcggccagatgcgtcaggcggcgaggcgcgccaggatggcttgttccagggggctgagggcctgttccagggggctaacagcacccgggaggcagtcgggtgggatgagtgggggttcccggtccgggtgctcggccggatagtgccggccggccggtgaaatccagcctggtggctcatccttcgtagccgccgttggtgtccatgcctgccagtgtttgagccggtggtgtttccggcatgcctgtcccaggttgctgatcccggtggtcccgccgtgttgccaggcggtgagatggtccgcctcattgtccaggctgtggttgctgcagcccgggaaggtgcatctgccgtcccgcatcttgagccaccgcttcaatgcttccgggagccggtagctggtgcgcccgatttccagtggagccccgtcgcgtggatccaccaggacccggtagaaggagttggcaccgttggcaacgagcctgcgtgccattgacggcgggaccggccccagcccgtcgatctcggcgggttcgtcggtaaggccgaggaaggagaggaccggaacggtaaccaggacatcagccttaggggaaggcacgtctccaacatcctgcttcgcacggcctaagagcagcgctgcggcaatgtccgcgcgtaactggctcaggttgcgtggttcgtccgggccttgaaggccgcgagccagtgccgtcgacttgttccagatggctaaggctgtgtctccgggaagataaagcgaaagccaagccatgccgtcccggtccgggctgaactccacccgacggtcctcaacactcttcgcgtggcgttcctcaatggactcggggtggtggcgttcccgccatgcccggatcttccggcggaaccgcgctggcacgagcgctccgggcgcggcagcgcggcccgggttctcgtccaggttagctgcgtccgggccaaagaagtgtgcctcaagagcggaggctgctgccggcgtgaggcctgttgtttcctccaccacgatgcgggcgtgcagccagctgatggtgccggcctgcagcgcatcgagtgccgctggcagcgaggtggtcagcgcgtgcgcttctccaaggagggcggatgccgcgcgttcgccgatggtgagcacgcaggcgacttctgccaccttgctcacctcctgcgccgtcgcctcgtgcgcgctggccggcgggcctcccagcgcgtctgcggcctccgcgtaggcggtgaccagccgtactttcagcgccgccgtcgcggcctcaagacgcgccaccaaccctaatccgtccaggcacacctcggactcatcatgtagcggatcagcatcagcgtcgggaccacgcgtgggcccaaccagggcggcagaccggcccccaacaacacccgccagctcgtcaaccagcccggccacggacaccacggcagcggcaaccccggcgctgactcccgcatccacaaccacaccggcttccataaccaaagcatggcaggggggtgtgacattgtggcttatggcggcgggaacgcgtcccaaggaaccatgcggacgacggcgggacctcccgccgtcgtccgcgtagttttaggctggcctgccagcgtgcctgaagcccaacgtcacaaaacgcgacgacctccggatcctgccgggcaacgccctacccttaacaggtgactttgactaagatgcgcaccgccgccgcgagctccctcgccgccgccggtctcctgttttccctcgccgcatgttcggcgccggccaccacccagccaaccccctccgcaccgtcgccgtcggccgcggcttcatccagcgatgcctccggaccctgcgacggcgtgaaggtcatcgtcgactctggcgccctgaagcaggaagctgccgacaccaacgtctgcgtgcccgtggacgagcccacggtcgctgccgagatcctcgaagaggcagacgtggaaaccgagggcaccacgcagtaccccaccgaactggtgtgccgggtgaacggtgtgcccgccgcggacttcgacgtcacccacaaggagggcacgtaccgcgaagaatgccagagcatgcccgccgccttcgcctactgggcactttgggtgaagccggccaccggtgactgggcctacgcccaggaaggcctcgccaccctcaaggtgagccccggcgagagcctggaactcctcttcacggtcgacggcgaaccggccgcccccgcggcatgaccttccggcccgcgccattacgcgccgcggcggcactcgccgtcgtcttcatcgtggcgcgggtcatctaccgcatccttttcaacggggcgggcatcggcgagccggtcctgctcgacctgccggccatgcgcctgccagccccgtacgcccatgtggttttcctcggtccggtcacggctcccgggctgtgggcggcggtcctgtccgccctgccgattgccgggatgttcctcgggttcggcctgctcaatgcgtttgtggacgtggcccgcggctttgtgcacctggcccgccgcggccccatccagggcatcgggaggatgcttgtggtggcctgggcggcgctccccgcgctatccgacgccgtcacctccgtccgcctggcgttccggttgcggggcgaaaagtttggaccccgcgccctggtgcccgtcctcgagcgcacccttgagcatgcgggccgcgttgccgcggccctggagctgcgcggcttcgggagcggggcaacgcaccggcccgggaacgacgacggcggcccgcttctggtacacgacgcccagttccacattggtaacgcgcaggtcagcgtcccggacttcacgccgcggagcgggtccatcacggtgatcaccgggcccacgggttccggcaagtcaaccatccttcgggggatcgccgggctcctctcgcacgtcgacgggggcgaagtttccggcaccgtgcgcgtttccggattggaccgcgcggccacgccgccgcgcgataccgcccgcgctgtcggcgtcgtcctgcaaaatccccgcgcggccttcgccaccaccaaggtccgggacgaaatctccctggctcttgaactgcgcggcgtggcgaccgctgccgccaaggcccgggtgctggaggtcgccgagcgcatcggagtgacggcgctgctggaccggaacgtcagcaccctctcggcgggcgaggcaacgcttgtcgctatcgccgccgcggtggtggaaaatccggccctgctcctggtggacgagcccctggcagacctggacaccaaggcccgcggacatgtcatcgccgtactcaacgccctagcccgcgacgccggcgtctgcgtcatcgtggcggagcaccgggcggcagcgcttgtcccggttgccgactcctggtggaccatcgacggcggcacattgatcccaactgcaggggtcccggccgccgcgtcgtcgacttccgagccggtcgaagcccgccagatcccttctccgcccgctgatgtcgcgccggtgctgacagcgacaaacctcgctgtgcaccgcaagggcaacactctggtgcgcgacgcgtccctgaccctgcaccgtggcgaagtggtggccctggtgggaccgaacggagccgggaagtcctccctcctggtggcgttggccctcggtgaaggcacggtgggcgaaggactgggcagggcgggaaagggcagtacgggaaagaacgacggcggaacgtccgacggcggccgggtcgccctggtgccggacgcctcggacgacctctttacgagggatacggtcgcgggcgagcttcgtgcagccgagcgacgccttgcgcgcgctttacgtaaggccggacggagcagcgcacgccggcgctctacggacggtgaccagcttcccctacgctctgccgagtcgcatttggcccgcctgcggggtgacgtcagcattcccattggccacgagcatccgcgggacctctctgccggcgagcgcaggatccttgccatcgcgctgcagaccatagacagcccccaggtcctcctgatcgatgagcccacccgcggcctcgatcccgcggcgcgcacggcagtcgcggcggcgctgcgggcggcagcggactccggcgcggcggtcctgatcgccacccatgaccacgacttcgcccacagcctgggcgcccgcatcctgccgatgcgtgacggcgtcgcgccctcctccacaccggccgaagaacccgagccgctcctctcgctcccccggcacgcagtcaccggaccggaaccgagggtgatcgaaccaaccatcccgcgcgcggaacgaaagcgccgcatctggatgccgcgcggcgtcgaacgcgccgttctcgcagccgcaaacctcctggccctcgccgccttctgctggccgctgctcgctgcggcgctcccgcaggacgcagccgccgccctcccctacgcggcgctggcaattgcgccgctcgccgtcgtcgccattgttgtgtccctggacggctcggtccgctcggcccacacggtggcgctgctcggcgtcctggcagcggtcggttcggcggtgcggctggcgagcaccggcgtcggcggcgtggaggctgtctttatcctgctgatcctggccggccgggcgttcggtgcccggttcggcatgctcctcggcgcggccaccatcgccctctcaagcgccttgtggggcggcatcgggccgtggacgccgttccaggtcttcgcctgcgcgtgggtgggcgcgggcgccggcctgctcccccgccaggtgcgcgggcgggcggaactgtggatgctgtgcggctacggcgccgtggcgtcctacctgttcggcctgctgaccaacctgtggttctggcccttcgcggtgggagtcggaaccggcatctcctacgtgcccggcgcgccgctgggcactaacctgagcagcttcctgctgtactcgctggtgacgtcgacggcgggctgggacaccctgcgcgccgtcaccacgatcgtcggcatcgctgtggtggggcgggcgatcctcgccgcgttcaggcgggtgaagccggtttccagtgctggcggaggcgccggcggccacgccgcgcagcaacattccgaccaggccagggaccggctacaaattggagtttgaggacacccgacaccatggtccctgtcgggaagtcgcgtaagccgcttcgcatgcaatgggtgaatggacgtcgcccttgaaggtcatagtgggaggatccctaggattcgctatttcccgtggatagtctgggacaggacgccaccctacggagggtcagtgaggacgtgagcgaagcagttgctgcggtaatgggccggaacaacgtcaccatatccggccgggatgatgggcccgtgatgatgtttgcccacggttttggctgcgatcaggctatgtggcggaagctgctgccctatttcgttgatgattaccggttggtgctttttgatcatgtgggtgcagggcattccgacatcagcgcctatgactgggagaagtacgggtccctgaacgggtacgcgtcggacctgctggagatttgcggcgcccttgaacttgaggacgtcatcctggtgggccacagtgtcagcacgatgatcgcagtgatcgccgcagtgcaggaccccaaccgtttctcccacctggtgctgcttgctccttcaccccgtcatacggatgacccgtacgacggctacgtgggcggcttttcgcgggaagacatcgagggcctgctggcatctctggacagcgactatttcgcctgggccgcggccttggcgcccctggttatgggcaatccgcaggagccagaattagcggaggacctgcgcgtcagcttctgccagacaaatccgtccattgcacggcacttcgcgggggtaacctttttctccgacacccgccctgaactgaaaaagttgcgcaccaactgcctgattctgcaatgctccaacgatcggcttgccccgccggaagtgggcgcctacctgcacgagaatctcgaacacagcaccatagtgcagcttcaggccaccggacactgcccccacgtcagcgccccggaggaaacggcccgggcgattttgcactacctcgacacccactcctgacaggcgccgctggccctcccccgccccgttttgaagccttctttcatcaagcacccccgcgggtgcctggataacagatgatgatggccgcagatcaggtgacccgcaggatctggttcaggcgagtttggttacctcgtaagtgtggccggccgcgcggagccgctgtatgagcacgttgccgagtgcagtggccggtgtcagcgaccctttcgcggtcggcagccggtcaccgtcgagggcaagagcgagtgcagtctcgcctgccatcacggcggtggcggcatagccgggatcaccggggccagcagcaatcgcctggtaacggtgcccgtcctcggtgcgggcggtcacctgggagtggaaccagcccgcgcgctgcgtgctggcgctcggacccgcacctggtgccggaagacagcggtcgagcaccctccgggttggcgggaacgccatcgcgcccgtgaatgcgcggagcccgagtgccattgccctggcgatgaccgctcctgccggtccgggggccacccccatcacctcgccgtactgaagggagcggccgtaggcccagccctgcaatgcgttgctgcggcgcacgatccgggtgttgaacggggccatgatgaatggcgcggtccaggtgccgtcagcggaacggcgcacaggaccggcgtcagggggctgttgtgtcgtcggctcgcgtgtgcggtcggggctcaaagcgtaggggtcagccactaatgacctcagggcggtgctggatcgcatcgcgtcgagctgcccgcgcattgattcgagtgtgcctccgctgatgccagccttggccgtggccacgagttggacctcgaccaaaccgccagcgtcatcagcttctgccgtctgatgaagcagcagtacggcgaggtcggacggcacggagtcgtagccgcaggagtgcacgatcctggccccgctcgtcctggccagagcgtcgtagcgatcgatcgcctcccttatgaaggacacctcaccggcgaggtcggcgtagtgggtaccggcccgtgcgcaggcgtcgacgacgggtagtccgtgtttcgcgtatggaccgacggttgtgaagagcacgcgtgtgcccgaagccaaggcggcgattgagtccgcgtcccccgagtcagcttcgatgagggcccatccgtgcgcggcggcgggcaactgcgaccgaaccgcctcgagcctggacttggaccggcccgcgagtccgacccgcataccggccggtgcatgctccgcgacgtaggcggcgatcagttggccaacgaaacccgctgctccgtagagaacgaggtcatgttcccgagatgagttgtccataactgcagcctttcacagcggcaactccaagcacggcgatggccgcggctgcagctgcggtgtgcaacgtcaccatgcggatctacctcgaccgctcctccgtagaggtgttcgtccagaacggcctgaagaccatcaccgaccaggtattccaacccgggagccgaccagatggccctcttcgccgaaggcggtaccgcccagctcaagtcactcaccgtgacaccgctggagaaggcagtgttcttctccgaaaagcaataacacccagaatttgatcagctcacctgcgagctggtgctgaagggactgagttcggtagtacaccgggcccagtcccttcactttttcccgggcgcacgtgttgcgagatgagccgcttatcgatcatgcagctattctgcatggttatcttcaaaatcttgcgcttttgttgcagctcttgtgactctaatctcatcagtacaagctcttcgaccatcagatcacttgtccaattgcgcgctgggcaggcagcatcggggtgctgttccaccagacacggcatcccactgacggccttcgccctcgcgaaggaagagctgtcccgtgcccgtgaagggtgcttcggtggcctgaaacctggggaggtatcctcatcgaagcatccttcacgggctacggggcaacgcctgcaaactttgccggaccagtgccaggccatccgcatggaaggcctggcaccacatacccctaccaaaaggagtgtccatgtcaggaaacagagccgtcgcctacaaagaacccggtgtcgtcgaaatcatcaacaccgactacccgacgttggaactcaaggacgggccaggagtcaatccagccaatgtgggccggaaagtaccccacggtgccatcctgcgcacggtgaccaccaacatctgcggctccgaccagcacatggtacggggccggaccaccgcccccaaagacctcgtcctcggccatgaaatcaccggtgaagtggtggaagtcggtccggacgtggagttcatcaaggtgggagacatcgtctccgtgcccttcaacatctcctgcggccgttgccggaactgcaaggagcgcaaaaccggcatctgcctgaacgtcaacccggaccgcccgggcagcgcctacggttatgtggatatgggcggctgggtgggcggccaggcggaatacgtgctggtcccctacgctgactggaacctgctcaagttcccggaccgcgaccaggccctggaaaagatcatggacctgaccatgctttccgatatcttccccaccggcttccacggcgccgtcactgccggagtgggcgttggatccaccgtctacattgccggcgccggcccggtgggcctcgcagccgccgttggcgcgcagctgctcggtgccgccgtcgtgattgtcggtgacatgaacgaagaccgactggctcaggcccgctccttcggctgcgaaacggtgaacgtcagcaacggcgatccgaaggaccagatcgagcaaatcctgggcgtccccgaagtggattgcggcgtggacgccgtagggttcgaagcgcgcggtcacggcaaggacgcctcacacgaggccccggccaccgtgctgaactccctcatggacatcaccgctgcaggcggggccctgggcattcccggcctgtatgtcaccggcgacccgggtggaatcgacgaggccgcaaagcacggctccctgtccctgtccttgggcaccggatgggcaaagtccctgtccttcaccaccggccagtgccctgtcatgtcgtataaccgccagctgatgatggcgatactgcacgacaaggtccagatcgccaaggcagtaaacgccacagcgatcgcgcttgaggatgcaccgcgcggctacgccgaattcgacgccggttcggcaacgaagttcgtgctgaacccgaacggatacgtcaaggcgtagaaccccacgtaagtagcaacccacccggatggcacgggccttcctggtccgtgccatccggcacgcatccactctccctgcatcagcaaaggtaatcacatgacccatcgcaccgaccaagaatcgattctccgccttagcagcaacgggaaggagcaagctgacatccggctcgaagcagcgagtccggtgaccgttcggctgcagctggatggtggctgcacctgccagcatggcactgaaaatcgcccgggttcgtatgttgacagcgacctcggcatccgctgacggcggctgcgccagcccctctggcatcagccctaaggccgggaccatattcaaataggcatctcagcaaccttcgctgcacaaatgatcatcagcgtcatgcccatgatgcccagctacagcccagcctgcaggtgctgcttatccgcctggtctcggctcccgcttcagcgccgaaggcgcagcgcgaacgcgttagcaccgacaatgaggactatcccggcccattccaccgcgcccagttcctcattgagtgcgatggctccgatggccgcagcgaacacaggattgatgctcatgagtacgccaaagatgtgggcggggacgctgcgcagcgctaccaggtctgcaatatagggcactacggatgccaggagtccggcggcgacggcacaaagcaccgttgcggcgtcgggtctttgggtaatgaagatggtgagcccgacggggaggaacagtgcggctgacactcctgttgcggtggcggttccctggacaccgggtatccggttacctaccgttctgttcagcagaatgtacgcggcccagctcgatgccgcgatgagtgcaagaccgattccggcgtagtctgtggaagcctcgggctgtgtgatggcaacaacgcccgcaccagcaatggcagcacagaacatgctgcctttacttctggttgtggccaaggcaactgccagaggcccaaggaattccagcgtcaccgccagtcccagaccgatttgctcgatggccgcgtagagcgaaaggttcatcgttccgaagacaagcgcgagcagaagtatcggccaccattgggaaagcgtgaaatcccggactcttggccggaccagcggcaggagtaccgcggcagcaacaagttgacgaactgcaacaacaccgacggggcccactgccggaaaggccatcgagccactggccgcgcccaattggtttgagagggcacttgctacgagcgtggcggttgcccgcccctgacgccctttccctgctttatccatgaatggattctccgcaacggccgcactcccccataatgcataagtgcgccgactaatgcagatcctgcatgaatagactggtggccatggacttcgagatacgccacctgagatctttcctcacggttacagaggctgggacgttcaccgacgcagccattgagctgggtatttcccaggccgctgtttcccggaacgtcgctgctcttgaacgggcattaggagtccggttgctggtgcggaccacccgcagtgtggaactcactcccgcgggaaagcgcgtgataggtcgcgctcgacatgccctctccgcgctggaggatcttcagcgggaagcgtcctcctccaagagcaccgtaaggatcgggtatgcgtggtctgccttaggcagccacacccctgaattccaacgccggtggaccgccgccttccccgacaaagacctgctgctcatcaggacaaacacccctaccgcagggctggccgaaggaacaaccgatcttgcaatcctgcgccgcaccccggaaccaggaaccgtcgacttcgtcctcactggatacgagaaacgctactgcgcaatggcgatcgctgaccccctggcagccaaacgagccgtcacgctagcccaagtcagcgatgccactttggccattgatccacggaccggaagcacccgcctggacctctggcccgaaggaaagcaacccgttcagacggtaatcaccgacgacgtggacgactggctaacggtcatcggcagcggcaaagcccgcggcataaccgccgaatccaccgcccaccaataccgaagagccggccttgcctaccggctcgtccgagacgcaccgccagtccccgtttacctggcctggtccagaaacgacccgcccgcaatccaaaccggagcggccgacctcatccgcagcctatacgaagggctaggactaacgcccgggccgggggcctgtccagatgaggcacagcccaacctgacgtcagaattcactcaaaaaccgtcaggttagcgtccaaaacgtgtttcctgcagccttttgatggacagccctaaattccaacccgacacttggcagcagtacctccgccccggcatttagcttccacaagccttttggagctcgcatcctgcctggtgggcaggtagagccggctgttacgcttccggacgtatcgcaggtgtacctgactcctccgacagtgcccgttccgccaggcacaagccttagcgaatgggtcggctcctgtttttggttacccggcgcggcgaccatgcttgtcttcaacgccttgggaggcgtgctcagcccagggggcgtccgctcagtacacggaccacccccacctcacacctcgaagtacttcgcctccgggtggtggaacacgaatgcatcggtggactgttcgggatgcagcatcagttcatcgctcagcaccacgcccatccgctccggcttcaggagctcggtcaccttgcggcgatcctccatgtccgggcaggcggggtagccgagcgagaaccgggcgccgcggtagtcgagcttgaaataccctgcggtgtcctttggctcctcggcggcaaagcccagctccttgcggatccgcgcgtgccagaactcggccagcgcctcggtgagctgcgtgaccaggccgttgagctcgtagtagtcgcggtactggttggcggcgaacatcttggcggtgaactcctcggtcttcgagccggcggtgaccagctggacgggcagcacgtcagctggacaggtagcacgtcgatctggccggattcgcgtcttgggcccccactgccccatgaacgtggcgcgctcatcgaggaacgccgagtagtcgtggagcgagacgccgcgcacgatgcgggtgccccagaacggcggggcgggcacggggttgtcggaagcgacgtcggaacggccgggcatggcttccggctcggtcaccgtgaacttggcgccgcccttgtggatgcgcttcttcaaaggcggcaggccgacgtcgtgcggggacttgtcgggggcgtggaagcggtttttatcctgctgatcctggccggccggcgttcgttccccggtttggcctgctcctcggcgccgccaccatcgccctctcaagtgccttgtggggcggcatcgggccgtggaccccgttccagatcttcgcctgtgcgtgggttcgcggtgggcgccggcaccggcatctcctatgtgccgggcgcgccgctggccaccaacctgagcagcttcctgctgtactcgctgttgacgtcgacggcgggctgggacaccctgcgtgcggtcatcaccatcatcgggatcgccgtggtggggcgggcgatcctcgccgcgctcaggcgggtgaagccagtgtccagcgcggctcttggccccggcgggcacgccgcacacactggatccgcccaggccagggaccagctacaactcagggtttgaggacacctctgaactccccggtgcgaccgtgccttggggaaggctctctacccccacattatgagcggcgcgccgttcaagggtaaaaacttgcggccaatgccatccccccagacccacaggcctgatccgtcgggcatccactcgtcgattacgccttgtatcacttcttgcccgtggtgaaagcgaattcgttggcccccgccgaagttgggcttcggctctctcgcgcatccctcggaggtgtcgcgggagatttcatcctcctgcaggtagggcagccccttgcgacagtccacaggcccgtcagattctgaatgtgaaggcttccggacgccgactctttcctgctgaagtgccaaggcatgctcgttccgttcgaagcccacttcgttgaggatcaattcgacacgtgctcgcgtggatgctgctacacagccctgctggtttatcactctagacacggtggctgtggagactcctgccattttggctatatcgagcatgcggaaggtgtgtgttgccgttccacgtcccgccacgcttgaggtcgttttttgcctgtcggcgttctgggtggcgggaaggaaaggggcggctgatttgaagccgaaggccagatcggtgttccgaaggcttccggcacccgttttactgctgggttgtttcagcacgtctgccacggtccccggtgttgcgtccgaaggcgtcgggagatgccgcaccctactggtcggggtgccggcggttggtgcaggcccgggagatttcatcatgggtcctttttctaggtcgtgcagggcagagctgaagccaccacaggaccttcccacctgccgtcctcctgagagaaggcaggtgggaaggcaccacacgtagcgagcggtcggaacaacagtcccgtaggtgacgccgtcggtgcttgcgagaagctcaagcgtttgtgtgcggctgccccagtcgctgtctgtcttgagtgctacgcgtgacaccggtggtgaagagacggaccgcccgggtgaccccgggtggacgacatcgtgtccggcatcaatacggacggtgttgtatctaccgctggggacacgccagcagcaattccgagattgcgccgaggagattcggattcagatccatggcttgcagataactaatagtggcggccaaatccccgatcccgcttatcttggcaaagacgctttccttggtggcaaagtcgatctgtgcatcggcgagcagctcgaagacgcgcttcgtcacgtcattactggccagtctcattccgtcatggaacgtgacggtaagcccggtgtccgcggcgatattctcaacccgcagcgtggtcgagtttgttgctgccgcgtaggtgcgggccgcgtttagcttccgcccgccgctggtgaccgtgacgtgcttgggtgtgtcgaagccgacgaaggtcagctcgtagccgcgctgagcgggaatgtgtgacagatcgcccgtcgccggctctaccgtgaacgttccctcgtgccagtcaagatgcatcggtgttttcgcgggtgccgcggaggagtctttggttgaggcgtcgtggtcttcgatcagtgtgaacgttcctgaggccccggcgaagattcggatctcgatgtttccggggttgggtgttccgtttccggtttcgtccaggctggtcagcgggatgacggagcctgcccgtgcgagggcgggaatgtgctccagaggccggtagaggttgatgctccggtcgccccggtaaatcaggcctgtgaaaaagtcgatccagatcccctcaggcagccaagttttgacccggccaaggttgaggctggggtctgacggcgttgtgaccggagccatcatgagctcggtgccgaagaggtattggttcggcacggtgtaagcggcgttgtcttccgggtactcgtagtacatcggctcgatgaggggaagaccctcgtgggcggcgcggtggttcatggtgtgcaggtagggaaccaggcggtgccgaaggcgcaggaaatcggccatgattctttcctgagcggcagggtagcgccacggctccttgccggtgaaggggctggctccgctgtgcaggcgcatgatgggggaaaagacaccgaactgggtccagcgcacagcgaggtcgttgtccttgtacccgcccatgtgtccgccgatgtcatgactccaccacccgtagccgatgtttgatgcggtggcggtgaagtagggctgaaagtccagggactcccaggtcacgatcgtgtcgccggagaacccgatcgggtagcggtggctgcccggaccggcgtagcgggagaaggtcagcgggcgttttccgtctcgggcgctgtcgaggaagtgcaggtgatttagcacccagagcggatccatgcccatgatctttgagtggctgcccgattgccagtcgagccaccagaaatcgacgcctctgtcctccagggggtggtggacgtgttcgaagtacgcggtgaggaaagccggatcggtgacgtcaaagacgatggggtcttctgaagcagggtcgatgcccagttcccgggccaccactgcgtaggcgtcctcatgggcgcgcaggccttccgccgggtggacattcagcgtcaggcgaaggccgttgctgtgcagccagtcggtaaagccatcggggtccgggaacataccgcggttccaggtgtagccggtccagccgcttccatgcttggggtcgatgtccaccaggtgccagtccatgtccaggaccgcgacggagaacggaataccttggtcctggaagcgttcgatgagttccttgtactcctccgcggtgtaacggtggtaacggctccaccagttgccgagggtgaaccgtggcagcagcggggtgcggccggagaggtggtagaagtcctgcaggcactggcggtagctgcggccgtaaccaaagaagtacaggtcaacagtgtcggctgtcctcggtgagaaccagcccccgtcaagcaaaagtgaggcgctgtcatccagtacggagtagccgttccgggacatcaggccaggttccagcggtatggatccgtctgcctcgtcgagggttctggcggtgccgccgaggttctccccggcttcggagtagcgccacaggctgtggtaggcgctgagtttccccttgacctggatggtcagcccgttcggggagaaccgctgcttgtcgtagctcaggtgcaggtgttcggtgatgatctgcagatggtgggtgtcgtcaatgacgcggaactccggggcgtcgaagttcctgttcagagccagctgcgaggggcggtcttcgaaggtgccgtctgggctgtactccatccggatcatccgggaggtcagaacggtgaaccggtaggtgtcaccgcggattgttagctctgccggggcgagaggctcggattggatccgcagatgggccggcagctgcacggaatcgcggtgaaggtgttcggatgtcagggtcatggtgttgtcctgggtgcgtgaggagaagtggtgccgcatcgacaaaaggatgcggtaggccgggcggttggccggtggcgctacttgacggctgcgctggcgactccggcgacgaaccggcgctgaaagatgatgtagacgatgatcacgggcaggacggagatggtgctggcggcaaacagtccgccgtagtcggttccgtattggccggcgaatgtcgtgaggccaacggcgagaacctggttggcgttgtcgctgatcatcaggtagggccacaggtagtcgtcccatacccaaaggaattggaagatggccagggcggcgatggagttggtggacatgggcagcacgatccggtggaagatccgcacctcggatgcgccgtcgatccgggctgcttccaggacctcgtccggaacggcgtgcatgttctgcctcatcatgaagatgccgaacccgctgatcgcggcggggatgatgatggacagatagttgtcctgcagccctgcgtccgcaaacatggtgtaccgcggaatgatggtgacggcccagggaatcatcatggtgccgacggtgaagcccatcagcatgccgcggccgcggaattggtacttggcgatcacgaaaccggccaaggcagaggtgtagaggacgatcgccgtgatggtgacggcgagaaagaccgagttcccgaaaagccgcaggaagtcgaatttactctcgatcgacaggaagttttcgaacgtccaggttttgggcaggaacgtctggtccgcggcgttgatctccgagttggatttaaaggctgagattatcatccacacgaagggaaagacggtgccaaggccaaggatgcccaggagcaccgtgagtgcgagggagctgaggcgggtgcgcacagtctttatccttccaatgagcttttccggccggtggcgaaccggaaggaaatgagggtgagcagggccgtgacgatgaggaggatgaatgcagctgcggaggcatagccgaagtcgtacttcaaaaacgccttgtcgtagatgaggtacgagatcagctgcgttgatgtccccggcccgcccttggtgaggacgagcacctgaacgaacgcctgcaggtaggaaatgattgaggtgatgaccacaaaaaccgtcatcggtgccagcagggggaaggtgatacgccagaatcgttgccaggcgcccgctccgtcgaccgaggccgcttccagggcgtcttcgggtactgcgtgcaggccagccaggaacaggatgactgcgtagccgaaatctttccagatggtcattgccataatcgagggaagtgcgagctgcgggtcgtagagccagttcagatccaggccgaagaaggtgttgattgcaccggtctgcgggttgtacatcatctgccacacgtaggccacggctaccagtggtgtgaccgtgggcatgtaaaagatggtgcggaaaaacgtctttccgcgggtcaccttggagaagatggcagccgcgatcgccaggcccagcgcgacgcggaagaagatcacaatggcagagaaccctcccgttcgaagcattgctccccaaaagtcggccgacgaaaggatggttgtgtagttttccaggccaacgaagtcgaacgcgccaacgagcggattccagtagtggaatgagccgacgaaagccaggccgatcgggtaggcggtcaggcccagcagagaaccggccacgatgatgatgaccacgttacggagggcgcgttcgcccgggtacgtgcggacccgtcgcttttcttgcgcacggcgcttgctgccggtcggggccggtgccgggggtgcactgcggcgtaatgaaagagtcatggttggtcggtggtccccgcccttgcggggaccaccactcccttcgatttttgtcagcgccctatcgcgggctcggcgcgtagtgcgcgtacgccggctctgctgacttgaattttgtctttgccaaatccgaggcaatggtcttctgggccgacgagatggccgtttccgggaccacgccgttgtagagcacgtcctgccacgccttggtgatggaggtttcgaacgtggccggcatgggaccgggccagatgtagcggtccagtgaacccatggccttcactacggggttcgcagcaatgtcagcgtcactgtccagtggcttgtaggccggggcaagggagtagttcaaaaccagattcttcatgtcggtcttgtcggtcaggaagaacttcatgaagtcctgggccacagccttctctgcttcgctggcacccttgttgattccgggggtggattcaccgttgtagcggtcaaatgcgtagggtgcttccgcagcgtccgggaccggggtctggaaggttccgtagtcgaggctcgggtagttcttcttgagcgtcccgttcaggtggccccactcatagaccatggcactctggccctggccgaagctttcgatggccttgggaccgaaatccttagagccgaccttgtccacgttgtataggtccaggaagtactgcatcgtctgcacggtcccgggattgtcgagggtcggggtaacagcatcctgagcaaacaggttgtagcccctctggtactgcaggaagccgagcgactggtacgtgccattgaagttgaacccggcttggttaaaggtgtcaccctcacgcttcgtgagcttcttcgcgacctcgcggaactgctcccaggtcttgggggtgtcactgtccgttaggccagcatcggcccacatggccttgttgtaccagatgaggccggtcatcagaccgtagtcgaggtatttgaccttgccatccaccacgtgcgccgcggccccggtgtaatccgcttccagatccgacgtctcgatgtcatacggctccaggtacggatccagcgtggcgtcataggagttgtggatgttgaacagcgtgggacccttgccggactgaagctgcaacgggagtttggtccagtaggactcccatggctggttcaccgtcttgatggtcacattcgggtggagctttttgtaggagtcagcgaaagcctggaacttttcctggccatcccacaaccaccactccagctcaatcggcttgccgtcattgacaagcgtgttggggtcgtacttgatggtctctccctggaccggcagcccggacggtgcttggtcgacggtctccccgccgcttccggcgccgcatcccgtcagcagcaaggctgccgtgccgagcacggcaattgcgcgtgcaagtttcatgctgaacctccttgttcgttgtgttgaagtgcaaagcgtcacgtatagcgctaaaccaaagtaagtataacgctatactttgactaggtgtcaagagcttctggacttttcgggatgagtgtcgaacgtaatcggggtagccttcactttcgaggaaagaggttggattgtggccgtcacgctgaaggacatagccgaagaagcaaacgtcactctgatgacggtttccaacgtcatcaacgggcgccatgcaaaagcgtcacaggtgaccatcgacaaggtgctcgccattgccgaccggctcggctacgttcccagcgcagccgcccgcagcctcgcctcgaactcatcgcggattattggggttatggtgcatgatcctggcaacgggaacgtcctcaaggacccatacacagcatctatggtcggagcgattgaacctgcccttcgccagcatggctaccacctcttgctgcagggaataccagacccggccaacgtccccgcggccttccgcgcctggaatctggacggcgcaattttccttggcttcttggacagcacgcttcggcccatggccgggaacctcggcaaaccattggtagccatggaaagctacacacagaacccggaattcatgaacgtcaggcttgatgaccgcgacggcggctatcaggctacaaaacacctgctggacaacgggcaccgagccatagccttcgcaggacacctcactgccgaacgagcagtgaacagggaacgtttcgaagggtacaagctcgccctggaggaggctggcgtgcctgttgacgaatccttgttgttcgatgcgcgtaattcccacagcgccgggatcagcgtcggccgccacctcaaagaccaatgtcctgaagtgacagccgttttcgccaccgcagatctcattgcaatcgggattatggaaggtctcgtcagctgcggactcaacgttccgaatgacgtctcggtggtcggcttcgacgatctggacatcgccacctacatttcgccgaaactcaccacagtcgcccaggacttgcaggccaaggccgctgccgcggtggagctactcatggacaggcttcaggagcccgccaaggagaccgccgactgcgttctaggtgtccagttggtccagcgggaatcggttaagaagctcgcccactgaatgtagaaggagacagggccccgttgcccggtttcggagttggacagtgtgggcgaccctcgtgatattcgtacctaagacatagccgcggcatcaaacggctcacaccttgaagtacttcgcctccgggtggtggaacacgaacgcgtcggtggactgttcggggtgcagcatcagctcgtcgctgaggagcacacccatccgctcgggcttcagcagctccgtcaccttgcggcggtcctccatgtccgggcacgcggggtagccgagcgagaaccgggcaccgcggtagtccagcttgaaatacccagccgtgtccttcggctcctcggccgcgaagccgagctccttgcggatccgggcgtgccagaactcggccagcgcctcggtgagctgcatgaccaggccgttgagctcgtagtaatcgcggtactggttggcggcgaacattttggaggtgaactcctcgatcttcgagccggcggtgaccagctgcaccggcaggacgtcgatctgcccggattcgcgggacttcacgaagtcggccaggcacaggtgccggtcgcggcgctggcgcgggaagttgaagcgcagccggtcgctgccgatcggaccgcctgaaccaccgtccggggcgagcagccccgcggtacccaggacgccgtcgcgatcctccccgtggtggagaaccaccacctgctccccctcggagaccaccgggaagtagccgtaggccacggacgcgtccagcattccctcgccgaggatgcggtccagccagtagcgcaggcgcggccggccctcgcgttccaccagttcctcgtaggaggcgccgtcctcgccgcggccgggcttgagcccccactgccccatgaacgtggcgcgctcgtcgaggaacgccgagtagtcgtgcaacgaaacgccgcgcacaatgcgggtgccccagaacggcggggcgggcacagggttgtcggagacgacgtcggaccggccgggcatcgcttccggctcggtcaccgtgaacttcgcgccgcccttgtggatgcgcttcttcaaaggcggaaggccgacgtcgtccggcgattcaccgcgggcaacgcgcaccagcggttccatgagggcgaggccctcaaaggcgtctttggcgtaccggaccacgccgtcgaactgctcggccaggtcctgctccacgtaggcgcgggtcagggctgcgccgcccaggatcacgggccacttcttcgccaggccgcgggactgcagctcggcgaggttttccttcatcaccacggtggacttcaccagcaggccggacatgccgatcacgtccgcgttgtgttcctcggccgcggccatgatctcggcgatgccctgcttgatgccgatattgacgaccttgtagccgttgttggtgaggatgatgtccaccaggttcttgccgatatcgtgcacgtcgccgcggacggtggcgatcaccatggtgcccttgcccgaggagtcggacttctccatgtgcggctcgagcagggcgacggcgtttttcatcacctcggcggactgcagcacgaacggcagctgcatctcgccggcgccgaagcgctcgcccaccaccttcatgccctcaagcaggtggtcgttgatgatgccgagcggggtcatgccctcgctgcgcgccaggtccaggtccgcttccaggcccttcccttcgccgtcgatgatgcgccgctccagccgcgcgcccgtgggcagcgcggcgagttcggcggcgcgctggtccttgagcgctgcggtgtcgacgccggcgaacatgtccagcatgatggcgagcgggtcgtaggtggtgttgccgtcggcgtcgtattcgcggcggtcccagacgaggtccagcgccaccttgcgctgctcttccggcagggaggcgagcgggacgatcttggcggcgtcgatgatgccgctggtcaggcctgcctgcacggcctcgtgcaggaacacggagttcaggacgatgcgcgccgccgggttcaggccgaaggacacgttggagacgccgagcgtggtgttgatgccggggtactttgcggtgatctggcggatggcctcgatggtttcgatgccgtcccggcgcgtctcttcctggccggtggcgacagggaaggtcaaagcgtccacgatgatgtcctcgacgcgcatcccccattcgcccaccagggcgtcgacgaggcgcgaggcgatggccaccttgccctcggtggtgcgtgcctggccctcttcgttaatggtcagggcgatcacggcggtgccgtgttccttcacgagcggcataatgcgcgcgaagcggctgtccgggccgtcgccgtcctcgtagttgacggagttgaccaccgggcgcccgccgatgtgttcgaggccggcctgaagtacggccggttcggtggagtccatgaccagagggagcgtggaggccgaggcgaaacgcgagacgatctccttcatgtcggccacgccgtcgcgccccacgtagtcgatgcagacgtccagcaggtgggcgccgacgcggatctgctcgcgggcgatgtccacgcagtcgtcccagcgctcttcgagcatggcctggcggaacgccttcgagccgttcgcgttggtccgctcaccgatggcgaggtaggaggcgtcctggtcgaagttcacgtgctggtagagggaggcgacgccggcttcgcgctcggtgggaacgcgggcgggctggggcttgccgtccgcagtggcgggcacggctttggtgcggaagggcgcaagacgttcgacgacggcggccatgtgttccggcgtcgtaccgcagcagccgcccaccaggcccaggccgaattcgcggacgaactgctcgtgcgcggtggcgagttcgctgggcgagagcgggtagtgcgcgccgttggggccgagcaccggcaggccggcgttgggcatgcaggcgatggcgacggaggactgcttggagaggtggcggaggtgctcgctcatctcgtccggcccggtggcgcagttcaggccgatggcgtcgacgccgagcggctcgagggcggtgagcgcggcgccgatttcggagcccatgagcatggttccggtggtctcgacggtcacctcgacgaagatggggagccggatgccgcgggtgacgatggcctgcttgcaaccgttgacggcggctttggtctgcaggaggtcctggctggtttcgatgaggaacgcgtccgcgccgccgtcgatgaggccctcggcctgcagggcgaaggtctgcttaaggtagtcgtagctggtgtggccgaggctgggaagctttgtgcccgggcccatggagccgaggacccagcgcatccgtccgtctgttgcttctgccgcttcggcgcgttcgcgggcgatcttggcgcccttcagggcgagctctgcgatgcggtcgtcgatgccgtagtcggagaggttggaccagttggcgccgaaggtgttggtttccacggcgtcgatgccggtggcgaagtaggcgtcgtggatgtctgcgaggacatccggccgggtgtcgttgaggatctcgttgcagccttcgaggccctggaagtctgtttccagggacaggtcccggccctgcagcatggtgcccatggcgccgtcggcaatgacgacgcggtggttcactgcgtccagaagctcctgcgaacggacagggcggggcacggactcaatatcaagcgcaaaacgaggcatctaaacaggttacgtgtgggggcgggaacgttgcgctgtgtgtccgtgtactacgacggggtgggtgagtcgcattcatcgtcctgcgggctccaagcggttggcgaactgcagcgtggtgccagcagggtggccgcgcagctcgtggcctaacggaccaatagtgcgggtgtccgctccacttcactgccgcaagtgatgttagacggcggccggtatcaacccggcctcgcgcaggtccttggatgcggcaaactcctcggcgggtgcgttctcctggtactccaccagttccacgtgatgctccaccaaggcatccttcacgtccgaaggggacgcgtagaagtactcacggcgcagattcaccaaattcacgcgctggccagcaaaatgttggtggagcatggtttcaatgcccactgcgtccttggagaagaacagggcatggacgtcaaagaggaacgggacggacgcatcgccaagttcgcgcactcgttccatggggttaaggcggcgcgtcataccaatcttgactaccccttcaccgaatgcgccgaggttggagatgacgtagacatacccagcgcgagtattgagcgcgttgtcctccgcatcggccagctttgcttctgcgtcttcgagctgctcctggacacgctggacaccttctaggtctccagcggcctggagctggacgagaacattggcgtagtgatcgacttctttctgctgcttggcctttagcgcttcccactcgcgctgcgccttggcagcctccctggcctcggctcgcgcctcggcctccatttgcttctgaatggcgacggcttccaggtgccgtgccgcgagttcaagttccttctcccgcaatgagtggaaggcgttggtaatctgcagacctatcatggtgccccgcttggcgatctgctcccgcgccttctcgaggcgtgctgctgcagtgtgaaggtttccggctttcacggtctttacacagttctcggcctcagcgttgtaggcacgaagcaaaagggcagaaaggtcacggacgaacttgctgccctcccttgtggaaccgttgaaagtgaagccagacacggtggtcacagcggttttttcacgcagcttgtccttgatacgtccacgaacggcggccagttcgtccgccagcttcaccgacgtctcagcagggtgctcgtaatcgtaaaagcccacgttgtgccggtccgcgacctgccggacgtctagaagctcgccacggacggctgccagttcggcattgatcgccgccaactcccgctgagccgaagaaatactactctccaactctgagtcgtggcgttccttggccagagtgcccatggccccgagcctctggaggtcaacaagcatctgcgcgttcgccaggtacacctcatcggcgtactgcttcaaaccgctggcaggcaggggcggtgcgccgaagctggttcggtaagtattttcggcgctgatgccgaacccctcggcgggagcaccaaaagcctccttgtactgcttcaagatgtcgagcagtatccagagcacgccacccgctagtagcagactaaacgggaaagcctccgtgggaacgaaggccataatcaagaggcaggtgcatgccaaagcaatatgtttagtaaagcgtccgggctttttttcggtttttccggttcctgtgcagagccggatgatacgtctgacatggttcccccattagtcgctgaatgattctcgaacggtagcagcagggagcgacaaaacaggccgcataccggatctcctcacatagctggcattaccagcgaaaccaaatcgaactgaaattggacccgacagacgtgctgccacagtccaatagaaagagtggtggacctaccggtttgagtccagtcatgactacgacgcctccactgccgcccgatcctagggccaagaccgtccctgcggcgcgggaagggggtgcattcatcaagaagtgttgccgctgtgcttcaatgtcggcttgagaattctcacgccggtaccgctggcagcccgtaatatcagggacgagctcggccaacatcataggcttcgcggtgtatatattcctcatgaaaggttatccgtgacaacgatcagcacgggacaggattcgcgagagtcgggtcttcgtaaccccgatcctcctcccgagggttcttccgcattcgaagtggcaatgcactatttgcgattttttgagagcgattttgcacgggcacgccgagttgtgaagggtcgtgccaggaacgtcaccatttggactgccgttctcacagcttcaatcgcagtagttggagcgctgacggctgtatccggcttggcctggttaggcctcgtcagtacggccgcggcaggcgcggtgactgtaatcgagcgttgggacgcgatgttcagacaccgcgagatgtgggtgcagcgaagcgcagtgactgctgaactccagaagcttcgccgctgggccgaattttggcgggcgaccgaagggagcactgagcaagtcggcaagagaatacttgatcgccttgaagaaattttgggtgaagacttgagcagctggacgggtctaagggaactccctcagcaacgcgatggcgaagcgcaggatgggaacggattggtagaagcgtccccaggccaagtttgacctatcgcaggaggataaggacaagccgttgtcttaggctgattttcgtgatgcgtccagtactgtgacaacgtaagccgagataccaacaggcctatacctcgacaacgtggccgcgaagctgtcccagtaagccctgcatacacccgaccttcagctgacggttccgctgcgttccttgctccaaagtctgaacggcctccatcatcaggatgatggaggccggcgtcgtgaatggctggctaagtagtttggcagccggggatacgggacctctggtgaagttcgggacgaaccccttttcatgaaggactgacacagacgcctgtcagccgcaattccttgctttccccttccctgggtcttgtcatgcttgccacaaggctccacgcagaggaaagggccaacctgtccgcaccggtaggtgcccgtgagtatcaataatgcaagacccggacagcctgtcgacctacgtaagtcacaagcaggatttgggtggcacactggtgctatgactgccattgggggaatcgccgcacacgcgatatcggttactgagacgcttgagctcattgacgcaaactttccgagcttggtggatgccgttagcaagggcgagtacgcattttggttgggttctgccatctccagggatcgccttccacctctcgaaccgcttgttggtaaaatattggactttttgcaatcgcggattgacaccactaatcccaactgcgtatacaaggatgccttcgagaacatactggaacttgcaatgctttccgaggaagaggaaaagcattgcgatttttctcaacctgtcgcaggctggcctacgcacaaagttattatggcccggctcattcgcaggtacgccgaggttctcgacatcgaaattccagggcaaccacgcgactttttgctttggaatgtacttgacgtgccgggggtctacgctgatagcgcaatagcccccgacatcgaacactattgtctagctgtgatgatactcgaagggcttcttcccgatgtcgtgacggcaaactgggacgggcttatagaacgagcgttagaggaactggcaggaaccaatagccaaatagcaccaacctacgtgacctctgccgactttcgccgcccacgaggacgcacccgcatattgaagtttcatggttgcgcggtcaaggctaagaatgatgagaatgcttatcgcggctacttggtcggcagacgtacccaaatcaccgactggccgaatgactcgaagcattcagtcatgaggctcgaaatgagttcactcgcgatctcaagacggaccttgatgattggcctttccggtcaggattccaatattcagaacctcttctcttcagcgaaggagcttttgacttgggaatggccaacagaccctccagccttcgtttttgctgaggataaagtcgggcccgaccagcagaatatcctccgagttgcctatcaaagcacttatgagggaaacgaagccgcaatagccgccggctcacatttacgggcatacggcaagccgctcctcagtgctttgatgctcgccacgtttgcgaagaagcttggagcgatggtggacatcgccgcaacggcagacactgtggagtgtcaagccgtgctcagcggaattcaaacgctagtattccttgccgcctccggagtgacttccaacgccgaccatctactcaggttgatatttagcgttggccgaggcctgtccctatttcgggacggaaaggtttctgttagcggcacctacatgcctctcagtgtcagtcccgtacaccagctcgcaacggatcctcacatccactcgggcggcttgccacagatggccgttgctctgggacttttgggaatagatcatgcctcaggggcttggtctgtatccgtgaagaatgagaacctggcccacctcggtctgactgtcacctcgggacagtttgtatcgcaaattttctttgtctcaaatccggcggttgctctacaacttgaactcgatggtctcattgacagcgaagatccggaccttatcatcattcacagcggtagaattacccagcggcttcaacggggtccaggcgcagaacacggacgcaccggacgtagcgtagcccgtcaggttggtatggctgaggtcatttccgaggcagtgactatagaagatcttcagcgtatttttcgagaagagatgtctcaatgaaccacatcagacctgtgcaacttgttatagaccttctgtcgaaaagcggttatgtgactctaccggacttcaaagtagggtctttagcattcgacttcaccaaagttctcgccggaacacagtattcctttgacctggtagtcatcgttgacaccatcagcgaatttgctgaatcaagactccgcaggcaagtggcagcattggctcgagccctggatttagtggagtcaaggcggtccgtcacactgatactcgtgggtccgggaccaagcgacatcactatccgcgaacttgcgcgggtttgccgtgtcctatcggtcggcgtgccaacaggagaacatgcagaggccatggtgagagacgtcctcgctgtactcttaccgctgagccttcctcggtcctcggtcgccggcgtaaacccactcagccgcctacggcatgaacttgagcggctgcctgagcttgctgtcctgccaatgcttgacgtggcagacgcaggtgacgccaaggtcgaactcgcgctcaaagaatggttgagccatggcatcataggggagcaagcatgagcgtggatagattaaaatcgattactatacaggacttccgaagcatcgggggtgagataactattcccttggatgctcaagttgtcctcatccatggtcctaatggaaccggaaagactagcacgctctcggcaatcgaattcgcgctggcgggatcagtcgattcccttcgacgcgtagatccaaattatctcgaccacctcgttcaccgcggggccacgcatactaatatcagcgtgaatgttgaaatgagcggaaaagatttaacgcacgctcttcgctttgctcaaggggatgacttgggtattgcaccaatccttcaagacacggaagctcactttttcagcgagcggtgttaccttgcacagtcgacgcttgggcgcttacttgaaatatatgcagagcgcgacggagaccaaaactcgcccctgactcgttttgtgaacgatgtacttggactcgatactcttgaagcactcaccaagggactaaacgcttccaaggacataagaaacacacgaaacctcgtgccgggaatagcggcacttgaaagagaagttgctatgctcactagcgacaaagctgcaaagaaagctcgccgtgatcgactagcgcaagcccaggcgcgcattttgcaagacatagaaccgggacttcgcctcttgggctcagtcgcttacggctcggacgttgcggtggccatggacaggctagcgacgaccgaagatacatccggggatatctcgctggtagagctaaccgggtataggcgtgagatcgaaagcctgctacaacggctttcttcggtaaagcagacatccctcggagtcgatttggcagccctggaagaaagagcgcacgaatcgtcctccttgacagcagaatggcaaacgaaagtgggccagcgaatcgagaagttactcgaacaggctcgcggtgaattcccggaccttgcgtcactaacgacttctagccccgctatggctgtatccacagccctagcccgcatcagtgcggagttggaaagctgtagttcccgactgcacgccgacgctgtagatcgcgaccggttagatgagttgataatttctgcagaggcggacggtgcacgcatcgctctcattgatgaacaaacagctactgttaccgccggagcgggtgagattgcaaagttattagcggcactgggcccccatatccacaacagcgagtgcatagtatgcgggcgagactattctgaaatctcagaagaacccctgtctgcgcagttggcgcgaagagcggcgcagctaagcgaccaagcagaaagattggccgaactcaatagggcgaaacatgatgcagcaacaagcctcagtaacataacttcagagatgaaactcatcgaggctcgaattctacaatcttctgtcaggtcgctcctagtatccagagaggcacagttccaagattggcaaaatcagctttcggctcgcgtggccgacgctgaattgggaacaaagcatctacgggagaccacccaagctcgcatggcgttggctaccgcgcgtaacgatgccggggcatggatcgaagttagaaattctgcgagtggaatatgccagaagttgtcaatcgacccacctagcgatgtcgagccgatcgatagcctactggataggatatcgacgcacatcaggaccctaatgactgagggtgaagagcgactcgccgcgcgaacggcacttaaggattcgcaccgaacatggatgcagctaactaatgacctctcagatgtagacgtcgagcacagtcgtctcgacagccggttgaaagagttgctggctgagcgggacgaattcgaacgacgccgaaatggtgcgaagcaactgcttaaagttgccacagaagtgcagcagaaaataattcgagaggtcttcaatgactcgctcaattccgtttggcgagacctcttcgttcgtcttgctccaaaggagccattcgtgccggcatttcgagtagcagaaggacgtaaaacttcgccacagctaactacagtccatcgggccggaggaaccggcggaagccccggggcgatgctaagcgccggcaacctcaacactgctgctctcaccttgttcttggcgcttcacctgaccgcaggggaaaagttaccacttcttgtgctagatgaccccgtccaatcaatggatgatgtgcacatctctcaattcgccgcgttgctgcgtacgctctccaagcaacacagcaggcaagtgatcgttgcagttcatgaaagagcactttttgattaccttgccttagaactcagcccagcttttgatggagataggctgataaccgtggaactaaaaaagcaatctgatggtacgtcatttgctgcacccagctatcacttttattcagatgaccccgtacatgtcagtgcctaatacttcccgcgtatccgagtcaaggttgttaaagcttagagaactggatctagccccaggccttctaaacctccgccgcaagcgcagcaaactgggcctcatcaactgcgcgtaggccccacccgcagccagaagtgaagcgtgcgttccctgctccacgatctggccggcctccatcaccaggatgaggtcggcgtcgcggatggtggagaggcggtgggcgatgacgaaggaagtccggtcggtccgcagcgcccgcatcgccttctgcaccagcacctcggtccggtgtccaccgaaaacgtcgcctcatccaggatcagcaccgacggccgggccaggaacgcccgcgcaatggtcagcagctgcttctcccccgcggacacgttggacccctcgtcttcaagcagcgtgtcgtacccgtccggcagtgaccgcacgaaccggtccacatacgtcgcccgcgcagcttccaaaatttcagcttcagtagccccaggccgcccgtacgcaatgttgtcccggatcgttccagcgaacagccacgtatcctgcagtaccatccccattcgtgagcgcagctcgcgccgcggcaccgaggtgacgtctacgccgtcgagcgttaccgcccggcatcaatctcgtagaaccgcatcatcaggttcaccagcgtggtcttccccgccccggtgggccccacaatcgccaccgtctgccccggcttcgccaccagggacagcgacgaaatcagcggctgctcccgcgaatacgagaacgagacatcgtcgaacaccagccgcccccgcccaaacaccggacccgtagaaggggagggctcaggctcaggctcaacagattcctcctcctcctcatccaacaacgagaacacccgctccgcagacgccaccccggactgcagcacattcgcctgcacgtcgcccagctgcatcggccccggatgccacttgcagcccacccaccacggcgatccccacgtacaccaggtttctgatgaacgtcatggccggcatgatcagcccggaaatgaactgcgcccgaggctcactgcgtcccggcggtttcttctcgctgatcttgtccgggccggtggcgcagttcaggccgatggcgtcgacgccgagcggctcgagggcggtgagcgcggcgccgatttcggagcccatcagcatggtcccggtggtttcgacggtcacctcgacgaaaatggggaggcggatgccgcgggtgacgatggcctgcttgcagccgttgacggcggctttggtctgcaggaggacctggctgggttcggtgaggaaggcgtccgctcccccgtcgatgaggccctcggcctgcagggcgaaggtctgcttgaggtagtcgtaggtggttggccgaggctggggagcttggtgcccagccccatcgagcccaaggtctcgcatgtgcggacgatcttacacttcgcccagctcacgtggctgctactcctggacaattaaagtgacgcgccgcgtcctggccaacatgcaacgattagtggcgttcgtcgcggagataggacactacccctccggaagtgcggagctgctccggaacgcgccttggccatagggtttctgcgacggcaaaaggaggcgagacgaggaacgctagtgccagccttcgaatagggcatggcggtcttgccgggttgggaaactacatctagagtcgcgtcaccctaactatgagtcgagcccttccaagaaccgacgagcctcatcatcgttacgacggccctcatcgcgataggactccgcgacaagtcgaagcgcggcggccgttcgcggatgtgtggcgtcgacaagcagtgcccatgcttcgtagccatccgcgagctcatattcctgcttcccgccttccgtcatgcctctcgaagttaccccccgcttgttgtgaaggccgattgcaaagccacgttccaagcgatcgtttggcgccgactcaagaacatctcgcacaggtcgagtggggaaagtcccgtcgggatcgcttggcgcgtaagcgaacacttcgccgatctgcagctccccgatctcaaggcgatcgctgtccgctagacgaactcgtacgtcatctagccaagcttgtaaggcggcaccgtccacggtgccgtctggtgtcgtaccaggtacgacatgccactcacgcagcagccgatatgcatttgcagctaatgctgcgttgacttcacgcggctcaccacgcctcgaattcgccggcttgaacgccagttcgataagactcacgaaccatgtcgggtcgcgcgcgagaagacgctgaagtgacaatgctttggattcgtagtgcagagcgggaagaaacttccactccaatcgggcaatctctgtatcatgaacgacgtgcgaccggacgtagtttaggagcctagtcaagtcgtgctctttaactcgacccccttctgggtcctcaactgttccgaactggttcagagcgtccatgacgatgctgacgtcaacatcacctgcgagacgctcggcgaacaagctcagggtgtggacagccatcgcgacccgaccgtggcgcagaagctggcgggcgacttcgttgacatgctgaaaatccgcgccgcgtccgtagggcacgaactcggcccaataggcggcatctacctcttcccccagcgctgagagaaggtcccacgcctttgtgacgtccaagatggtgtccaaaagacgagcttggacaatggggcggtcactgaagtgctcgacccacgggcgaacatcttcgacggtgccagcgaaacgagcgcgagcgaacccgtctgcaaactggacgcgttggccatcctcactgtctaggaaggacagcgcttcagcgtcgtgcagttcgtcgatttctgccgcggcttgacccagcgcccggggaagggacacctcgctcgctagctgcaccatagcgtcaaacccttgctcgttaataatctgctctgccgcagcctcgcgcgccagctttaccgcggcgtcgtatgtggcgaagtcgtcgctaacggagacgccaatgtttggggtccagtcgtcaaagagccatcggtaagcttcgcttggacgagcgggcttcaaagcttcggcgacagcttccaggggcaccagccatttatcaggaagcgaccactccgcgtcgggatactgccgatgtttccgcacgaagtcttcaatcgcgtcccaaagggcggtgactacctccggctctaaagcctcccggcgaagaagaaccagtcttgctagcaccgcgcgctttccctcgtccggcaaccgatcgaaagccccgacaacctgtatccaccgctgtggttcttcatcggacatctggacgagtcgttccgagattacatctaggaagctgaagagttccgcgtaggtagcggttcgctcttcgggtacgacccaatcgcggaagcgcggcttgtaggtgttcataccgacttctgtctgaccgggaaggaggcgcagcatcaactcccatgtgacctccctgtggcgatgaagcaacgcatcaagagtcatcacgcggctctctgctggcgctgaagtctggggcagccagggacgaaaaatgtcgcgcagactagctgcaggtcgattgctaagcttgccgccgggatcaatttcggcgagcgacgcaaggacctgagcggcgaagcccatgtgccggttcgaccacgcaacacactccagtgcccaaaggagccctgtgtggggactgcttgcatgccaactttcatcctggtcttgaaagagctttcgaagtagtggctcggagccgctggccgcctcggcgaccgctcgaaggaagacgtcaggtgccgcttcagccagtagcggtatcacatcatccatagatgcccacaactgcgcggagttgtcctgattagcccgacttaccaatctccaaacgacgcgctcggcccattgcctcgcggaacgcccccctggtaggcgaacctcgtcaccccgactcccaagcagggccaccgaacgtgctaaacccttgcgcaagtcgctagagtgaaccctggtctttccgtagactgcggcgctccaccggtcctcgggaggcagttccagacgtgggtcaactgcaccgagcacgttttgaacggcgacctccaaagcatccaagtccgtctcgcgaatgctgtgccgagcggttcgccaagagtcctcgggtgctgcaacagcccatgtcccgccaacccgcgtgaacattggatctgcttggcgagcaacggcttctagttgctccgcaagactttctttatcgatgcctgtgaggccctccagaatgtccacatccccactccgcagttggctccaggcgccagcaagccatgcacggcgcagcgggcgttgtgcaaggtcctgcgtccactgatccgggtcgagttgaccaaatctagttgccactctttggagggcgagcaaactcttaacgccagcgcgggcgaacctgtccaggtcagcttcacccaccccggcctgacgcaacgctgcctgaagggacaggtggtcgagaggcagcaattcaatttccgcgtcgccatccgtcacgacgaagacaacatgatggttctgcacgagttgcgcctcgcgctggaggttctcttcgtatggcaaaaggatcaataggcttgatgtgctgtctagacgtcgcagggatgacccgtcgtgcacaagcaacgaccgtgagagcattggttcggattgctctatgccttgtgccatcatggcgcacacggcgaacgctaggccgtcatcgacactcgcggctttgatgaacgtccgaccgacgtccacagccaatcgtcgaagcagggccgcagcgctatcctcgcgtccagcaagcaccacatccggtgtaagcagtgggtcgaaaccgtttgagaagcgacgccaccattcttcgattgtcgccacgccaagcgcaggcatctccaacagctcagacagccaaatgcgtaccgctgcagcctcctccagcgcctgctcgatgtcgtctgcgtcgaggaccctgacatcgtgccactgcccttcctgccgacgtctgtcctcccagtccttcttccttggccaccgacgaggagtgacaaagacgaatgttgccgaggccttatcgattccaagtgaatcagccgagcgagtgttgtagtcttctgtggcttttcgagtggggttctcgctcgtgcccatctcccagacactgaggccgtccggcacaaatgaagtcgcacgcgtagcctccaccacgccgtcaaacccggggagtccaacgccctccccgccgcgcatctcgacgcgttggacctggtcgttctcgtgccggatgagcctccggacaagacgaggaaggtcagcctgtgccgaccgctgatcggcccatcgctcaagatcagtcgcgtccgctagatgtggccgcccaaccccatttgtcatcgcttcaacctcccccgtatagaaagcctagatgttttcccgcgtcctgtggacgcgcaagccccgttatctgaattctctcccttcccggcggctctccctgcagtgtccgccgcgccgcgagcttgcggagacgtcatgccgtcagcccccccgtggagtatgtccgtcctttgctccgatatgccgcgctggcagtgagggttccccaatcaacgtattctccccgatggagagaagatactggcatccatactcattcgacagatgcccgataacttcctcgctatctagaccaaaccctaacgtttaaacctccgccaccggagccgcgaactgcgcctcgtacagccgggcataagccccgcccgcggccaacagtgaagcgtgggtgccctgctccacgatctggcctgcctccatcaccaggatgaggtcggcgtcgcggatggtggacaggcggtgcgcgatcacgaaggaagtgcggtcggaccgcagcgcactcatcgccttctggaccagcacctcggtccgggtatcaacagaagacgtcgcctcatccagaatcagcaccgacggccgggccaggaacgcccgcgcgatcgtcagcagctgcttctcccccgcggacacattggcgccctcgtcgtccagcacggtgtcgtacccgtcagggagtgaccgcacgaaccggtccacgtacgtagcccgggcagcctcaagaatttcggattcagtagccgaaggccgcccgtacgcgatgttgtcgcggatggtcccgccgaacagccacgtatcctgcagcaccatccccaaccgcgagcgcagctcgcgccgcggcaccgaggtgacgtccacgccgtcgagcgttatccgcccggcgtccagctcgtagaaccgcatcatcaggttcaccagcgtggtcttccctgcgccggtgggccctacaatcgccaccgtctgccccggctccgccaccaaagacagaccagagatcagcggcttgtccggcgaatacgagaaggacacatccgagaacaccagccgcccccgcccaaacaccggcccggcagaaggcgcaggctcaacagactcctcgtcctcatccagcagcgagaacacccgctccgcggacgccaccccggactgcagcacattcgccatggaccccagctgcgccagcggcatggtgaactgccgcgagtactggatgaacgcctgcacgtcccccagctgcatcgccccggacgccacctgcagcccgcccaccacggcgatccccacatacaccaggttcccgatgaacgtcatggccggcatgatcagcccggaaatgaactgcgccccgaagctggcgtcatacagctccgcgttcttctgccggaaccgctcctccacctcacgctgccggccgaacaccttcaccagcgcatgcccggtgtacgtctcctcgatctgcccgttcagctcccccgtgtgcttccactgcgccacgaacagcttctgcgagcgcttggcgatcagcgccgtaatccccagagtcaacggaatggtcaccagcgcgatcagcgccagcgtgggcgagaggatgaacatcattaccagcacgcccagcaccgtcagtacagacgtgaccgcctggctgatggtctgctgcaggctctgggagatgttgtccacatcgttcgtcacccggctcagcagttcaccgcgctggatggaatcgaaataccgcagcggcagcctgtggatcttcgcctcgacctccccgcgcagcccgaacaccgtccgctgcaccaccccgttcagcacatacgcctgcacccacatgaacgcggaagacagcacatacagcaccagcgcccacgtcagcacgttccccagcgcggcgaagtcgatcccctgccccggcgtcagggccatggcgctgagcatgtccgcgcgctgcccctccccggacgcccgcagctgcgcaaccacttgctccttggtcgccccggcgggcagctcccgggacaccaccccggcgaagatcaggttggtgccctcccccagcagccgcggcccgatcaccgagagcgccaccccggccaccgccgtcacgaacaccagcagcagccacgcccgctccggccgcagcttgcccagcaggcgtttggccgacggccagaagttcatcgccttctccgccggaacgttcatccccgcgaacggcccgccgcgacccggtccgcccaccgggcggggaatgcgtacgacgccggcgcccccggttgcggaggcgggcgcggctttggcgccgggtgcgggaggaggttccgggctcataccgtctcctccgccgccagctgggaggagacaatctcgcggtacgtctccgatgtctccagcagctcactgtgcgttccgcgccccacgatcctgccgccgtcgagcactaggatctggtccgcgtccacgatgctggagacgcgctgggcgataatcaccagcgtggcgccggcggtgctgcgcttgagggcctggcggagccgggcgtcggttccggtgtccagcgaggagaacgagtcgtcgaagatgtacagctcgggccgtttcaccagggcccgggcgatggccagccgctgccgctgcccgccggagacgttggtgccgccctggctgatgggcgcgtccaggccctcctccatccgctccacaaagtctcgggcctgggcgatgcggagcgcttcccacagctcgtcctcggtggcgtccggtttgccgtagagcaggttgctgcgcaccgttccgctgaacaggtagggccgctgcgggaccaggccgatgtgcccccagagcaggtccgggtggagctcgcggacgtccacgccgtccatccgcaccgagccggacgtggcgtcgaacagccggggcatgaggttcaccagggtggtcttgccggacccggtgctgccgacgatcgccgtcgtctgccctgccttcgcggtgaagctgatgccggagaggacgggctggtcggcacccgggtaggcgaatccgacgtcgcgcatttccagctcgccgcggcgcacatcgctgctcaaggggttcttaggcggccggacgctcgactccgtccgcagcacctcgccgattcggtccccggacacggccgcccgcgggatcatcacggccatgaacgtggccatcatgacggacatcaggatctggatcaggtagctcaggaacgcgatcagggtgcccacctgcatggagccgtcctggatccggaacgagccgaaccagatgacggccgcgctggagacgttcagcaccagcatcaccagggggaacgcgagcgccatcagccggccggcgcggagggcggtgtccgtcacgtcctcgttggcgcgggcgaagcgttcggtctcgatgtcctcgcggacgaacgcgcggaccacgcggatgccggtgagctgctcgcggaggacgcggttcacggtgtcgatccgcttctgcatcttgcggaacagcggcaccatccgggcagtgatcaggccgacggcgatcagcagcaccgggacggcgacggcgataagccaggacagctgcacgtcctgcctgatggccatgatcaccccgccgatgctgagcatgggggcggtgaccagcatggtggcagacatgaggaccagttgctggacctgctggacgtcgttggtggatcttgtgatgaggctgggtgcgccgaacttggtgacttcctgctcggagaactcccccaccctcgcgaagatcgccccgcgcaggtcccggcccacgcccatggccgccttggccgcgaagtacacggcgatcaccgcgcacacgatctgcagcagggtgattgccagcatcacgccgcccaggctgaggatgtagccaatgttgcccttggccacgccctcatcgatgatgtccgcattcaaagtgggcaggtacagggacgcgatggactgcgccagctggaaaaccacgacggcggccagcagcttgcggtgcggccgcaggtattcaacaagcagcttccagagcatgggcggctcctgacacagagtccacacggtgtggtgcgaaggtcagtttacgtccggcggctgggagtggggcagtttgctgcctcgccggccacccgccctcgtgcgttagagccatgaggcccaggggactcggagctcggcccccatggcgtcggttatgacaacggagtaaagagcaagccgtcctattcacattgccaagacaataagtagactttctatcgatcgtcgtcatattctgggacggtcgtcgttcgacgcattcattaccgggggggtggtgggcatggctggagctggttctctgtggcgttcgctgcggccaaccctcctggctggagcagccgcccttacgtggctcacggtctcttcgactgctgccagtgctgacacgctctctgagcctccctcattgcttggcagcgtcacatcctcggtagcatccgtggcagaagtgctgcccgtcctgccggcggcagatgagtctgccgctacgccggcatcggctccgagcggtttgctgcagcctgcagcggcacccttggccggcgccgccgacaatctcatagcttcagtacctgtggtcagccatgttgtaccggcaaatactgtttctgccgttacggcgcctgtaacggcggttgccgacgatgtagtggccggcgcagtaggcgcggtggtaacgccgctgacagaggctgttcccgttctggaacctgtggtccaacccatcaccgacctggttggcggagtatcacccgtgcccggcggccttccgactcttccgcagcttccggctgcatcggaggcggaagctgtcctcgaggataccggcgtcagtgatggcggcacagcaccagcccaggctgatgctggcaccgtggcaacagagtcaagccagacttcggacggttctgaggccgcggcggaccctgccagcatcgccgctgcctccatcacgtccgaagcttcatacctcacgtcctattccgcttccgccatcagcccgacagagatgactggcgagcaggcccttcccttcggcgggtcgccttaccctgcccatgtgcctgctccccctgcctcaagcagcggcggcagcacggcatccggggcgggttcgggtccagcagcgtggctcgacgcctttgatcttctactcccccttgcaggcgatagcccactgggcgagtattcggagcatgctccttcaccggtgtcctttgaccccggttcctcccctgactagttgagtgcctcctgcctttctgtggcagaacacggctaacgggttgctgatccagcgcccaacctcaactacttcaggagaaacaaatcatgagttccaaccttcgcagagggctgctcggcaccctctttgccggcgggctgcttgcccttagctgcactgcagccaacgctgcagacgccaccaccgcaccagaaaccacccagaccggcctcgcagttgccgcggacgtaaacttgggcctgggcggcctcacccaaaccggcagtaccaacggcagcattgctgacgctgcggtagccgccgatgtcgctgctaacctcggcaacgcgacgaataccggaaacaccggcagccttgtcgacgcagccgtcgcggctgacatcaacctcggcctgggcaacgtgacgggtaccaacgggaccctcgccgacgctgtggtaattgccgatgtcgacctcggtctcggcggcaccaacggcaccggcaccaccctccccgacgccaccgtcgtcgcagacgcagacgtcaacctcggcaacgtcacgggcaccggaaacaccggcaacctcgtcaacgcagccgtcgcagccgacgtcaatctcggcaacgtcacgggcaccggaaacaccggcaacctcgtcgacgctgccgtcgcagctgacgtcaatctcggcctgagcaacgtgacggacaccaacgggaccctcgcagacgcggctgtagtcgcagacgcagcggtcaacctcggcaacgtgacggatagcggaaacaccggcaacctcgtcgacgctgcggttatcgccgatgtcgacctcggcctcggcggcaccaacggcaccggcactgtcctgcccaccaccgacgtcgtcgcagacatcgacctcggactgggactcggcggcaccggcaacggcaccaccctgcccaccaccgacgtcgtagcagacgtcgatctcggactgggactcggcggcaacggcaacggcaccaccctgcccaccaccgacgtcgtagcagacatcgacctcggactcggactcggcggcaccaacggcaccggcaccaccaccccggggaacaccggtggcgtagatgtcgatgttgatctgggcgtaggtatcggcggttccggcaacggcgcagaagctcccggagcggaaacgccagggactgaagttcccggcggcggaaccggtggaacgggaactgtggacccgggcacgggcggcgtagcacccggaacgggcgctggcggcagcacgggcacggtggccccgggagctgggatcagcgtggtggccccggtaaccggcacccccatcaacagcacggacggtaagaccagcgttggttccattagtgctgctggccttgtggccggcaacgctgcgaccggtgcgtcagccggcaatgcacaggcccaggcctcaggagtcctggccaagacgggtgttgacgcttcgctgctcccgcttgccttggtcttcctcttcgccggcctgctgctgctcaggaagcgccgtacagcctaggttgcagcacgcctaacaggtagcaggaccgcagacggaagtagacgcggccctacgtagaacgagagtccggtggcggacatgtgtccgccaccggacgatcaacataaaacgaggattagcactgtgaaagacatgaaacggtttgcggcatctaaggaaaacgggattctccagctacggtgggttccccggacgttcgtgacttatgaaatcgccgtataagccgccggcgcgctagccgacctgagtggtaaccagccactgccgcttctcgttgacatcaccggtgttacgggcctcgcccccgaggccagggagggcatgaacacgtaccgtggattctccgcagtagcgctcgtgggcgatcatccgatgggcacggtaatttcaggatttgcccggcggtcctccactccgacggccttcttcaccaacgaagccgaggccctccgttggctttcagtgcaaagctttcagcaccgggtgcctgccgatgtccaggagctcgggtaggcacaactgacaagcgccggggttttgacggtggcggtgacgggggagtattggcgccgcaacctccctttatccgggcctgattatgcgttctgcttgatgaggtcttcggcttccttgaaccatgcgtcggcggcgccatcgacagtcagcttgccgaagttcaggtccgaggcaacgcgcttgaaggaagcctcaagcgtgccgaaaccgacgatcggcggctccggggcgtccttgaggtactgctcgatggacttctcgtaatccaccacgagcttgtccgtaccttcgaaggtggtgccgtcgcgctgggtcttcgacgccggaacaccgcgggaggtcttgaagatctgtcccacttcggggtcgttgaccatgaagtcgatgaagcggccggcagcgtccttgaacttggtcttggcgctggccgccatcagcatcgagggcttcaggaacaggcccaggttgtccggatcgtccgacggcggcggcaccagcttgagctccttggcgccggtatccgagaggtagctggccatgaagttatcccaggtaaactcggtcgctgcagagttggagctgaagggtgatttcggcgccaactgggtgacgcgctcttcggaaatcatggccggggtgccgcggagggccgccgtcgtattccaccacttcttgaggtcgtccttggtgaagccgagcttgccgtcctcggtaaaggcctcgatgttgttctggcgcagccagatgttgaacatccaccagacggacgtgtagtcaccgccgccataaatcgcgccgttgctcttggcgcccacctccgccatgaagtcgttgaactccttgtaggtccaggagccgtccggctcggcgatgcccaagggcgccagcttggcggggtcgtagtacacagcgaaggcgttggtgctggtggggatgccgtaggtcttgcccttgatctgccccgagggcaggagggacttctcgaacgcatccgtgttgatgttcacggtgcccaggtccaggagctggttgcgctggccgtaatcacgcaggtaggacaggtcccactgcatcacatccggcagcccgccgccggcagcctccgtggcgcgcttctgccagtacccggcaaagtccgtgaagttgccgttgaccttgatgtccggattcttctcctcgaacagcgcgatcgccttgcgtgtgcgctcggcacggtcgtcgttgccccaccaggtgtagttgatggtgaccgggttctccgcagagcccgtctctccggggctggtgctggatcccgttccacacgcggccaaagctgcggcagatgcggtgccgacagccacggtagtgaggaaatgccttctgttaatcatgggagcctccttgctcaagtggtactagctgatggtcccgacaacctccacggggtgacttggataacacgttgtgaaacgtatcagtctgatacggaaaaatccagaaacatttccgttgacaggaaaattgcagcaacataggcttggttcgcgatcacatcccctcatttcaggagcaccgtgagctttccttcccgccgggtcaccctggctgatgtcgccaatgcctcgggcgtgtcagttggcacggtttccaaagcgctgaacaaccggggccagctccgggaagatacccgggacagggtcctggctgcagcgcacaagctcggcttcgaaaccctgcctgccgaaagcagcagtagcggggtagtcaccataggcctggtcacctcggacgacatcggacgcttcagcattccggtgatgtacggcctcgaggattcattcggccctgaccaggcctcggtgctcatcagcaactcacggggcgacctggtccgtgagcgccactgcgttgaaacgctcgcctcgcggaatgtggacggcatagtcgtcatgaccaaccacacgggcccccgcgcaccgctacccaagacatcagtgccgatcgtttatgtcatgggacagtcttcagaccccgaagacatgtcagtggtggtggaccaggtccagggcatgctcctggccctggaacatgccgccaacctggggcatcagaacatcgcctacgtggcgggcccccgccaggactactctgcccggatccgcgcccaggcagtccaggaacacgccccgaccttcgggctcaccctcgtgggcgaccgtgcgctgtacggaaactggtctgaggcatggggcaggcaggcagcccagatgctccgccagcgggtggaacccgtggacatggtgctctgcggcagcgacgaaatcgcgcgtggcgtagctgacggcctgcgcgaggcaaacatcgttgtgccccatgacgtctcaatcatcggctttgacaactgggcagcagcggccctgaacagccgccccgccctgaccaccatcgacatgaacctcgaagaactgggccgcgcggcaggagcacgcgtcctcgaagccatcaccggtaatcccaggcccggggtagacgcgctgccctgccagctcatcgtgcgcgattccacctagccccttccattcaccccctacagaacacgagggaacaatgatgtacccaccaccctcccttcagcgcgcccaaaaacgccgcgccgacggcatcagcaaccctagccggcgttccatccttaccctcggagccgcagccgcggcccttggcctgactggatgttcggccgtgctgccggaagccaatgtcaccgccgccggcttcgggaagaacccttccggcaccatccggttctggtgccgtagcactgcgttcaaaccggcgcagctcattgtggacaaataccatcaggcccagcaggcagtgcggatccagctcaccgtgcttccggaggggcagatgacaacgaagctcgccacctccatccggagcggcgccgttcccgacgttgtggcccccgattccgtcacgagtccggttttcaccacccgggaagccttcacggacctcacctccctggtggcggagctcccctacgccgcccacctcaacaagccgcttctggacgtggcctcctatgagggaaagatctacgggctgccggcactttccaacgtctcacagctgttctggaacaaagagctctacgcgaaggccggcctggaccctgagagagggcccgcaaacttcgcggagtacctggagcatgccacggccctgcaggggatcgacggcgtctccggagtgaccttcaccggcaactccgccggcatcctgggctacgtcatccagccgcacttctgggcagaccagagccctttctacgacgggccattgggccggcaacaagctgcggtgctgggcaatgatccactccgccggaccctggaactttaccgggaactccacaggaagggtctctcgcaaccagggtcagcagcagattccggagcggcctggggccaggacttcctggccggaaccgtgggactgtttcccgggtcctacgacctggtggtgggcagcgccaagccggagttcctggacaagctcggcgtcagtgcatttcccgggccggacggaaacttttcccagttttccggcggtgcggtgctgtccatcccccgaggtgcccccaaccctgaggccgcgtgggacttcatccgcttcgtgggtgaacttgaacagcagtcggaactggcagcgctgggctggtatccagtccgcagcgacatcctggagacggatttcagcgggaaattcccgctgatggtcccgggcatggaacggatgaacgacgggttcgccgctcccacaacgctctacacacagctcaccaacaccgtgcagtcaccgtggcttgcgatgttccgcgaagcagttttcggccaggaggcgatggaggacatcctctaccgcgggcatcaggaaaccgcccgagttttgaaggtgaaccaggcatgaccacagcaaccccctccctcagccgggacaagcgcacacgcgccccaaggcctgcctcgcgccgcgattcctataccgggatgctcatgctcgcgccggccatgctcctcgtcgtcgcctttgtcatctttccgctcctgttcgcggtggtcatctcactgaccaactggccgctcgttggcgacgtggagttcaccggcgtcgaaaactacctcactgccttcaccgacaccaccttctggggatccattctctacacgctcctttttgcggtggtctccaccgtgctgggagtggtggtcggctacctgctcgccgtgctggtccgttccaaccggagaggtgccgggctcatccgcaccgccgttttccttccgtacgtcatcggcatcacgtcattcagcttcgtggccctgctggagttccggccggacagcggcgtgctggaccagatcctgctggcgctcggcataacctctgcgcctactccctggcttctggacgcaaccagcgccacggtcctcatagtcctgctgggtgcctacgtggggtccgggttcgccatgatcatcctcatgtccggcatgcagggcatcccggacgaactgtacgaatcggcgcagatcgacggcgcggggcggtggcagcaggaactcctggtgacggtcccgctggtcaagcgttacctggggcttctgacggtcatgggattcatcggggccatcctggccttcacccagttcttcatcatcaccggtggcggtccgggaaccggcaccctgaccgtgatgctttacgtctacaacaaagccttcggtgacctgcaggtgggttacgcaactgccctgtccttcgtggtggtcatcatcgcggcgatcctcacgctcatccagttccgcgtcatgcgcgaggactgacccacccacttctttggcccagccccgaacaggagatgccatgacaacgtccgtcgaagcgccgccgcaggtgacgcaccacaagccccgccccaccacgcccccagctgcctccagggcacggacagctgcccggttgaggaccgccatctatgcggtcatcggcaccgctgtgtccatcgcctttgttgtcccggtggcgtggtccttcctccggtcccttcagccaggaacccagatcgcggccccgtcatcggagcagtcattcgacaacctgaccttcgaaaactacacggggctcattgccaacatcggggcagggtcctacatctggaacagcctggccattgccctgggtgccgccgtgttcagcgtcatcatcaccaccctggccgcctacgccctggtcaacttccccttcaagggatccaacattgcgttcgcgctcatcctgctgaccatgatggtcccgttccaggccatcctgacgccgctcttcctggagatgaacgcgctcggcctcacggactcacttgccggcatcatcgtcttccacatcaccttcaacctgcccttcggcgtcttcctgatgcggaactccttcgcccaaattcccagggaagttgttgaggcagcacggatcgacggcgccggtccactcaggatcctgctttccgtactgcggcccatgattgtccccggcgccgttacggtgttccttttcgccttcctcggcggctggggggacttcctgggcgcgttgacgttcctcactaaacaggaactgttcaccctgccagtcgccgttcagaacctcgcctccgtcgcgttcggcgtggtgaaccacggctacgtcatcgcaggggccgtcctgctcatgctcccctgcatcatcctgtacgcggcggtccagcgctactacgtgcgcggcctcgtggccggggccgtcaagggctgagcgcacacgtcctcctacgccgccgaagcaacccaagaaagcaaccatgcaccccaccagtcccccgacaatcacgcaactaccgccgtcgtcctttcccctggaccgggtccggctgctgcccggccaattcaagaccgcgcaggacgttgacgtccggtatgtcctcgaactcgacgccgaccgtctctgcgcgccgtacctgcaggaagcgggacttgggacggcagcggaaccctacggcggctgggaatccgacgggatgggtgggcacatcggcgggcattacctgaccgcctgcgcccggctgttcgccgccacaggtgacgtccggctggcggagcgggtgcagtacgttgtggaggtcctggaacaatgccaggctgcagccggaaacggctacctcggtggcgttcccggtggccgccggctcggcgaagagctggctgccgggaacgtcgacgctgatctttttacgctcaacggccggtgggtcccgctctacaacctgcacaagacttttgccggcctcctggacgcctacacctatgccggctccggaagagccctgacagtactcacccggctggcggactggtggctcacggcatcgcgccacctggacgacgattcattcgaggaggtgctcaccacggagttcggcggcatgaacgacacctggacgtcccttgcccggctgaccggccgggaagactacctgcgcgaggcccgccgtttctcgcaccgggcactcctcgatccgctggctgcggggtacgaccggctggatgggcttcacgccaacacgcagattcccaaagttgtgggttacgaacagtttgcccaggctaccggggacgcgcgctacttcgaggcatccgacttcttctgggatgtcgtcaccctgcaacggaccgtgtcgatcggcgggaacagcgtgcgggagcatttccatccgtcgcgggacttcactcccatggtcctggacgtccagggcccggaaacctgcaacacgtacaacatgctgaagctcgccaagcttcgcttcgaacggaccggtgatccggcggcggtggagttctacgagcgcgccaccttcaaccacatcctttcctcccagcaccccgagcggggaggttttgtgtacttctcgccgatgaggccgtcccactaccgcgtgtactccacagtccacgaatcgatgtggtgctgcgtgggctccggaatggagaaccacgcggcttacggagaactcatctacagccacagcggagacgccctggcggtcaacctctacattccatccaccctggactggaccgagcgcgggatacacgttcaactggagacagctttcccgcactcggacgtcgccacactgaccgtcaccgcggacacccccacagagttcaccctgcggctccggcgccccgcgtgggcaaccgatatggaagtccgcgtatcccaaggcgacggtgtctccccacaggctggaaccgccgacgacggccatcccgtgctcatccggcgcgtctgggagggcaccaccacagtttccatccggctccacgccgaagtacgggccgaagcccttccggacggctcgccgtgggtgtccttcctctacggacctgtggtccttgccgccagggaagggaacgcaggcataggaagcttcgaagcagccgacgaacgcatgggccatgttgccggcggccaccagctggcgctggcacacaccccggtggtctccgcgcaagagccggcagacgccgtcgtcttggtcaaccgcgagtcgctttccgcggacctcaccgccacacaggatggttctcccgtccgggtccggcttgaaccgttcgcaggtatccacgatgagcgctacacggtgtactggccaaccggccccgctcccgcggagcggactgccgaactcgccgccatggacgcagacgcagcggagatggaggccgtcgtcgacgccgtcacggcaggcgagcagcaacccgaagctgaccattttttcgccggcgaaggcacgaaggccggcggacaggacggactgcactggcggaccgccacaggctggttctcctataccctcaaggatcccaactctgaagcagccttcctcaggaccagggtccggcaaaatccgggacgccgccaacggctcaccctcaacggcgcaccgctggcgaagatactgcgctccggaacggaccatgactgcgaagtaaccgagtacgccattccggcggaagcaaggctcaagaattcagtggcactcgtgttcgcggtgcacgcagagcccggccacaccaccgaggacttgctgtcggtggaactgcgaaaaggaccctagcgccatttatacacgtggcggcgtttagccagcccgcacatcaaacctccgacggtactccgttggcgtcgtggaaaaagcagccgcgaagttttggcggagggtgacggcgttcccgaatccgcagtcagtggccacctgttcgatcgacaagtccgtggtttcgagcagacgccgggctgcgtcaaggcggcgggcacggatccaggcggccggcgtcgttcctgttgcggcccggaaggcgcggacaaaggtgcgccggctcaggtgcgcctgcgccgccagcaggtcgacggtgaggggttcacccagccgacttagggcccattccagcaggcgcgagatcggatcgtcggtggagcgggaaggaacagggcgctcgatgtactgcgactgcccgccctcccggtgcggtgcgatgaccaggctgcgtgccacctggttcgccgcctccgcgccaagccgtgcgcgcaccaggtgcaggcacgcgtccagggcggaggcggtaccggcagaggtgagcacgtcgccgtggtcgatatagagcacggactggtccagcggaacatccggatgccgcgcagcaagggaatcgaatgcctgccagtgcgtgactgcccggcgtcccgcgagcaagccggcgtcggcgacggggatcgcgccaaggcacagccccagaattggtgcgccacgcccgtgcgcgtcttggagcacctgccgcagcgaatcactggggacgcgaccgtcgtcgaaccatgaaggcaccaccaccacgtccgccgcctccgcggcttccggcccttccactttgccgagccgatagccctcagcggtggtgacctcgccttcctggtcagagaaaagaactgtcttccagcaggcaaggccctggcgggcaacctcgtcaaaaaccatctgcggaacggcgaggtggaacatcgttgccccatcgaaggcgtacaccgcgatcctcattcggccccttccaaacatcttggcccgaatccatcgtatatctgccttcgtgccactgttggcacgcaccagctgcgggaagactggaacagttgccagatggcagccgagagaaccaccagggagaacaaagatatgagcaccccccgccgcgccctcatcctcatcgacgtacagaaccagtactttggcggccccctcgaaatccagtacccgccgcaccaggaatccctgcccatgattgcgaaggcagtggacgccgccaccgccgcgggcatcccggtcgccgtgatccagcactccgcgggcgagggtgcaccggtctttgcacccggcacaccggagttcgacctgcaccccgagattgagcgccgcaaaaccaccgcatggaagtcgctggtcaagcagtacggctccgtctatgccggcacggacctcgtcgaatggctgcggaagcacgacgtcgacaccgtcaccttggcgggctacatgaccaacaactgcgtgctcgcctccgccgtggaggcagagttccttggcttcaccaccgaagtcctctcagacgccaccggcgccatcaacatcgccaaccacgcgggttccgccgatgcgaagaccgtgcacaccacgctcctcgcactgctgaactcgaactgggcagcagtagcggatactgacacgtggacgaacgccctggctgcggatcaggcccttgcagggagcgaccttggcagctccgctgtcgccggtttggagctcgtcccccagacgtaaccagctgcccgggcttcccacttgtcatcggccgcgcgaagcccgggaacaccagcagcactcccgccgttgcacccacggggaccaagccccaacgaaattcaaggactgaatacatgaagtggattcttctcgccggcgccatcctgagcgaggtgacagcgtccctttccctgaaagcggcccttgataatcctgccttcttcatcgtggtggtcctcggttattccgcgtccttcgctttcctcgccggggtcctccggaaaggcctgggcctcggcgtcgcctacggcatctgggccgctctgggagtaaccctcaccgtgctgctggccgcccttctttttggcgaagcgctgacgccggtgatgatgatcggcgtcgccatggtgatcggcggcgtgctgtgcgttgaactcgggtcacacaaggagccggcagcagaacccgcaaaagaaatggcccgctcatgatgtggctgctgctggcaggggccatcctcaccgaggtgaccgccactcttttgctgcgggtcgcgtccaccggtaagcggcgctggtacctacctgtcgccgtcggatatttcctggcgttcaccctcctgacgctgacgctggagcagggcatgaacctcggcgtcgcctacggcatctgggccgctgccggcgtcgcgctgaccgcccttgccagccgcgtcttcttcaaggagacaatcacccccgtcatgatgctggggctcggcctcatcatcggcggtgtcctgctgatcgagctgggcgcggcgcactaggcaggaccgcagaacaggagtcggggcaccgggtgccgtggcactccggcctgttctcttatggcagactgcccctcccccgggcgtcccgactgtgttcaaatgggaaggttgaaccggccgcccgagtccgctccacggcctcggcccgatggaaggaagcacatgaccgatcgtccggaacaccctccaatccccacgcccggaagcgcccaaggcctggacagcaaggtcgagggcggatgcccggtggaccatggcagcgtgacctcgcacggcagcgagagcgaaaacccggccatcgattcgccccagcccaaagggcaccggccgcggaccgtcgcggactggtggcccaaccagctggacctctccgtgctccacgccaaccaccccaaaggcaacccactcggcccggacttcagctatcgggaagagttccagaagctcgacgtcgaggcactgaagcaggacatcaccgaggtcctcaccacttcccaggactggtggccggcggacttcggccactatggcggcctgatgatccgccttagctggcacgccgccggcacctaccgcgtccacgacggccgaggcggcgccggggacggcagccagcggttcgcgccgctcaacagctggccggacaatgccaacctggacaaggcccggcgcctcctgtggcccgtcaagcagaagtacggccagaaactctcctgggccgacctgctggtcctcgccggcaacgtctccctggagtccatgggcttcaagaccttcggtttcgccttcgggcgcgaggacgtgtgggagcccgaggagattttctggggtccggaggacacctggctgggcgacgagcgctacatcggcgaaggccagatgtcggaggaagtcggttccacggagatgggcctgatctacgtcaaccccgaggggcccatgggcaacccggatcccaaactcgccgcggcgttcatccgggagaccttcaagcggatggccatgaacgatgaagagacgttcgcgctgattgcgggcggccacacgttcggcaagacccatggagccggcgacgccgacgcgcacgtgggaccggagcccgaaggcgccgaccttgaggcgcagggcctgggctggctcagcacgtacggcagcggcaagggtggggacacgatcacctccggcttggaagtcacctggaccgacaagcccacccagtggagcaaccgcttcctggagatcctgttcgagtacgagtgggagctggtcaagagccccgccggcgcccaccagtgggtggccaaggacgccccggagatcatcccggacgcgcatgacccgcagaaaaagcaccggcccaccatgctgaccaccgacctgtcgctgcgctttgaccctatctatgaggaaatcgggcagcgcttcctgaagaacccggacgagttccagctcgccttcgccaaggcctggtacaaactgctgcaccgcgacatgggcccggtcggcccgcacatgctggggccgtgggttccggaagcccagctctggcaggaccccgttcccgccgtcgaccatggactgatcggcgagcaggacatcgcgtccctgaaggcccagctcctggactccggcctgtccgtctcccagctggccacgacggcatgggcttccgcctccaccttccgcaagacggacaggcggggcggcgccaacggtgcccggatccggctggagccccagcggggctgggaggtcaacgaacctgagcagctttcgacggcgttgcaggccatcgagcgcgtgcagcaggagttcaactcgtcccaggcgggaggcaagaaggtctcgctggcggacctgatcgtcctcggcggatgcgcggcggtggagaaggcagcgggcgacgccggcttccccgtcaccgtgccgttccgtccgggacgcaccgatgccgcccaggaccagaccgacgtcgagcagttccagtacctgaagccgcgggcggacgggttccgcaactatgtgcgtcccggcgagaagctccagccggagaccctcctgctggacaaggcgtacctgctggacctgtctgcaccggagatgacggcgctcatcggcggcatgcgtgcgctcggcaccaacattggcggctccaagcacggcgtcctcaccgaccggccacaggtcctgacgaacgacttcttcgtcaacctgctctcccccggcaccaagtggaaggcgtccgagaacgaggagaacgtctacgagatcacggacgtcgctaccggcgagctgaagtggaccgccaccccagtggacctggtgttcggctccaactcccagctccgggcgatgtccgaggtctacgccagcgaggacggcagggagaagttcgtcaacgacttcgtagcggcctgggtgaaggtcatggaactcgaccgtttcgacctgcggtgatccacctgaactgaatacggcttactgaacaaggcatccgggccggctgcttcctgcggccggcccggacgtttgccacagattaacagccgctcacggaatcaggttctcggcccggtagcggtcgaagagtgcggtaaaggcgtccagcgtccgcctgtatccggtgaacccggcatcccggcttttgcccatgtccgtcaccacttcaatgccgcggcccaggtcgccgtccgtgtgccaccaggacgccaggcggttcaggtccggttcgctgaggttatggcgcgcggcgatgtcccgccactggtcctcccggcctgccatcgactgctccagggggcggggcttctcctcgtacccctcccactccacgccgaagtaggcggcgagcttcggccacatccagcgccagcggaacacgtcgccgttgacgatgttgaaggcctcgtttgccgccgccggcgtggtggacgcccacagcatgtgctcggcgagcaggcccgcatccgtcatgtccgtcaggccgttccactgtgtttcggagccagggaagacaaacggttcaccgttctcgcggcacaaggtggcctgggcggcgagcgtcaggcccatgttcatggcgttgccgacggcgtgcccgatcaccgtgtgtgcgcgatgcacggaccaggtgaagccctgctccgccgcggccgcccagagctcgtcctcctgggcgtagtagaagttccggaccggcaggcgcggctcctcctcgtggaaaggagtgtccggcatttccccggccgcgtatgcctcgaagggcccgaggtagtgcttgaggccggtcatcagcgcaacgtgggctacgtccttgccgcgaagtgccgccaggaggtctcgcaccatgccggcattgaccgcgatgttttcctcctcggtgtcctgccgcgaccacgctgtgaagaagacatgggaggggttctccggcccgagcgcagcggccagcgatgcagccgaggtcaggtctgcggagagccaccgtactccgggacgctcagcaccggggttccgggagagggcaagcaccctccacccctcgcctgccaaggtatcgacgagggcagaccccgctatgccggtcgcacccacaacaagagccgtcttctcggtccctgcggttgttcctgcgccaatagtcatggagctcctcctggttgtgctgaattacgccctggcatcggcagggcgttaaagctctggggcgcgcgcaccctgtgcgcggcggcggtatgaagcctgcattggcccaatagcgacaaggcggtgcctcagccagatattcccccaccgccgtcgaacgtctctatggcccgcctggaggagcgtagatctccgcgggaagctctaccagcatcgccaccagggcgatcggaatgagtgccagcccggcaatgtgctgaaggaggccgtccggcagttggaccgccagtccgccgacgacgacggcaggaagtgctgtggagacgatggcgcgcaaggaccggcgttccacggccgcccacactgacgccgccgcaaacgccagggctccgagcaaaaccattcggtgcccttcaaagtaggtgggcgaccggccaatgaaactgaaactgtcagcaagaccgcacgccatgatggccgccgccagcaggaccagcagggcccacaacccgaccttccagcggatgaagctcatcatgggatgagctaaccacacggttcacgggttggatcggcctttggctgtcgggataggcccgatagcctgctgtgatggtcgcggacgagcaggaacttgcaggcggaaacgcgtccggccgggttgtgcgcatcggcaacaccgtaaggaaaccctggctggaaaactcagcagccgtgcaggattatctcgccgggctccgctcgtccggggtggacgttccccaacctctgggaagggacgacgacggccggagcgttgtggagttcgtggcaggcgtcctcgcgctggaggaactgccgctcacccacgacgatctgctgcgggttggccgcatgatccgccggatccacgacgcgagtgaagctgtggtgatccctgatccaggagcgtggaacatgctgctgcctgccgagaacccggacctgatgtgccacaacgacctcgcaccctggaacctcgtcaggggcgaccggtgggttttcatcgactgggacggagccggccccagcacgcgcctgtgggatttggcgtacgccgcccagtccttcggcatgctgttcgaagggcagcccgtggaagacgcggcagcgagactgtccgcccttgttgacgggtaccaggctgacgaaccgctccgcagcgcgttgccggcagcaatggcggagcgaactgcggcaatgttcacactcctggagtcctcgcacgagaacgggttccagccgtgggcggacatgttcgtcaacggccacggggaacactggcgtggcgctgcgcagtatgtacggcagcatcaatcggcatgggagcaggccctcgcccggccgtggtctgctgagcgtccagggtcagcgttggagtagagccgccgttagccttggggagtggaaattcgagctgttctcttcgacctggacaacaccctgttcgaccatgcagcttctgccagggcaggcatggatgctttccttcaacacctcgggacggcgtccacggacgatctggcacgtgcgtggttccagctggagcaaaccatctaccaccgctttcttgccgatgaactgtccttccaggaacagcgccgggaacggctccgcccgtttctcccgctggcaggtcttgctgtccccgcaacggacgcgatgctggacggactcttcgacgtctaccttcagaattaccaggaagcgtgggccgcgttcccggacgcagcgcccgccctgcgaagcctgcacgacggcggcatgccggtcggcgtcatcaccaacgggaaccaccgccagcagacactgaaagtcagcaagataggcctcggcccggtgatacgccgtatcttcagctcggagtccatgggccatgccaaaccctctcccgaggcattcatacaaccctgcaaaagcctcggaatctccccggcccaagccctctacgtcggggacaacttccgtgttgacgtcgaaggggccaggaacgcggggctgcactcgatccatctcaaccgggacggtggcggaccagaggcacgatccagagcctcgcagagctgatcccgattcttggcgcaggaacaggtgcggcgaatgattcgactacgatcttgtgatggcccgccttatcgctccggacgttagttaccactcctcctggctggaaggggtggcggatttcgacggcgcccgccaggacggcgcgggcgccgaggactggcccctggaagacctgggagacccccaaacgttcggccgctttgttgactggctcgtcaaggacgcactgccggagaccccgcggaaaccggagcacgtgccctgcacctacctgtggatcgtggaaggtgacacgttccttgggtctttggccatcaggcatgaactgaccgagttcctcctcaacgaaggcggccacatcggctacagcatcaggccctcagcccggcgccgcggccacgctgcccaggcactggcggatgccctgccgatcgcgaagaaactgggaatcaccagggtcctcctcacctgcgatgaggacaacttcgcctcccggggcactatcgaaaagaatggcggcctctatgaggacagccgcaacggcaaacgccgctactggatcgataacgcctaacgaggagctatcccctaccccgccggccgcagcgacgtgatcatccgcttgatgtccgcatactccggcgtccccgcgtacagcttcgccttctccaggtacggcagcgacgggtcgcccggcgtcaggttcagctccggattgtagaaggccccgaacgtggcggcgttgggcggccagttgaagaagtggaacatgtagcaggccgagtcaccttccggcagtggcgcggtggtgattccgtaggccgccgccggggtgtccggcgggccggccgcggcgtcgttgccgcgggtctcgaacgtgtaccgggggacggtgccgtactgggccagctgcggcatctcctcggactccaacacggagtaggggtacttctccgtacacgtggaaccggtggccatgttggtgcgcagcgtcgccagcagccgcccgtcctggctggtcacctcggcagacgctccgcctccctcagccagctcccctgccgggtccgtgatgttccagctgggcggcaggtcgaaggccaggtcgccggccgccgtcgtgtacgtggtccaggaggccggcgccggggcgctggcgctcgggctcccggtcgcgctgggcggtgcggccgtcgtcgtcgcagtgggcgtcgctggttcgctcgcggcagaggtaacgctcgacggcgtcacttgcggttggccggccggcccgccgcatgcggtgagcagcgaaaatgaaagaagtagtgccgcgccgggccacgctgaccgccgcatgtccgcctcctcggaagccgttgtgatccctcaattgtggcgccgcggcgcctgccgggatccgttaatcaaccgattggagccaaaccgttgcagctcgtaacgaaaccattcccggccacgccggccacccgccgtcgaacgtttacgtcccccttaacgcactttgcggcgcgggctgtttgggtgagcggatggcaaccagcgtgaacacgaacgcgaccgtggccgtgaccaccagcagcatcagcccaatgaagtagctgttgtccgccgcgttgtaggtggcgcccatgaccagcggcgggaagtagccgcccatcccgccggcggcgctgacgatgccgctgatgctgcccaccttcccctgcggcgagagccggccaacccacgcgaacacgccgccggtgcccaggccaagcgcggccgccatcgctacgaaggtgagtccggccgggatctcgccgtcgggccgcaggttcaccacaaaggccagcaccgcaatgcccgccagcgacgaaagaaccaccggcttggacccgatccggtccgccagcactcccccgatgggccggaacagcaccgccgccagggcaaacccggcggtgcgggtgccggctgcggttggatcgaactggtagatgtcccggaggtacgtgggcaggtaggtggcgaaggagacgaagccgccgaagacgatggcgtagaggaagcacaacttccaggtgacggcgagcccggcagcgtccttgagcttggggatcaccggcgcagtgttccggtgccagtccggcgactccttcaggttgaaccagatcacggcccccatcaccaccagcagcccggcaatcagcaggtgcgtgggcaggtagccgatccaggtcaccaagcgcggggtcaggaaggccgccagcgcggtcccgcccatgccggcaccgaacacgccggtggcaaagccgcgccgcgacggctcgtaccaggcggaaacaaaaggaattccgacggcgaacacggtacctgcgatgcccagcaagaggcccgcgcccagcaccaccgcataggaaccgagcgtgccgccgaaggccaccagcaggacgggaggcacgctgcccagcaggacaaatgtgaacatcacccgcccgccgaagcggtccgtcatggcgcccaccacgatccggcccagcgatccgacgaaaatcggcatggccaccaggaccgcggtggccgtggagtccagccccatctcctgcgtatagcgggcgcccaagggtgccacgatgttccacgcccagaaggccatgacggacgcgctggtggccagcgccaggttcaggcccttgccgggatgggaggtttccgtgggcggtacgggattcgcggggcgtgcggcttcagtcatggtgtgctcccctcagcggttccgggtgtcccggtcctcggtcccgaccgccgaccagccgcgtttgccggcgggcgcgttggcgttgtggacggcactggcgccggacctgctcccggccctgcctccgggccgtgtacccgcccgcccgcctgccctgccgccgtcgcggtcccgcgagcggtacacgatgtacgggcggaacaggtagtggaacggcgcggtgaaggcgtggaccagccgggtgaaaggccagatgatgaacagggccatccccaccaatgtgtgcaggtggaaggagaacggtgccgcagccatggccgcgatgtccggctggaagatgaacagcgaacggaaccacggcgccacggtctcgcggtagttgtgcccgtgctcgccctcgaacacgctggccagggtggtccacagcccgaacacaatggcggcggtgagcaccacgtacatggtcttgtcattcttggtggtggccataaacaccggccccgtggtgcggcggcggtaaatcagcaggatgatgccgcccagtgtcccgatgcccgcgatcccgcccacgaacagggcgttgaagtggtaaaagtcctggctcatccccaccgcttccgtccacgacatcgggataacgagcccgaagaagtggccggcaatcactgcgagcaggccgaagtggaacagcggcgaggcgacccgcagcagttttgattcgtagagctgtgaggacctggtggtccagccgaactggtcgtacttgtagcgccaaaccagcccgcccaccaggaccaccaccatcacgtagggcaggacgccccacaggacaatgtccagggcggaaagttcgacggcgacgccgggctctgtttccaatgtcaccatggtcaggcccccttcacgggcagcaggcgcggatcgtaggggtcaaggccaaccgcctccgtaggcggcccgtagcctgccatccgcatcacggcctgttcatccgccggcgacttcccgggcagcgtggcgcaaatggcctccaggatccgggcgtgcggcagcttgtcccggagcagcccgaacttcagcatctccaggctgggccggtaccggatcagcagctcccgccctgcggcgaagtccaccagcgcggtgtactcgagcaccatgggcaggtagtccggcagctccccctgggtgtccaccaggatgtcgctttgccggtaggccttcttgaagctgcccagcacttcgccgcggcgccgggtgtccccgtccgtccagtagctcaggtgcagcgcgtggcggcggctgaggtcgaactcccgcacgtagtgcgcctgggcctccatcagcggcgtggcttccagcgcgtccagcacctcctggaagggttcgacggcgcccgggaactccgcgagcgcggcgcgcatgagcgtcaccttgcccaggaggtcctggtccgggtaggacaagcaccacgcaccggccatgtaagccacctggtggcggcggctcacggctggtcctccgccgcggccagggtccccggctcgggccccttgtccggaaagagccccggcggcgccccgcggccgtcccagttcagcaggttcacccgccccttcaggctcgtcccggcagatacctcgtcgctggtctgcctgtcgcgcagggcgttgaacgtgtccacggcaaccggtaccggcctgccgctcgcctcgccgaagggcgaggaatcctgcatgcccgggccgccgtcgaaatccagcgagcagcccatctcctccaggtcatgcgcctgctccacgtgcgccttggggatgacgtaccgctcgtcgtacttggcaatcgccatcagccggtacatctcgtacatggtctgaccgtccatgcccacggcctcggcgatggactcgtccgggtcgttgcccatgctgatgccgcgcatgaacgaacgcatggctgcgagcttcttcagtaccgcggtgacccggtccgcgtccccggcggtgaagagctcggcgaggtactccaccgggatgcgcagcgcatcaatggcgccgaacagattgccgtggtcctcgccgtcgtgcccctggtcccgcagcaggtccaccaccggggaaagcggcggcacgtaccagaccatcggcatggtccggtactccgggtgcagcggcagcgccaccttatagaccttggcgagcgcgtacaccggcgagcgcacagcggcgtcgatccagtcctcggggatgtcctgcgccctcgcttcggcctgaacggcgggatcgttcgggtccagcagcacgtccatctgggcgtcgtagagttcctgcgggtcggtgacggacgcagccgcggtgacggcatcggcgtcgtacaaaaacagccccaggtaccgcagccggcccacgcaggtctctgagcacaccgtgggaatccccacctccacccgcgggtagcagaacgtgcacttctcggccttgccggtcttgtggttgaagtagatcttcttgtacgggcagccggtgacgcactgccgccagccgcggcacttgtcctggtccaccagcacaatgccgtcctccacccgcttgtagatggcgccggacgggcaggatgccatgcaggaagggttcaggcagtgctcgcagatccgcggcaggtagaacatgaacgtctgctcgtacgcgaacttgatcttgtcctcggactcccgccggaccttctccaccagcgggtccaggtggccgttctccgcggagccgcccaggttgtcatcccagttggcggaccaggtgaccttggtgtcctccccggtgatcagggatttgggccgggccaccggaaagtcgtcgcccaggggtgcgtccaccagggtcttgtagtcgtaggtccagggctcgtagtagtccttgagctcgggctggaccgggctggcgaacagcccgaacatcttcttcacccggccgccggccttcaggaccagtttgccgcgcttgttcaggtcccagccgccgcgccatttgtcctggtcctcgtagcgccggggatagccctgcccgggacgggtctccacgttgttgaaccagacatactcggtgcccgcacggttggtccacgcctgcttgcaggtgaccgaacacgtgtggcagccaatgcacttgtccaggttcatcaccatgcccatttgcgccatgactcgcatcagtactgcacctcctgtgagcggcggcggaccgtggccaccatgtctcgctggtttccggtggggccgaggtagttgaacgcatatgccagctgggcgtagccgccgatcaggtgcgagggtttcaccagcagcctggtcaccgagttgtggataccgccgcgccgcccggtggcctccgacttcggcacgtcgatggtgcgttcctgcgcgtggtggacgtagaccacgccagcgggcatccggtggctgacgatggcccgggccaccaggacgccgttgatgttcaggcactccacccagtcgttgtccctgacctggatggaatcggcgtccgccggactcatccagaccgttggcccgccccgggagagcgagagcattagcaggttgtcctggtattcggagtggatggaccacttggagtgcggcgtcaggtagcggaccaccacctccagctgcccgttctgcccgagtttgggttccccgaagaggcggtgcatgtccagcggcggccggtagatgggaagggcctcgccgatgtccgtgatccagtcatggtccaggaagaagtgcatccgccctgtcagggtgtggaagggtttgagccgttcgatgttgatggtgaacggtgcgtaacggcgtccgccggtctccgagccggaccattccggcgaggtgatcaccggcaccggggccgcctgggtctgggcgaaggtgatgaacttttcctcggagccttcggacaggtccgccagcttccgcccggtccggacttccaggtccttgaacccctgcacggacagcatcccgttggtggtgccggagaacgccaggatggcttccgccattttcgagtcggtgtcgatggcggggcggccgtccgcggcgccgccgagcatcacgccgttcgagtggctgagccgcttcagcggctcctccagtttgtaggtgacgttcttgacagtgaagcccagcttgtccgcaaggggtccgacggcggctagcttgtccgcgatggttgtgtagtcccgctccaccacggaaaagacgggcatgttctgccccgggacggcggggatgtccggctcccgccagtcgcggacgattccgccgggctgggcgagctggcccggggtgtcgtgctgcagcggaacgctcaccaggtcgcggcggactcccagatgggtcttggccagcctggagaactcccgggccagcaggtggaaggtgtcaaagtcggtcttggtttcccacggcgggtcgatggccggggtgaacgcgtgcacgaacgggtgcatgtccgtggaggacaggtcgtgtttctcgtaccaggtggcggcggggaatacgacgtcggacagcagcgtggtggaggtcatccggaagtcggcggagaccagcaggtccagcttcccttccggcgccttctcgtgccacttcacgtccgtgggtttgagcccctcggcatggtcctcgcccaggacgttgttgtgggtgcccagcaggttccgcaggaagtactcgttgcctttcgcggaggaaccgaagaggttggagcgccagaggaccagggtgcgcggccagttctccggggcgtccacgtcctcgatggccgggttcagggtccggtttttgagtgcgtccgctatgtaggtgggggtgtccttggcggttccggcggcgacggccgcctccgcctcatcggccaggtccagggggttgcggtcgaactgcgggtagaacggcatccatccgagccgggcggactgggcgatggcgtccgcggtgtgcaggccgtccagggcgccggtggacagcggggacttcagcgcatcggcggagtagccatcctggcgccactggtccgtgtgcatgtaccagtacccggtgccgatcatggtgcgcggcggccgggaccagtccagggcgttggccagcgacacccagccggtgatgggacgcgtcttttcctgccccacatagtgcgcccagccgcccccgttccggcccatgcagccggtcagcatcaccagcgccaggatggcccggtaggtggtgtcgccgtggaaccactggcagatgccggcacccatgatgatcattgagcggcccttggactgctcggcgttccgggcaaactcgcgggccacacggatgcaggcctgggcgggaacggacgtgatctcctcctgccaggccggcgtgtagggggtggcggcgtcgtcgtaccccgcggcccagtcccccggcagcccttcgcggcccacaccgtactgggccagcatgaggtcgaacaccgtagtgaccagctggccctccacctccatcacgggcaccccgcgccggagcacgctgccggtgccgtccgcctgctcgaagcacggaagcaggatctcggcgctctcacccgagacgtcccgcagcgaaagggccggttcaatcccctccaggtccaggttccacttgccctcgccgctgccggagtagcggaagcccatggagccgttcggtacggcggggcggcccgcctttttgtcgaacaggacggtgcggaacgccgcatcctcagccccggactccgccgggaggtccctggcggtgaggaatttcgacggcgtgagggcgccgtcgtcgcgcttctccagcctgaccaggaacggcaggtccgtgtactgcttaacgtagtccgtgaagaaggggacctgccggtccacgaagaattccttgagcgtcacgtggcccatggccatggccagcgcggcgtcggttccggcctgggcggggagccactcgtccgcgaatttcgtgttgtccgcgtagtcggggctgacggtgaccaccttggtgccgcggtagcgcacctcggccatccagtgggcgtccggggtgcgggtgacgggaacgttggagccccacatcatgaggtagcgagcgtcccaccagtcgccggattcgggcacatccgtctggtctccgaacacctgcgggctggcgacggggaggtccgcgtaccagtcgtagaaggaggtcatcacgccgccgatgagctggatgaagcgggtccccaccgcgtgcgaaaccatggacatcgccgggatgggcgagaaaccggcgcagcggtccgggccgtaggtctttatggtgttcacgtgcgcggcggcggcgatctcgatggcctcctgccaggagacccggaccaggccgcccttgccgcgggcctgctggtagcggcgccgcttctccgggtcggcggcaatctccgcgaaggcgaggaccggatcgcccagccgtgccttggcctcgcggtacatctccaccaggaccccgcgggcgtagggaaagcggacccgggtgggcgagtaggtgtaccaggaaaaggccgccccgcgggggcagccccttggttcgtattcaggactgtccggccctaccgaggggtagtcggtctgctgggattcccaggtgatgatgccgtccttgacgtacaccttccaggagcaggacccggtgcagttcacgccgtgggtggagcggaccaccttgtcgtggctccaccggtcgcggtagaagatgtcgcctttgcggccgccctcccggaagactgccctgccgtcgtcagtctggtcccactttgtgaagaaccggcccaccttcagcattgcatccgatgctgctccgtctacccccgggacaaaacgctcctctgccatgctgccacggtaggcagggcccgggcgggcgagtagggtctttggactgcttgcgctttcgccggggcgggactatgtttcggccttccttggctgccgtaggctgaaatccgcaggcggcggacaggagacgagtggtggccgagacatcattgacccaaacaacggtatcggaactgatggttgagctggccgcgctcgaggatccgcgggcccgcgaggtgaacgagcgtcatggcgacgatcacggcgtgaacctcagcaagctccgcgccattgccaagcggctgaagacccagcaggaccttgcccgggagctctgggccaccggcgacaccgcggccaggctgctggcactcctggtctgccggcccaaggccttcgggcgggacgagctggatgcgatgctgcgcgggtcccgtgcggccaaggtgcaggactggctggtgaactacgtggtgaagaagaacccgcacgccgaggaactgcgcgtcgcatggctggccgacccggatccagtggtggcgggtgccggctgggccctgaccagcgaacgcgtggccaagtctcccgagggcctggaccttccggggctgctggacgtcatcgaggcggagatgaaaaccgctccggaccggctgcagtgggccatgaacacctgccttgcccacattgggatccaccatgccgggtaccgggcccgggcactggagatcggcgagcggctgcaggtgctcaaggactatcccacgcctccgggctgcacctctccattcgccccgatctggatcaacgagatggtccgcaggcaggacagcaagtaggaacggcgaagcccccgcgcgagtctggctccagcgcgggggctccttggtgcttccgtgttggggaataacgtggaaacagatagcaacttacccgctggtaacaggcccgaaagtctatttcgcagggttgcggcaaatcttgattgaacattgagccgtgccgccacaagcagtgccctcccgccgtgccttcacacgcagcagtgcccccgccggaggacggcgggggcactgctgcttgcgggggattcggattgtcctagccgatgaggagcgtgatgagccggatggatgaggccacgatggcgatcaggccgatggcaccgaagaggttctgccaccagcggttgcggagctcccccatgagcgatgccttgttggccatgacgaggatcaggacgccaagcagcggagcgatgagcacggtgagggactgggcgatgacgatcagtcccaccggggacgactggaacgagagggtgatgatcagcccgaaggcgaggatcatgcccgtgacgatgcgtgctgccggtgatccggcgtgggtgccgcggcccatggcatcggagagcatggtgcctccggccgtggcgttggcaatcattgaggagaaggcggcaccggagaggcccagggcaaacagcatggagccaacgggaccggccaggggcgcgaaaacggaggccagggcgttgatggttccggcctcggcgccggtcttgcccagtacggacgcggccaccaggatgaccagcgttgtcatgatgccgggggcgatgatcccggggatggtgtcggcgagggtgatgtcccggtagtcggcacgggtgcggcggtgttccttgatgccgtacgaggtgtagaacgcagcgttgatggagaagttggtgcccaccagggcaacgatgaggatttcgcttccgggcggaagcgacgggaccatgccctccatggaccggtaccagtccggctgggccaagatggtgctggcgatgaaggcgatccccatgaggacaacgataaccagcagggccttttccaccaggccgtaaacgttgcggaaagccaggacaaatccgacggcggccgtgcagaccaccgtccagaccaccggggagccgccgaacaccagggacaggccgagtccggagccaacagcgttgcccaccgagaacatgagcgtgatgccgaagacgccgaagcctgcaaggatgcccaccggcttgccgagatgttccttgatggaggtaatcagggacgtcggagtgacgattccgagccggacgctcatgtccgtgaagaagatcatcaggatggtggagaccgcgatgacccagaccaggctgtagtcgaaacggctgcccgcctggacggcggtggtgaggttgccggggccgaactgccaggcgcccaccacgaaggcaggccccatcagggccaggtagccaaggaaggtacggcgctttccggttccggcgggcgcggggtctacgtgcggggcggccatctgctgctccatctgtccgggatggatgatggtcctattctgctcgcgcatctgcgagtcctccttctacagctgcaatgctgtgggtcgtcgttgaccgggtggagagtaaaagcggggaccgggtggcgggccgtgggcccgccaccccgtagggatccggaaaaaggatcagacagtggccgtgacgctgccgaggtttgcggacttcagtgccagggcgatttccgcgccggcgccctcggcaagcggaagcagcgggggccggactgttgcgtgctccaggatgccacgggcaacgaggccttccttcagcgccaccgtgccttccatgtgcgagccgcggtggtacacgttcttggtgacgggcagcaggcggtcgtggatggcacgggctgcggggtaatccttggccttgccggccgcgatcagttccaccagcggctcgggtgcgagtccgccgtagccaaccagggcaccgtccacgtcgaacatggtgtgcagaaggtactcgtcatggcaggtgaggatctgcaggtccgggtaggttgcgcggagcacgggaatctcggtgtcccaacgcttcatgttgcggacgccgttcttggtggcgaacacgccttcctggccggcgatttcgagctgggtttcaaggtcgtaggtggccttggtggcgtccgggtactggaagaggatcagcggcaggccggaggtctcgtagatttccttgtaccgggtctggggcgcgcccttctggtacccgaaccggagccagccgtgcgaggggtagaccaggccggcggaagcgccggcctcaacggcccgctttgcctcaagggcggcaacggtgtttccttcgccggtgatgccggcgatgatcgggatctcgccgttcacggcgttcttgaactcacggatcaccagggcctgctcgtcctgggtgaggaaggtaccctcaccggcatggccaaggactaccaggcccttgacgccctcgacgcttgccagccagcctcccagccggtggatggcgtcgacgtcgacgctgccgtcgcggttgaacggggtgacgggggcggggaccagcccgcggagatcgatggtcatttcactacctctgtcttctttgatggtcggcagtcccgcggtgttcgctcaatatgagaacgtttgcgggaacgttttcattgtgacgcgtgtcgcaggtcactgtcaagagaacgtttgcagaaagtcggaatagagtgtctgtacacgcttgctgcagaacaggagaaccgtcatggaacccgtggcatccggctcgatcgtcaccctcaaggatgttgctgcagccagcggcgtcagcatttccacggccagccgcgcgctggacgagcggacagcgtcccggtcagccgcggcggcgcatgtcaggaaagtcgccgaggagctcggctaccgccggaactccttcgcatccggcctccgccggggcgaaaccaggacgctgggcgtccttgtcccccgcctgagcgacaccgtcatggcgctcatgtttgaagaactcgagcgtgcggcgtcctcccgcggctacttcgcgatggtggccaccagcggggacgaccccaacgacgaacgccgtgcggcagagacgctgctggaccggaacgtggacggactgatcctggcaacagcacggctcgacgacgaacttccgcgccggctgcgggagcggaaggtcgcgcacgcccttgtgctccgcacggatggcgtcagcccctcagccctcggggatgacgaagtggggggctacctcgcggtccggcacctcatagaccttggacacagcgacatcgcggtggtcaccgggccgacattcacgtcaacaggaatcgcccgcctggccggcgcacgccgggccctggccgaagcgcaccttgacgcccgcgaggagtggatcatcaccgggggctacggcatcgaaaacgggttcagtgcgggcgaggagcttttggggcgggagagccgccccacggccatcttcgcggcaaatgacaacattgccatggggatcatggccgcggcccaccggcacgagctgaagatcggggcggatctggcgctggtggggtacaacgacacacccctggcggcccggctgcccactcccctgacgtccgtccacgtgcctttggaccagatcgcgaggacggcgatcgacctcatcgttgagccgggtgcggaaccgcaggtccggaagtcaatgccttcgctcatcccccgtgaatcaagcggcgcaccgcttgtccatggcagcggtaaatgagagctgcgggcgtcaggccctaatcggtctccggcgcttccgtggcgtccggatcctcttcgggttcaaaggtgttgggctcggcatccgcaccgatccctacgccatccttctggccgggaacaccgccctcgccctttccctgcgcagtggccgcatcctcctgcggatcgtcctcaggcagtgaatctggtgagttgacagtcatcgctcctccttcattggccggtccttcacgctaacagcccccggcagggaaggcacggatacagccaaagaatttacggccgacggcggacgggcgccgccgcacggaggatgacttccagcccggcagggctgccgggccagtgccgctcaagcgccccgggacccgcccgtatgaggacagagcgcagtaccagcgccacgatgacggcgtcatccgcgtagccgatcactggaataaaatccggcaccaggtcgaggggcaggagcaggtaaccgagcagcaggaccagcctcacccgcacaccggcggggagcgtccggtctgcggcaagcctccggaccagccggagcaggtccgggagcaggcgcagcgcgtccttcatggtgacggcttcggggtgccgccgggcgtagatccacaggagcacgaggagcgcggcgtaggccagcagcaggccggccgcaattccggcgacggtttcccaggtcattctccgcctcttccgcagggccggcggtggatgccggctcctgactgagggtacgccaagggcagtgttcctacggcgtcatccggtagcccacgccgcggacggtctccacccagcatggattctgcgaactgtcacccaggcgcttgcgcaggttgcccacgtggacctcgacggcgcgttcctcgcccgcggtgacaaaggatcctgtgttgtacggctcgttgcgtagccgccgcaccagatccgccttggtctggacggtccgtccgttttccatgagcaccaggaggatgtcgaactgggtgcgggtcaggtctacaggctccccgttgatggctgcctggcgggaggcctcgtggagggacaggcccctgtgtgcgaaatcgcagcagcctggctctgcaggcgaacccggctcaccctccgggctttcgcgtggctgctggcctgcaaggttaccctgccgggcttgcctcggcgggtgctgttcgcctctccgaggcggaagcgcccgttctgccggagctgcctgcagggtccgcggccgccggagcatggccgcaatccgcgcccgcagctcgcgcgggcggaaaggtttggtgaggtagtcatccgcaccggcctcaaaccccatcagggtgtcggcttcgtccacccttccgctgacgatgatgaggtaggcgtcgctgaaggtccggatacgccgggacgcctcgatgccatcaaagtccggaaggccaacgtccatggtgacgatgtccgggttatgctcacggacggcatccacgcccgcaacgccggaggctgttgagtggacggcgaaccccgactgctgcagcacttccgtcagggttgtcctgatgtcgtcgtcgtcctctaccaccacggcaacaccgcgctccaccattcactcccccaagcctctcttcacttttgcgcccaggttttcctcaagcacattcaaggaatattcggagaaacgggcaatatggattgcttttgttattccgcaccgtggggcgtctaaaagcctaacccaagggattgaaaggttacttatctccttcgtctaaattgagcagttcttgagctttggcaaatattgagtatttcctgagatttgcctcacgaaaaattaagttcgttgagctattgccttgggcagagttcctggctgaagatcaagctgtgtgctccacaggggccgcaattgctcgctgggagcaaccgaaaaggggcgtctcatggctggttttcgcttttttgtctcacatcccaagcgccggacgaaaccgctggcagtgctggcagcggccgccgtcgcaatacttgcctgcgtgccgtccgcccaggcagcggacaccacgccgctggaccccaacccagggcccgcaggcaacttcgcctggaagggattcaactgggagaaacgcttctggggcggagcgccacagtacaacaagtccttcgcggccgcgaacgtcagcaatccggatgccaacggccacatcaccatgaacctgaccaaccccaccggcgaagcccccgtgggagcggaattccagtccacacggaaagggttcggttacgggacctacagcaccaccgtggaaaagaacctggaaaccctgcagaaagaagtggtgtggggctgcctgttcacgtacgaccccctggccgaaccgggatacaacgaaatcgatctctgcgaggcctccgcgtggggcggcggcgccgcatacggggaatcctggccggtgacccaaggccacggctattggtttgatgccaccaaacctcccggggaaggaaacaacaccacggtcttcaacgtcacgccggacccggtcaccacccaccggatggtgtgggagccggggaagatcaccttcgaatccttcgccggcgaagggtttgcgggcagcctgctgaagcgcacggtcctggaaggggccaccgtcccggtaccggcccaggaacaggtccacttcaacctgtgggtcaccggtggcggcggcggggatcctgcccatgtgaaaccggaaagcgtggtgatcagggatttctccttcgtcgcagcttccgtcccagcaccggcagaacctgcctccgccatcaagctggctgccgccaccaccaaggcgaagtccgtcagcactacaaccctgacgtggacaggggccacgggcaccaacgtgaccctgtggatcaacggggcgcagaagtccgtggccaatacgggctcctacgtcaataaaatcaagggtggaaaaaccacttcctacaaagtctgcgatgccgcggggtgttccaacgtggtcagcgtggtgacctgacccgcgtgtagggcctgaataagtgtcatccggtgctggtggccggcatgggaaacgcagggcgcccgttctggacgccctgcgtttcccatgggcggagccccggggagagcgtggagcttaggccttggtgccgcggacggggatgatcctcttgatggcaaggcccagagccaggagcgcaaaggctgcgagggcgaaccagaacacgtccccggcgccggtcatggcgagggttccggaaccggctccggctgctgcgggaactgctggattgttatacatggttcttaccaggctttctttctgttaaaggctgcgtctgtgtacgccttcgcgtgaaccaactgcaggaaaaggtcgatcaccagctcgtacatggtggcggccgcgagcatgtatctccatccccggagccgcaccgtcaccactcgttcgatcacgaagacaccggtcacggcaagccagaacggctggatgtgcagccctgcccccgtgcccagtgcaaccgccaccgtgctgaggtagccaagcgtcaccaggacacctgccaccgaaagaacctgcctcccccaatagggcctggtgacccgcgtccagccgtactggacgcagttctccaccgcgccgcgcttccaccggaggcgctgcgcccagagttcccgccaggagggcatgacctcggtgaccagggtgcaatcggcgggtgacttgatccggtacttcagcgtcagcagggcaaaggacagctcgttatcttccgtcaggaccgaggtgtcgtagacgccgcccctgccgttgccgggaggcagcgtgccatccagcctggccgcggacacgtcgcggagcgtccggacccggaacagcgcagcggtgccggtgaccaccaggcatttaccgtgcagccgccgcacgtccctggcgtaccgtgcgtattcattcctctgcaggtggccaacgaatccgccgccctcgccgccccggaacactccgcccacggcacccagccgcgaatcagccttgaggtgccccaccgagcgttcaatgaagtcccgggagagctgcgaatcggcatcctgcaccaggaccatatcctcgggctcagcctccggcagcaggccagcgagcacgaaattgagggcgccggccttcttgtcagtgttgcccactgttgacaccacctcggcacccgccgccagggaaatcgcttccgttttgtccgtgcaattgtctgcgaccacaattatccggtccgggataattgtctggttttgcagtgacaagagggtttcgccgattcccgcagcctcgttgtgggccgggatgataaccgtgatcacagggctgcccctgccataagctcgggcctgaatattgcccgtaattgcgacgccgcgcacatttttccccgctgaaaccatttgaagttctattggctttgagtgtttcaacgcgaactcaaatcgtttgcacagaagcagcaacagaactacaagcttcaatcaagatgaccgcacgcacctcaagctcaggaaacggccgcgctgagctcaagggcaggcgccgtccctaccgattccaccctgcgccccgcctgcgccccgcctgcgccccgcctgcggtcgaacaagaagaagcagaagcgcacaaaaagcgcacaaaacctcttgactcatcacagtgatcgctgttacaaatgctgtaaagcgctttctgaaacgatacaaactcttgtgccatcaaaggagacgactgtgaccgccgctgcccacccgtccaaccgacctgcccctgcgacccgctgtggcggaccggcaaggaaatccttggccgccggcctcgctgcagctgccctgctgtccggggcaggcgtggccattaccgcgccggccgccaacgcggagccgaacaactaccgctttgacttcggcaacgggcccgtggaacacgggtacaccggagtcggcgccactgacgcctacagccccgaaacccgctacggcttcaacaccccggagcatatggccaacgttcccgccaagggcaccggagccgggagcgatgccgtgcgcttcctccagttcgggaccaagagcgcgaacacgttcaacgtggacctcaaggaaggcctttataaggtcaccgtcaccctgggcgacacttcccgggccagcatcgcggctgaaggcgtcttccaggaaatgaacctgaccggaaacggggccactgcctcctttgaagttcctgtgaccgatggccagctgaacctcctggtcacggagggcaaagttggcacggccttcacactgagctcgctggagatcgacaaggtctcacgccatccggagatggatgccaccatatgggtgggcggcgactccacagtggccagctactaccccctggagaacagtgtccagggcggctggggccagatgctgccgcagtacgttgacccggcggcgttcgatgtccggaacatggccaccggcgggcagattgcccgcggcttccgcaatgacggccagctcgaagccatcctccagtacatcaagccgggtgacctgttcccgctggagatgggcatcaacgacactgcagccaagaacgccaccaccgaggcggagttcaaggagatcatgcgtgacatggtccgccaggtggctgccaccggtgcgacgccggtgctggtcactccgcagggccgcgccacggacttcgtggatggagtgcacacctcggtcaaccgctggtaccgcaactcaaccgttgcccttgcacaggaggaaggcgtgcacctggttgacctgaacgtcctggcatccgcctatttcacggagattggcccggaagccaccctggccctgttcatgaccggcgacaccctgcaccccaaccgcgccggtgcctccgaactggcgcggctggtggccggagaccttgcccgccagggtctctaggccaggaactctagttcagggtctctagatccagtcagcggagaagtcctgcggcggccaccaccgggtgcgcgcctggacgtagaacctgcggccggtaacctctgtgggattgatccggatcaggtgctccttgaggccggactcccacggttcacggtccggatcagacagctccaggggcacgttgccgtcggccacaggctccggtatccccttgaccaccacgctccacacttcggtgctgtaagcgttcaacccgtctgtctccagggccacaacggttccggcgagcagcgagtacagcttggtgccgggggcagtcctgaagtacagggccccttccgccgggacaaagttcacggggaagatttccggtgttgttccgttgatgactgccagcctgccgatgtaggaggagcgcaggtatttccagcactccgcttctggaaggacttcagttttgggtcccgacggtgagttctccatggcccgaagtctaggcctccgggagccggggcgagtagggccttccttcccatgagctaaagtccgctcagctcgcttgccccggcggacggataatcctgcgctgggtggcggcggcgatggctgccgtcctgttgtccactccgagcttcccgtaaatgtggaccaggtgcgttttgaccgtggcctccgagatgaacacctgttttgcgatggcgcggttggacagcccggtggccagcagttccagcagctggacctcccgcggtgtgagcgaggtgccagggttggtgatgcggttcatgagcagggcggcggccttcggtgccaggaccgtctcccccgcagccgcggcgaacacggcctgacgaatctgttccggaggcgcgtccttgagcatgtagccgctggcgcctgcctctacggcggcgaggatatcggcatcggtgtcgtaggtggtcaggataaggacgggcggcggcgcagccagcttccggatcgcggcggtggccgccaccccgtccatgcccgcacccatttgcaggtccatcaacaccacgtccaccccttcgcccaggaccgccagccgcgagagttccctcagggcggctttgccgtccgcagcatcagcggcgatggagatgccctcgaactcggtgagcatggccctcagcccggcccggaccaccggatgatcgtccaccagcaggacgcgcacgtcagtcacgggcgcctccagcggaatcatcgagcggcagccggatggccaccacggtcccttcgcccggggcggtctccagctccagggaaccgctgagggcctctaccctttcccgcagcgaacggaggccgaatccgctgccgtccgtgccgccgtcgtgcccggtcccggaggcgcgcgtcccggcggcgggcgtcccggcggcgggcggcgcgtcaaagcccacgccgtcgtcgtaaatgtccatggtgacttccgtgcccaggaaggtgagcgtgaccacggcgttgccggcatgggcgtgatcgcggacgttggcaaggctcgcctgggccgcgcggagcagcgtcacctggtgcggttgcggcagctcggcaggttcaccatccacctccagccggcagcgcagcgccgctcccgcagccgcggcgctcgattcggtccctccgcagagccggcggagggcctccaccagcgtgctgtcgtgcagctgcggagaggacaggccgcggacaaagttccgcgcttcggccaggttgtccgccgccgtctgttgcatcagcgccacccgcgacgctgcggtggccggatccccgtgggccagcgactgctcggccgcccgtccaagcagcacgatgctggacaggccctgggccagggtgtcgtgaatttcccgggccagccgctcccgctcggccagcactccggccccatgctgggacgccgccagttcctggcgggtgcggcgcagttcatccgcggcctgccgctggttctccgcctcccggtacagcgcaacgtaggcaaggccggtgatgacggcgaaggcggcgccaaacagcgggccgacgacggcggccgcgtgcgggaccggttcaccgctggcagaccattgggaggcgatgaccgcggtggtcatgagtgcgatggccagcagcgcgggacgcctgggcagcaggtgcaggtgcaggaaaaacagggggaacgccagccaggcaaagtcggcactgcccaccagcaggaggccccagagcgccgtcacggccgccagccatgggagtccgtagcggcgggggttaaaccggatccggcccgcggcatggcggtgttccaggacggtcccggtgaggtacaccgccgccaggacgagcgccaggcccgcccagaggaacgggaaggagccccgggaacctggggccagcagccggaccacgcccaccaccagcagggctgcgaacccggtgtggagcgtcaccctcagcacccgcaggatcgcttccgaggacgccgtctccacagcactcagggggtccttgggcgcgtgggcgccgggtccgccggaagcgtgcagggcaggggtggcggacattccaccagcttatgcgggcccggccagcggcgggtcaatcaaaaggttgaccccgggctccacctttcatccctggcctatcaactgcccgcccgatggaccgcggacgggcggacgggacagtggatggagaccttatccactgggaccaaccgagagaagaacaacgtgtttctggcaatccgcgacatccgtttcgccaagggccggttcgccatgatgggcggagtggtagccctgattaccctgctcctcgttatgctgtccggcctgaccgccgggctggccgaacagtcaacctccgcgatcggaaagctgggggctgctgccgctgcgccggtggacaccgtggtgttcggtgcccccggctccggcacgcccaaggcctcctatacggaaagctccgtgacggcagcccaggcggagagctggcggaaccggcccggtgtccgcgctgccgagccggtggggatcacccagacccgtgcccagggcgcgggctccggttcgggcaccgccaatgtggccgtgttcggggtggctcccggcagcgggctggcgcctgtggacgtttctgccggcaccgcggtggtgggcgcctccgtggccgaagccctgtccctggagcagggggacgcggtggccatcagcggggtggaactcgccgtagccgcggttgttgaggaccagtggtacgcccacaccagcgttgtgtggacggcgcttcctgcctggtccaggctggcccacgtgtccgacggcggccagctggctaccgtagttgccgtcacctaccaggacggcgcggcagttgataaggccgccgcggatgccgcagccaatacggtgagtgcttcacgtacagagtccttccaggcgctgggctcgttcaagagcgagaacggctcgctgacgctgatgcaggccttcctctacggcatctcatccctggtgattgtggcgttcctgaccgtgtggaccatccagcggacccgcgacatcgccgtcctcaaggccctgggagcgcccgggtcctacatcctgcgggacgccatcacgcaggcagccattgtcctggtagccggcgccggcctgggcgggatcatcggcgtcgcggccgggctgcttgccgcccaggcagcccccttcgtcctcagccctgccaccacgctgcttcccgtcgtcgggattattgccctggggctggccggggcagcgctggctgtccgccgcgccaccaaaatcgatgccctgctggccctcggcgggaactgacaccccgccccccgtctccaatcctgtgaaaggaacacgatgtctgcctactccacccctgctcccctggaactgctcaatgtcaccctcgaatacccggatggaggcggcaccaccactgctttggaccgcgtcagcctggcagtcccggccgggcaggtggtgtcactcgtcggaccgtccggctcgggaaagtcgagccttcttgccgcggcggccaccctggtccgccccaccagcgggcaggtcatcatcgatggcactgacacgaccggccttcgggacaaggcgctcacggcactgcggcgcagcaaggtgggcatcatcttccagcagcccaacctgctcccgtccctcacggctgccgaacagctcatcatcggcgaccacctccgcggaaagcccgtgaaggccgcccggaagaaggccgccggactccttgacgtcgtcggcctgtccgcgagcgccgggaagctcccccaccagctctccggcgggcagcggcagcgggtcaacatcgccagggccctgatggggaatccgaagcttttgctcgtggatgagccgacggcggcactggaccacgagcgcagcgcctcgattatccggctgctgtgccaggtgaccgccgagttcaacgtgggcacggtgctggtcacgcatgacacggagtttgttccgttgacagatgcggtggccaccatgcgggacggtgcgctcactgccccggtgctgaccggcgcctgaggcatgtcccgccgtcgccctatctcccgaggtgatggatggtgaaggcggccagaaacccgacggaggccgtcaggcccgtgaggttgtggtgctcctcgaaggcctccggaatcatggtgtccgccagcatggccaggattcctccagcggcgatggcggtaataaaggccaccacactgcccggagcgttctccagcgccacgtacccgatcagcgaggccaccccgcagagcagcgcgatgccgccccacaaaccgaaaacatagcgggcgctcctgccggctttcttcatgccggcgcttcccgagaggccctcggggacgttggagatgaagacggcggccatcattgccgggctgacggcgccacctgccagcagtcctatgccaaggacaacggactccggcaccccgtccagcagcgcacccacggcaatggcactgccgctgcccgggctgtcggattcggaaggctgctggttgccggaacgtttgcggtgcttggcgcccgcccgggacagcatcgtgttcgcccccacatacaccacagcgcctgccaggaacccggccactgtaggccacagcccgccgccctccacggcctcgttcaccagctcgaacgccagggcggagatcagcacacccgcgccgaaggacatgatcgaggaaaccagcttggccggcagattccagcgccatgacaatgccgcgccgaggaccaaggcagctcctgccacggttccccacactaaagcctgcaaccacaacggcatgtgcaccgcttcccggctccccagcggaagccaaccgacctgaacccgggcccctgcctgcccggagcaggtgagcgctaaacagccagagtagtagaacccctcccggcgccaggaattgatctgatcttgcggcaaaccttgccgtgccctgaagttgcgggtccacgctggagccatggaccgaccagcttgtggggagcaggaaacaatgggaaacagaacagctttggacggggaagtcaccgccgtggacggcgtgctcacggaccagcatccgctcgacttctacgccctggggctggccggctgcatcgaccggctcacggcccccctccgccaccggggaaccactgtccgctgggacactccgcactggggcatcgagattaataaggactgcgcgtccctgctctaccaatcggcacgcgaggccctgagcaacgtctacaaacactccggggcatcgcacctgaccgtccagctcgccgccgtggaccatggcatccgcctggtagtggccgacgacggcacgggctttgacagtgaagccgccacctgcgggcgtcaccacggctacggcctccggctcatgtcagtggccgtccatgaggccggcggcaccgtggacatccgctcaacccccgggcagggcaccagcgtgacggtaaccctgccactggactaaggctcggatgcccgccgttgctgggacggcgggcatccggaaaaccctaacgggtcagcttggccgtgtcgggctcaaggtcgccgatgtggcccggcgcgttggccgccaggacccgctggacgaaggcgcagtactcctccatgtagtggcgcaggaacttggcggtgccctcattcttgacctctccgtcgtcgccgaatacggcggcatcgaagtggatgtaagcctcgggtgcgttgagctgcggcgcgtccaggaagctcaggacgcttcgcatggacgactgcatcaccgcggtaccgatacttcccacggaagcaccgatgattccggtgggtttgcgggcaaaggagttgcttccccagggccgggagccccagtcaatggcgttcttgagtgccccgggaatggagcggttgtattccggggacacgaacaggagtccgtctgccgcctcgatggcttccttgagggcgcggccttccggcgggaagtcggcgtcgtagtcgtagctgtagagggggaggtccttgatggggatctctgtgaactcgaggtcctcgggagcgagtttgatcaatgccttggccaggaccctgttgatggagccggttgccaggctccccacgaagtagccgattttgtacggtgccatgagtgttccttccaatagccggtctgcgccggcaggccatgtttccggaattagtgccgccgcagcccaagcggcgggtggtgcccactgcacccatcagtccagcacagaagcccctgcacagccagagggtttcggggtggcgcagggctgatgtagacccttccgaatcccgaccaccccttgcggtcctgcccggactcacctattttgaaacgaatcagaaaccgctttcctgcgcgcgggtccttcgcctgctgacgaggggccgcgccgagcggacgcgaagacaacagaattggatcacatgacggacagcacccccatcaggtggatcgacggccaggcgccttcggaaatcagccgcgggaccacgtggggcatgcccttcgcccgcggctcggtgccctcagcggaggccctctccgtcacggatgccggcggacgcgccgtcgcttcccaagcctggcccctggccacctggccggacggctccctcaaatgggcgggcatcgcactccccgcaacgagctcgccgtcggacttttaccacgtggcgtccgacggcggcgcgggcgcccgcggagccagccagacgccgtcgggcggtaccagcgtcaccaccaccgaaaccaacgatgcccttacggtggacaccggaaccctgcagatggtgatcgaccgcggcggctccaccctcttcagcagcctcacccgcggcggcgtcgaggtggcgcgggacgcccgcctggtcagcctcctgcaggacggccttgctgatgaccagggaggcgacggcgccggaaccttcagccgggatgccttcaccggcgaggtcgccgccgtcgtgcttgaacacagcggtcccgtgcgcgccgtggtgcggctggaaggccagcaccgcccggacgcgcgggacagcggcactggcagcgacagcggcaaggaaagctggctgcctttcgtggtcaggttctacttccacgccaacgcccgcagcgtccgtatggtgcactccttcatctgggacggcgacgcggaccgggacttcctcgccgggctcggcgtgcgcttcacggtcccgctgcaggaagagctgcacaacaggcacgtccggatggcaggggccgacggcggcttcctcaccgaggcggtccgcgggttgaccggcctgcgccgggacccgggcgaggacgtccgccgcgcccaggtggaaggccgcaccactccacccccagccggatggaacccggaagtgtccgaacggctgcacctgattccggcctggaacgactacacgctcagccagctcagcgcagacggcttcgagctgcgcaagcggactgcgcccggccatgcctgggtggggatttccggcggcaccaggtcggccggcttctgctcgctgactgatacccgtggcggcttcggcgtgggggtcaaggacttctggcagtcccaccccggccagctggacatccgcaacgccgctgcagaccacgccaccctgacggcgtggctttactcccccgaagcccagcccatggacctgcggttctaccacgacggcctgggccaggacacgttcgaggaacagcttgagggcctcgagatcacctacgaggactacgagccaggtttcggaaacgcgcacggcattgcccgcacacatgagttaactctgttcgcctatgacggaacaccggcaaccgagagcctcgcggccgacgccgccgcctcctcaacccctgccctgctgcaggccactcccgaatacctgcactccgtgggcgtattcggcgactgggaccccgtggaccgcagcacccccgcccgtgcggagcttgaggaccacctggacttcctcttcgatttctatgccggccaggtggagcagcggcgctggtacgggttctggaactacggcgacgtgatgcacacctacgaccacgaccggcacgtgtggcggtacgacgtgggcggttatgcgtgggacaactccgagctctcccccgacctctggctctggtactcctacctgcgctccgggcgggctgacatcttccggttcgcggaggccatgacccggcacaccggcgaggtggacgtctaccatgtgggcccgtggcgcggcctcggttcgcggcacaacgtccagcactggggatgcagcgccaagcagctccgcatcagcacgcccgcctaccgccgcttctactactacctgacggcggatgaacggaccggggacctgctgaccgagctcgtggacagcgaccagaacttcctgggactggaccccgtgcgcaaggtccgccccgacgccgacacctaccggcccaaccggggcgccctgggtgtgggcctgggaacggactggggatcgctcgccgccacctggctcaccgattgggaacgcacaggcaatctccgctcacgcgaccggctcctgggcaccatggcggacatcggcgccctcaagtacggcttcctcaccggcgaggcgctctacgacctggacaagggacgcttcgacaccggccgggaactgatccaggtttcgcacctgagcgccgtgttcggtttggtggagatctgcagcgaactggtggacctggtcccggacccggacttcgagcgggcctggctgcagtactgccggctcttcctggccaccaaggaggagcaggtggaggccgtgggacagccgctggagggcatctacctcacccaggcgcacagccggctcaccgcctacgcggctgcccggctgaacgatccggatctggccgcccgcgcctggacgagcttcgcggagggaggcgagcacctcaaccacgagtcggccttctcgctgcggaagatcgagccgccgcacgtgctgctgccggtggatgaggcacccaccgtgtccaccaacgacgcctcccagttcgggctcgcagtgatccagaacctggcgctgatcggcaaccacctgcggtagctctgcacagttgtgacggcggtacccggccttgattcagccaggtgccgccgtcgtccattccccgcgcccggcggacgtttgaacccacgctctggaaaccggcgtgcccagcaggtacattggtaagcatgctgatgatttaccgaatcgtcagcttccggtaacaaagcgaaggagacgttatgagcacgaaggtggaaaaacgcattctggtgaacgtaccggtaagcacggcttacaaccagtggacgcagttcgaggagttcccgcacttcatgggcggagtcaagagcgtgacccagctcagcgacgacaggcttgagtgggtggccgagatcggcggcatccgccggcagtgggaagcgaagatccttgagcaggtcccggaccggaaggtcgcttgggcggctactgagggcgcaacgaatgccggcgccattgagtttgaggacgtgggcggcgggcagacttccctccggctgacgctggagtacgagcccgaaggaatcatcgaaaaggtgggcgacaagctcaacgtggttgaccgccaggccgaggctgacctgcagcggttcaaggaattcatcgaggatgagggttacgccagcggcgcctggcgcggccgcgtgagtacgggtgcgccggcgggcacgccgggcgtggaggatgctgccggatcccggggcgactccggcaaggcaggcgtctccggcaaggttgccgctggcctgggcgttgccgcagtagccggcgcagcagccgccatggcagcaggcggcaacaaggagacaactgccgttgccgacgaaactataactccagcgacccccggggagccggtcaccgtcaccccgattcccaccgatacgaccaccacaggtaccgctacgggtacgacggcggcagcgggctccacggggtcggtcgccgacctgggcgatgacaggatcgggcaccagttcgaccagaccaacggcctggtggacaccacaggcgagtcggacgagacggcagaaggtgagaacctgagcgccgccgagcgcgaaggcgacgaccgccgtcgcgacggcggcctgcctcccatcggcggaaacctcggcacgcactaaccgggtttagccccaggcacaacaaaagcgccgtccgcctcgttgcagaggcggacggcgcttttgcctgtgcttgtgttacttgccggtgcccgtgtagaccaccgacggcgcggccggggtttccatgccttcgccgatgaagaagctcgggtgcggcggctggttgtaggccacattctcacgggccaccgcggtgcggtagacggtgtcgtgcatcagggtgcggagacggacctcggtgggcgaggtgctggtgtagatccgcagctcggtgctgtccgacgacgggaaggccagttcctcgcgccagtcacccagcaggtccgcctgcagggacgggttgcccttggtgtggttgttggtgcgtgcaccagtgacagtcaggagcctgtcgctcgattccgtttcccagttccactttgaaatggtgggtacgcccacaccggcagccgcatcaaagtcgtggtcaacgatctcgcggagcaggtcgccgtcccaccaggccaggaagttggcggccgggatcttctcggcaatcagctcgcccttggcggacatcagctggccccgcggggagttccaggaggcgtcgccgcctaccgcccagccctcagcgccggcgtagcggggatcgatgtcgccggcggcaccgcggccggtgtcccggatggcggggatgctccagagcacctcaccggttgcggcgtcgcggaacgtggcgccgcggttgccgctctggctcatgctctcatggacggcgaagacctccagcccggggcgggaaggatcaaaatcgctggtgtgcatcgcatcgccgtggcccagcttggtgttgtagaggaccgagccgtcgtcgtcgatggtcatggaaccgaagacgaactcgtccttgccgtcctggtccacgtcagccacagacaggttgtggttgccctggcccttgtattcggcgccggcgatgtccgaatcgaaggtccagcgcttcaccagcttgccgtccaccaggtcataggtgaccaggacggtgcgggtgtagtaaccgcggctgaacatcagggaaggcttttcgccgtcgaggtaggcgacgccggccaggaaacggtccacgcggttgccgtagccgtcgccccaggcggagacgttgccgcggggcgggtcgtaggccaccgtgtccatgatggtgccggttgccccgttgaacactgtgaggaactccggacctgacaggacataaccggcgctgttccggtagtccgctgcggggtcgccgatcacggttccggacccgtccctggtgccgtccgccgtcttcatggacacttcagccttgccgtcaccgtcgaagtcgtacgccaggagctgggtgtagtgggcgccggcgcggatgttgtggcccaggtcgatgcgccacagcttggtgccgtccatcttgtaggcgtccacgtagacgttccccgtaaacccgggcctggagttgtcctgcgcgttggacgggttccagagctggatgatctcgtagctgccgtccccgtccaggtcagcgacgctggagtcgttggccgtgtagctgtatggctttccgtccttgctgacgccgtcggcgggcttgtccagcttgatggacaggtagttctgggacagcggcgtgaattccgtgctgagcttgtcctgaccgttgccgttgccgacggtcttgatgacgtacgtggaggccgcggttccggccggatcaacgaacgtggtggtgttgcggatgggctcttcggtgagctggacgccgtcgcggatcacgtggaagcccacgctgtcctggtccaggcccagcatgcgccagcccagcgtgacgccctggtccgtgagcacggcgacgggtgcccggtccaggttctccacctggcgcttcagctctgccttgccggactgcccgggtgcggtgctggggttggcctgcgcgagcggtacgccggtgaacgccagcgcagcggcggtgagggaagcggccgccgccaagggggcggctttccaggcgcggccttgccgcaaacctggacggagcatgggggaacatttcgagggataagccaaaagaacatctcctttgatgcggcggcagccgagtctgccgcacacagtttggaacgtttcactgcaacctgaaatccacctattacgaagggagaatgggttcgggatgcgatagaaagcgttttctgcccttaatatctatcagcgctttacaagcttggtcaagggtttgacggggctaaatgagagatattgttccgttgcgttcagttcgcgtcggcgccgttccggggcctgcccgctgccgcctgcaggagcggcaacgtcctggctggcatgacctccaccagggacatggcggtgctggtacgcacgacgtggcaatcgttctggcggccctggcgctggtgtcccctatcatggtgctgctctcggcagccggcgcggtcctcctgaacttcatcctcgccctgaaccaccgcccgggccgctacctcgcgacctgaaggcggcaccccgggcggaaacaaccggcatttactcctagtcccaggccgggaccaggactacttcgtactgggttggcggcggctgctgtccgaactttgcgttcaccgcggctaacgtatccccaaacctggccaccgtcgtcgggatattgaagtgcttgctggtgatgacgtccttaaccctgaaggaagacaggtcatcggacagtttgaggcggctgacctggttggccatgttctggaccgcccatacggtgcggtccttcaccaggatgccatcaatgaacggaaggtccggccccttgatcctcttgctctttcccttatccgtatccacggcataaagggcctggttttgggtgtgggccacaatcaggacgtcgccgtccccggctgctgcgatgccgttgaacccgaactggccgggttgcagtggcttgcccgcctcaccgcccactttcagtgtctccacgtccgccgcttttccgagctcgccccgcccgctcacagggacgaaatagagctcgggcgcggccgaattggtaaaccaggcgccgtcgctgctgagggtgacgtcattaatgaagccggtacccaggtcatattccttgacctgcttgcgggtgtcagtgtcgtagacgaaagccttgcccgttgtaccgccggccacaaacagcaggtcgttgcgggtatccgccttcatgccgacggccatccggccctcgggcacgtcgataaaacgcttggcctttccgtcacggatgtcgccgcggaagatgtcgccggtcaacagttcgccggcgtagaaggttgttcccccgcccgccgcgatgccttcggcggaacttgccccgcggagaacgattacatcgtcagaggaaggagtggatgcgcctgccggcactgccgtgggcagcagcaaggccagaagtgcgataaatccaccaacggcacggcgtcgtactgttttgcgcataatggttcctggattgggctggtgcgcggggcccaatctgcggcagctccgcacgatggtgatgccattttaagctcctccacggatgccccgccagagcctggtgcccccttcacagtggagggggcagcgccggggaccggcgtacagttcaggattctgcttacaatcgaaacctcaatcaactactgagggatccatgaagaaattcgccacagccctgatcgccgccggcctcgttgtctccgcaacggcctgcaccgcctcgaaccagctcaccaccgcggaaacctgcgagcggatccagtccgttgtgtcgaacccggccaacaacgccggcaagaccggcatgaaccgcctggccaaccagatccggcccatccacgccgttgcctcggacgacctcaagggtgcgcttgaagcgatcatcgaatacacggatgagcaggcgaaagagactccggacgaggacaagctcgccgaactgacggaaagctacgaggaagccggcagcacgtacagccagttctgcagctgattcctgctgcagacgggcaatttgccagtgggcccggctacttgagggtggccgggtccgtgttcgccccgcacagtatcaccgccacccgttcgcccacgccctgagtgtaggcgccggaagtgagcgcggcataggccgcggccgcgccgtgttccacgacgatccggtagccgtcccacagcttcgtacgcgcttcggtgattgcggcgtcggacaccaggacgctttcgacgccggcgcggaccgccacggagaagccgatgtcaccgatgctgcgggcgcccagggagtccgcagcaactcccgagacttgcacgtcaaccgcgtttccggccgccagtgcagcgttcaaagtaggggccgattccggctccacggccaccaccttggccctgccctccacggccgcggcgattcccgccatcagcccgcctccaccgaccgctaccaggacggtgtccaccccgcccacctggtcgagaagctccagccccacggttccggcgccggcggcaatttcgggctggtcgtaggcatggcaatagacggcaccggtttcccgggcacgctcgatggccgcctggtatgcgtccgcgtactcggcgccgccctgcaccaccgccgctccgagggctttgagcttgcggaccttcacggcaggggcggcagcggggacaaacaccgttgccggcacgcccacctgtgcagccgcgtaggcattggccaggccggcgttgcctccggaggcaaccaccacgccgacgtccggcttcagctcaccgcgttccttggcggcgaggacccggttgagggcgccacgggccttgaaggttccggtgtgctgcatgaactcgcatttgaaccacaccggaccgggaaaatcctcggggtcagcttccaggacaggcgtcagccgggtaaggccggccgtccgtcgtgctgcctgttccacgtcggcgcgggtaatcattggtgcgtcagacctcgtcgtcccaggttcccggttcctgcagggcatcttcgggcttgtcctccggggtcgggtcactgctgcccgagtaggatgcagggacggtcccggcggcgtgggcctgctgctcctcgcggatgttgccggcaccgggaagctccgggtgctggccgctctgcggggcctgcttggcctccttggccgcgtccgggtcacccggtccccgaaggtctgcggcgttctgcggctcgtcattgctagcagtcatggttctgcctttcgctcgggaactgcggcgtacggccggggtttatccccgcaccgccctccagcctacgggctggcggggcccggcagcaggaaccgccggctctgacctttccgcagccgggttctgtgaaatcaggccggaacctgtgaaatgggcggtgaacctgtgaattgcgactcagccgggacttccacggcacaccctgcgttaaacctcatggcggaaggaggccatttgcttattgtcctgaccggcatcgacggttccgggaagtccacggccgcccaggccttggtgtccgccgtccgtgccgacggtggcacggccctgctgttgaacaaccacgcgggcagacgcagcatgtcggtgctgggcgccaggatgggcatccgactgccgccccgcgttgccgacgccctggagaccaccttccgggtgtggaacgtgctggtccaccacctgcgcgccagccgtacagagggcctggtggtgatggaccggcacctctactgccagctggcactgcgtgccacaaaggggctgccgcggggccgcgtgctttcgtggatgctgagcaaacttcctgcccctgatgccgtggtgcacctggaagttgaccccggcattgcgcatcagcgtatcgccgcacgcggtactgatgcggagacgctgcaggatttggcggctttcgcccacgcctaccgccaactgcccgagtacgggggcttcgtaaaagtggacgcctcggtccccggtccggaactggcgcgccgccttgccgcaacggtccatgaactggggcgtgcccgtgcggagggacggcctccggttgccggataaccgtacccaggctgtaagagacaggaaggcgggcggacccaggtgtccgcccgccttcctactgcagggaggtcctagttagaggcagtcggcgaaggcgaggtcatcccggtttcttcgggctcgctctccgtcacggacggcgaggccgacccgctcggtgacgacgtgcttgtggaaccggacgtgctggtggacgtcgggctggaggttgcgctgccgccgtcggccttttccagcacttcgttgatgaggtcctcaagttccttctggtccggatcgcccaggttggcgccgctcttagtggcaaccaccaacaacgtgccctcggcagcggagacctgcattagcttctgctggttctcgccgctgcgcgagctgagggtggcaaaggtcttctcagcgtccgtgtccgcctggacctcctcgctggtcacctcgtaggtctgccccagcgcctccacggagaaggtggcgcactggtccatcttcccgctgatctcatccaggacctcgacggcgtccggcccctcgctgcccgactgtgcggacagcgtccgcggctggtcgccttcggagagtgcgacggcgatctcgccgctttccacggtatccagcagtcccgcggtggcaatgtccttgcagtcttcgggatccacggttgccgtgctcaggaggaggttggcaatgttgccgccctggtccacctgttccttggagtacagcttaagttcgttgccgtcctcgtccgacatgccggagatcagttcacggagctcatcctcggtataaaccttcgcctcggccgttgcggagggcgtttccgaggcggacgggctcgcagcttcgccgccgccgcccgtgcagcccgcaagggccatcattgctgccgtcatcaatccaagcgcaggtacttttcgcattggtacaaccccttttggagataggaagcatgcttagtgtttatcagcttagggggtttggccgcggcggaacaataacggggccgtaactttccacggaactcctgccagcgcacttcctcgggccagacacctcgttgagctgcccgccctgggcccgggtgccgccacgccgccctcatgctggccctgcgcaagaaagccaccaagcaggctccctttgcctccgacggcgaactggttgcctaagggcggccgccggccgggaaagaccttccgggacccttgctgtggaataatccgaggagtggtccttaccggaccgctccaggatcaggaggggccgcattgtccgtcacaccaaggagcaccgcccaggcggcgggcacggccatcaacaactcccagatccccaagcatgagcagctgcggacaatcatcctcaagctcgccagggaagaactggagccgggcgccaggcttcccagcgagcggaccctcatggattcctacggcgtcagccggatcacggtgcgcgccgcgatcgggcgcctggtcaacgaggggcacctggtccgggttcctgccaagggcaccttcgtggcggattcaccagtgcagtccacgctgcaccttgcctccttcacccaggaaatggaggcgatgggccacgttcccagcacggtggtgctggttgcggaagccgccaccgtccctgaggacaccgccgaagcgctgggccttgccccgggatccgaagcgatccatctcaagcggctccgcctggcggacggacggccggtcagcgtcgatgacgcctggtacaacccggagcacgcccccggcctcctggacatcgacctgacgggctcggtctacaaagcgctggcggcgcaatttggccaccagattgaccgggcccggcaaagcgtccggtccgagggcgcccccgccgacgtgggggcgctcctcggaaccggaacgggggcaccggtgctggctttcgaccgcgtgtcctattcaggccccctggccatcgagcattcgcgctcctggtaccgctcggaccgctactcactcaccatggaagtccggctttaagcggacttgggcgaacgcctagtccagtgaaaacaggctggcgccggcggtcacggcaccggttgccatgagcgttgcggtgtccggcttggtgtcgagcacgacgacgggactcaccatcgagtaacccgcagccagggcggcggtggggtccacatgcatcacgggctcgccggcgccgacggtgtcgccctgggcaatcagcagcttgaagccttcgcccttgagcttgaccgtatcgatgcccacatgggtgagcactccccgcccagaagactccaccaccacaaaggcgtgcggcaggagcttaaccacctttccagcgacgggggacacgacgtcgaacgcatcgcctgccggcggctcaacggccgcgcctgaacccaccatctggcccgcgaagacggggtccgggacgtcggatataggaaccacactgccgctgatgggtgcgtggacaaccagcgcttcgggcatcagagcaggtcctcgatgtcttcggccaggttgtccgcctccggccccacgatcacctggactgctgtgcctgctgcaaggacgccgtgggctccggcggctttcagggctgcttcgttgaccagcgacccatccttgacctcggtgcggagacgcgtgatgcaggcctctacttccacaatgttggcggctccgcccaggccctcaatgatcttttctgctttggacatggctgccctttctgacggtgccccggggagcactgcttcagcaccaggaccggcggcccgggtgcgaccaattatgtgcccgttcatcggaactgtcagcgcctgcgggaagaactgctcccttgacaggcgctcgtgggatgaatcacactgaactggtcataaccagacagtaccggctggacccgtttcttcacaagcccccactcgatccccgcagaggtgtaaccatgtcaacatccgaaaccgccgccctggctccagagaagaagccgaacagggccttcgccaatctccagcggctgggccgctgcctgatgctgcccatagccgtcctcccggcagccggcatcctgctgcgcatcgggcaggccgacctgttgggcgcgatccccggcttcgaaggcggcgccgccgtcatctccgccgcaggcaatgccgtgttcacctggctgccgctcatcttcgctgtcggcatcgccatcggctgggccaagaagtccgacggttccaccgcactggcggcagtggtggggtacatggtgatcgacggcgtcttcaaggccatgtccccgctggtcctggccgggcaggttgaccctgccggcaagcccgcgatgatcaactacggagtcctggccggcattgtggtgggcctgctgtccgccatgctgtggcagcggttctaccgcaccaagttgccggacttcctgggcttcttcagcggccgccgcctggtgcccatcctgacgtccgtcaccagcctggcagccggcgtcgtccttgccctgttctacccgttcttcaacgccggcctctcggcagtaggtgaagccgtagccggcaacgccgtggccggtggcggcgtctatggattcgccaaccgcatgctcatcccggccggcctgcaccacatccttaactccggcgtgtggttcctcatcggcgactacaccgacgcttccgggcagctggtccgcggcgacctcaaccgcttcttcgccggcgaccccagcgcaggcatcttcatgaccggcttcttccccatcatgatgttcggcctgccggcagcagcccttgccatgtggcgccacgccaagccttcgcagaagaagatcgtgggcggcatcatgctctccaccgccctcaccgcgttcttcaccggcatcaccgaaccgctcgagtactcctttatgttcgtcgccttcccgctctacatcgtccacgcagtcctcacgggaacctccatggccctggtcaatgccttggacatccaccatggcttcacgttctccgccgggctgatcgacttcgtcctcaacttcggcaagtcggagaacggctggatgctcatccccatcggactgggctacgcggtgatctactacttcctcttctccatcgtcatcaagcgctggaacctgcggacgccgggccgtgaagacgacgaagtcacggtggagacagacgccgccaagtagcggcgttccccttctccgctcgagccgccgcagcggcatccagcacccagcaccagcaaccgaaagcagcttcaccgcatggagatcatcatccttcccacccctgccgacgtagcccgcacggccgcagacgccatcgaggagcaggtccgccgcggcccgtgcgtcctgggactggccaccgggtccacaccgcttggcacctaccaggagctcatcgaacggcaccggaccggcggcctgagcttcgcccaggcgcacgctttcctcctcgacgagtacgtgggcctgccgagtgcgcacccgcagtcctaccactcggtgatccgggacgagttcacggcgagcgtggatttcggtgcggacgcggtgcatggcctggacggcatggcggaggacccgcaggcggaggcggagcagtacgaggcgcggattgcgggtgccggaggggtggatctacagatcctgggcatcggcacggacgggcatgtgggcttcaacgagcccatgtcctcgctcggctcgcgcaccaggatcaagaccctcacccgccagacgcggcaggacaacgcccgcttcttcgactcccccaacgacgtgccggaccacgtgctgacccagggactgggcaccatccgcgaggcccgccacctgctgctgctcgccatgggcgaggccaaggcggaagccattgcggccgccgtcgagggccctgtcgccgccatctgcccggcgtccgcgctccagctacacccgcacgtctcggtcctggtggatgaggcagcggcctcactgctggcccaccgggactactacacggacacgtttggacggaagccggcatggcaggggctctgagcacgggccagggctcgccggttgctgctgtcagccggccgcagctggagcttgccgtggagaatgccgacggcgtcaggctggctgccgctgtcggcgcggcccgggtggagctctgcgcagccctcgccgaaaccgagggcatcacgcccagcatcgggatgacggaacaggcctgccgcgctgggcttcccgtccacgtcctggtgcggccgcggccgggcagcttcgcctactccagtgacgaactcgacgtcatcgagcgggacgtgactgcatcgctggccgccggcgctgcgggcgtggtggtgggggtgctcgcggccgacggcgggccggacgttcctgccctccgccggatcgttgaagcggcacgccggtccaacccgtctgcggaaatcacgttccaccgggcgttcgatgctgccctggcggccggcaccaaccctgctgacgcgctggcccggctccagcaggcaggcgtggaccgagtcctgaccagcggcggcagtcccgactgcgctgccggcctcagcatgctgggccgcttggttgagctgggacgcacgcacgcgccgtcggtacagatcatggccggcggaggagtgacgctggacctggtaccgtcgctgctcggcatcggcgtccacgccgttcacacctcggcccggcaacgactgaccgggagttcgggtacagaccgggctggccgggcaccggctgccgatcctgccctggcagcccaactggcggccgcactgacaaccggaggcctggaaccatgagtactgatgtgatccttcgtggccgcatcgtcacgggaagcatggacgtccccgatggcgcagtagcgatcgacggcggcgtgatcacctacgctggtccggcgtcggaatttcccggcgaccccggacccacggacccggaacctgcgcgcatcatcctgcccggactggtagacctgcattgccatggcgcgctgggttcggatttctctgaaggatccgccgagggcgcccggtcagcggcacaatatctgcacagccgtggaaccaccacgctgctcgcaagcctcgtcacggggtcaccggaacacctggtccggaacctcaaggcgctgaagacgctggcggatgacgggctgatagctggttcccatcttgaaggtccgttcctcgcatcgggacagtgcggcgcccacgaccccacgctgctgcgtgaacccgacgccgggcttatggccgacctgtttgaggcggccggaccctcgctggtttccatgacgctggcagccgagcttcccggcgccacggccctggtggacatgctcactgcgcgcggggtcattccgtccctgggccacactgccgcggaccacggcaccgctgcttccctgctggaacaggcagccacagggctcgccgggcgtgggaattccaccgggcgggtccgccccactgtcacgcacctgttcaacgcgatgcccagcttgcaccaccgctcccccggcccggtagcggccagcatcagcgcggcccatgccggcaacgccgtggtggagctgattgcagacggcgtccaccttgccccggagacggtcaagatggtgttcgagctcgtgggggcggaaaacatcaccctggttaccgattcgatggccgccacgggcctacaggatggccagtatcgcctggggacgctggctgtcaccgttgaccatggcgtcgcacgtgtggacagcactggggcgatcgccggcggaaccgccaccctgctcgacgtggtgcggtccgcggtggcggcgggcgtgcccctccaggatgcggtccaggcggcgacggccgttcctgcctccgtgctgggactttccacgcaggtaggcgatctccgtgccggcatgcgggctgacctcgtcattgttgaccgggacctggatcttgcaggagtcctgcgcgggggtgagtgggtcacgccgctggggtagtgctcttcgctgcctgaccgttaaatgtcagaccctcccatgaggatggattcatggaaggcaattcggcggtggtggaggcggaggcggcggttgacgcttcggtggctgcttttgcggcggtgctcgcgggcggcggcacggctggtcattctggcgctgggcctgacgccggcgctggcgggtgcgttgtcggcattggtgatgatccggtgcagcgggttgttgatggggcgttggatgttcttgccgggctggcccggtccgaggcgaagctggcggcgttgaaggcgcaggcggttcaggtgttcgccgccgccacgagcctgttgaacggtccgccgtcctccccgcatgaggccacggctcagaaccggagcctgctggccgaggtcggctgcgcgctggtgatcggcgaccgcgccgccggtgccctgttggccgagtcccacgccctgaccacgaccctgccccggacccttgccgcgttggagtccgggacgatttcctgggcccatgcccgggaaatggtgaaccagaccgtcggcctagaccgggccggagccgccgccctcgagaagtacttcctcgaccctggcattcccaagcctgccggtgcggcgacgatcggggagatgcccgcgtaccggttcaagcacaaggccaggacctggcgggaacgccaccatcccgaatcgctggagaaacgccatgccaagggcatggcggacggccgggtggattacaagccggaccaggacggcatggcctggctctctgcctacctccccgcccaccaggcaatggcgggctggaaccgcctcaacgccctcgcccgggccgcacaaggacccgacgaaccccgcaccctcgcccaactccgggccgaccacttcgcccaagccatcctcaccagcggcaccagccgcggtagtggagacagttccagcctccgtgcaggcaacagcgcccgcaacggcggcgccaataacggcgacagcgaccgggccagtaactgcaacggcggcgccaataacggcgacagcgactgggtgggcaacggcgacggcgacgggttgggtaccagcgaaagtgcaggcgcaggaacggatctcgtcgggccgtcgtccatccgggcgcaggtgctcgtcaccgtgcccgtactcgcgctcacgggcctgaccgacgagcccgccatgctggacgggtacgggccgatcccgccgtccatggcacgggagctcgtcgcgaacggcgccgattccttccaccgggtcctcgttgatccgagggacggggcaccgctggagatcgggcggaccagctaccgcgtcaccaaagcaatgcggaactggctgcggctgcgggacggcaaatgccccttccccggctgcaacaacagctcgttggataacgaggcagaccacctcctggcctggcagaacggcggaaccagcgggatcagcaacctcggacaaccctgcccgaagcaccacaaactaagacatagcagcgggtggacaccaacccaggccacccagaacgaaccacccggctggatctcaccgtccggccgccacttcaaaagcgaataccaggactgggagccaccccacttgccggaaactgtcatgttggccctgcctccgcggctggaattggaggagcatcacgacgggcaagtccccggcgtgctgccttatccgccgatgcccgctgcccaggcctgccctgccggagacctcctgcacctggaacctccaccggaggaacctgaagatgacaacctcatagacctggacgacataccagtggacgaccccctatgggacgacttctacgccctgccgcccgtcctgccccaataccccctgaatgactcggacgccctaaatgactgggacccgataacggaccgcaatccggcattgacctaattcccggctgaaagcgcacagacacgtgcagccgcgcgcgggggtcaacagccccgggccgagaaaaccacccgagaacaaaccgtgtcgggaagacggcccaagcacatgcctgacgagtgcctcagacgagcgcctactcagccccgggcaggcaaacttccaccatgccgccgctggtgcgcgtctcgaagagtggctgcttcgcggtggcggggccagcttgcacttcccccgtccgcagcgagaaggtgcttccgtgccaagggcatacaacgcacgggtcgccgccgtcaccagggccgccgttctggttgaccctgtcctggagcctgccgcccttgatcttgccttcgtgcagcggcccggagaggtggctgcagacatccgacaatacgctgacggtttccccctcccggtaggcaagcagcggaatctcggccacgacaactttgtggagcttcccgtcgggcagttcagccagcggcgccagcggatgccatccgctcgggaagcggtgtgggatctcctcgctgtggttcacgcccgccgcctgccggtacgtaagatggccgcccaggaaaccgcccgcacccacaacggcaaggccaaggtaggcaagcaccttgccgcctccccggctgccccgggcccgggcaaccagcgaggcagcgtagaggcccgtggccgtgatgttggcagcggcatggaccagccccacccgctgctgctgggggtgcagttgcgtccagtcggtgaagccagccaccgcggaaggcacggcggccccggtgcccacgccgatcaggagtgcggaagccttgtcgttaccaggcagggcgtccagcacggccgcggatatccacgcacccataggcacctggaccgcgagcggatggacagggtggccgatgggaactccatgcaggacgtcgcgcgcccacttggggcggatagcctgcttcaccacttttcggaccttcttggaaacggggtccagccactcggcgtcttccaggcgggtaacaagttccagtgcaggcagcggtttcatgtgtctcccttacccctttgctccatgtccagtcgatgccgggaagcttacttgccttagcaggggcagcacaggaccccaagggttagaaccatgcaagcgcagacggctaccggcgcgaaaacctaacggagcggagaacccagcaccgtgaactggttgccacccatttcaccggtgagcaggggcatggcttcctcaatcgccgcctgcacactctccagccccagggaagcccggtgtgcctccggcgattcccacagttcacagacgaacactgtgtccggcacggcgtcgttcacgcccacctcatacagcaggcagccggcctccttcagcccggccattggccggaccaggatggagaggacggcatcgcgctggccgggcttggtttcgaggcttcccacattcgcaaaggtcatagggacagtgtgcagcacaggagcgacaaagccggaggctaccgtacggccggcgtcgacatccccagcggcgattgttcgacggcggtccccgccgccacgctgccaggcaccgtggctccggccggctccaaggccgcctccgtcgtcgtggtttcacctgcaaaggcgcggagcatggcggcgcggtcgaactggccttcccacttggcgaccacgaaggtggcgacgcagttgcccagcaggttcaccaccacgcgcatggagtccatcagccggtctgcgcccaggaggagggcgacgcccgccaccgggaagattcccaaggcccccgccgtggcggacagggccaggaacgccgaaccgggcacaccggccatgcccttggatgtcagcatgaggacgcccagggcggccagctgctggccgaggtccaggttgtagccgaaagcctgcgccagaaacaggagggaaatggacaggtacagcgcggcgccgtcgaggttgaaggagtacccggtgggaaccaccaggccggtggtggcgcgggagcagccggcgttggtcagtttggtcatgatgcgcggcagcacggattccgtggaggctgtgcccaaagcgaggaggaattcctcgcgggtgtacttcataaactgccacagcgggacccgtggataaacccacgccaccacgaacagcagcccgatgaacacaatcgccgcgccgtagcaggccgcgatcagcagggcatacgtgcccagcgagcccagtccgtactggccgatgatgaatgccatagcaccgaaagcacccaccggtgccacccgcatgacccagcccatgatcttgaagaacagctccagcacggtttccatcagcgtgacgaccggcatgcagcgttcacgtccgacgacgacgatcgccgcgccgaagaagacagcgaagcacagcacctgaagcaggctgttgctggcgaaggctcccaccacactggtgggaatgatccccaggatgaaggcgccggcatccttcggcggtgcggtggcggttttcgcgttgagggcgtcctgggagagcgacgccggatcgatgttcagtcccgcgcccggctggaccacgttgcccaccaccaggccaaagaccagggcaaacagcgtggctgccgtgaagtagaccaacgctttgacgccggtacggcccacggccttgacgtcactgaccgcggcgatgcctgtgacgatcaccaggaagatcaacggcgcgatgatcatcttgatcagctggatgaagccgtcacccaaggggcgaagccctgcgccaatatccggccagaggtgtccaatgaggatgccggccacaacggccaccaggatctggaagaaaagggacttgtaaagcggcttcctggaagcgggaggtgctgccgtgggcgcgatgacattcatgccgttgcctgttctttggaggacggcggcacacaggatgccgcaaggtcacgagcaacgttagggaccgcatgtttccggaaagataaatccataatgcggaactattaagcctgccggcccattcagcgggaaatctaccggcaacttccatgacacgacaccgccatgagccagtggaagtatcactgtgtctcagctgcacctgctgcaacaccagcaacgtagaagaaggcgcaccatgcccctcactcccccatccgacgccgaactggacatcatgatccgggcccgcctggcatccctcggtatcgacctcaaccagcttcccgccggaaccgccagcgacccggagaccggaagccccggacaggcgtcggtcctggccagcctgcgctccttcatgcgcaccacggtggctgaactgagcgcctaccaggtgccttttgccggtgcggtcgggactgcggaccccgcactcctgtcccagcaggcagcccctcccgccctttacccctcgatcgatactgcacggaggacggcatgaacccgatggacggcgtggacagccagccgacggaccgcaccattgatcgccggtccttcgtcaacaggtttgccgttctggcagcggctacctcgctgggcgcggtggcgcttcccgctgttgcccacgcggcgccgtcagcagcggtgcccgccgggatcaacccgaacgcatacggggacgtccggcccgaagccctggcggacatcaccgagctgaccatcgcggaagccgcaagcctcattcggcagggccggctcagcgccgaactgctggtggaggcctaccttgaccggatcggcgcgttcgacgccgactaccaggcgttcaacctggtggcagcagacgatgccctggcaagcgcccgggccctggccggcgccgcatacaagggtccccttcacggcatcccgctggccatcaaggacaactactacacccgtgcctaccccaccaccgccaactcctacatcttcaaggacttcacgcccccgtttgacgcaacggcagtgtcaaagctgacgggcgccggcggcattgtcctcggaaagacccagatgggtccgctggccaccacccgggccaccactccggacggccgcatcaccaccgtcaatgcctggacccccgcggatccacggacgaatccaggcggatccacttccggctcagcgacggcggtggcggcacgaatggctgcttccagcgttggcacgcagatcggcggttccatcaccgcgccgtccaacgcccagaacctcaccgggctcaaaccgaccatgggccgggtttcgctgtacggcatcatccccctgagctacacccgtgaccacccgggaccgctcgccagggacgcgaaggacgcagccatcatgctcagcgccatggccggggaggatcccaacgacccgcggaccctggggcttccacccgtcccggacctgatcacggccgcgaccccggtgaagcgcggcaacaaagtggccatgcgctggggcacccgcgtgggcgtgatcccggacttcaccgcaggatcctcggaaacggcagcggcgcgcaaggccttcctggacaagcttgccggcattgaaggaatccaggttgtggacgttcggctgcccgaggactgggacacactgacaagcacagccttcaacaatgtgaggctgccggaacggagtgagccgttcctgccgctgctgcgcaaagacctccgcagctttggggtgtccgtgaccggctggctgcagggctccatgctgggcgccaacgagtacgtcctgggccagcgcgccaaagtcctgctgctggaacgcgtcctggacgatctcttcgagcagtgcgacgtggtgctgcaaaccagccccaaccccttcgatgcgattgggctgcctgagctcgcgctgcccatcggctttgactcggcaggcgtcccggtgggcaccatcctcggtggccagcccttcgccgaggaccggctgctggccgtggccgccgcctaccaggcagtgaccgactggcacctgcggcgcccggcgaacccggccggcgaaaaccctgagccgatatcggttgatccgtccaagtcccggaagccgttcgccaagagcgcgcgcggcaaggttcaggccgcacccgttccacagggccggggccgcttcgaggcgcacgaggccgcggagctgtcccagtaaccgctggcgcggttcagtccgcgaatatgggtggttcagtccgcggcgtatcagtccgcggccggcagtgccgcggactggaccaccaccgttccgctggacgtggtgtcctcattcagcatccagcccacccgtttgaccgtgcgcagcatcaccacgctttccaccaggtgtatgcccgggaccttttgctggagggcaagttcggcagtcataacgtccgcaagggactgcagccacatgatgatcacgaagttggtttgccctgtggtggaggcgctcaggcggacatttttgatggtccggatggcggcggccgcttcctcgtgctgtcctgcgggaacgttggcgaaccattggcaggtcaccgggtaggaggagcaggcctgcgcgatttcgcagcgggacagcaggatgccgctggccagcacgcggttcagctgccgctgcaccgttgccggacgccgccccaactcccgcgctatctgggctgcggttgccctgccgtcgcgggccaggaacggcaacaggtccaggtggctttgcgggagctgccccgcctccgccttgtgggcgtccgggccgccctggtgcccgagtgtccgaagcatggccagctgcggcttgctcagaatattcagccgccactcgtcggcgctcgtgtgaagccgcgtgcacagggccgcctgatatttgatcagcccctcgatgttcttcagctgggcgaccaccgaggcgctgaactcctccagcgacctggtgatcacggtcagcataaggtcgcggttgcttgccgcttcctccacggtgactattcctgggatgccggccaactgcgcagtcacgctgtcccgccggttcatgtcgcagtccaccgccacgaaggcgaggagcatctgctggggatcccccgccaggtgagccgtcacccacgctgccccgcttgaggtcagccgatcccagcgggcagcaagggtagtggcgtgcacgcccagcaccttggaggcgtccgcccagccgagccgcggatgcgtctgcagcacctggataagggccaggtcttcctcgctgagttccatccggtccacctctccatgcacgaatcctgcctgaaccgacgttttggaggatatttcgagtgcattcatccaatgtgagttgcgccactccacaatagtccacagacccggaaagctgagcccaggagttacaaagtgcccgtaattgaagacgccaaggaactgcagggggacctcatccgcctccgccacgacctccaccggcacccggaaatcgggctgcacctcccgcggacccaggagaaagtactccaggccctcgacgggtttccgttcgagatcaccctgggcaaggaaaccacctccgtcaccgcggtgctccgcggaggcaaagtctccgcaggcaccaccggcgcccagcggcccgcggttctcctccgcgccgatatggacggccttcccgtgcaggagaagacgggagtggagttctcttcacaggccgacggcgccatgcacgcctgcggccacgacctgcacacctcgatgctcgccggagccgccaccctccttgccgagaagcagcacctactgcagggcgacgtcgtcctcatgttccagcccggcgaagagggctgcgacggtgccagctacatgatccgcgaaggcgtcctggatgccgccggaacccgcgtgcaggcggcttacgggatgcatgtgttttcctcgctcgagccccacggcaccttctgcacaaagcccggcgtgatgctcagcgcctcggacgggctggaggtcaccgtccttggcgcgggcggccacggctctgccccgcatgccgcgaaggatcccgtcacagtggctgccgagatggtcactgccctgcaggtcatggtgacccggcagttcaacatgttcgatcccgtggtgctctcggtgggtgtactgcacgccggcaccaagcggaacatcatccccgagaccgcccgcatcgaggcaacggtccgcaccttctcgcaaagctcccggctcagaatgatggaggccgtgccgcgcctgctccaggggatagcggccgcgcacggagtggaggtccacgtggactaccaggaggagtaccccctcaccatcaccaacgaggacgaaacgcacacggcagagagggtcatctcgggacttttcggcgagcgccgcctttcgcgctgggccactcccctgagcggttcggaagacttttcccgggtactcgccgaagtgccaggcaccttcgtcggcctcagcgccgtcgcccctggctgcgatccggccacctcgccgttcaaccactccccttatgcaacgttcgacgacggcgtgctggctgacggggcagcgctttacaccgaactcgccacctcgcgccttgccgcgctggcggcggcggcctgacccgctttcgtccttcccatccccatcctcttcaccacgaacctgaggaagtaaccatgtccatggcagtcaccaagcagcagactggacgcgtgtccaccaccaagaccatcgtcggaaccggcatcggcaacgccgtcgaatggtacgactgggccatttacgccacgttcacccccttcattgccagccagctcttcagcaaggccgatcctgcgtcggcggtgctgtccaccctggcgatcttcgccgtcggctttgtggcacggcctttcggcggcttcctcttcggctggatcggcgacagggtgggccgcaagacctcgatgaccctcgccgtcggactcgcctcgctgggcagcctgatgatcggcatcgctccgaccttcgcgagcatcggcgcctgggcgtccctgatgctgctcgtggcacggctcgtccagggactggcgcacggtggcgagctgccgtcgtcgcagacctacctgtccgagatggctcccagggagcaccgcggattctgggccaccctgatctatacctcaggaaccgtgggcatcctgttcggcacactgctgggcgccgtcctgaacatgaccctgaccgcggaggccatgaacgcctggggctggcgcatcccgttcctgctgggcgcggccatggggctttacgcgctgatcatgcggtcacgactgcacgagaccgacgcgttcgagggcgaatcgctggcagaaaagcgggcaccgctctggccgcagattgtccgccaccgcaagcaggcactccaggtcatcggcctgacggttggactgaccgtcatctactacgtctggggagtcgtggctcccagctacgccaccactgcactaaagatcgaccgcggcgaagcactctgggcagccgtgatcgccaacatcgtcttcatcgccgcacttcccttctggggaaagctgtctgaccgcatcgggcgcaaaaaagtcctgtggtccggggccatcggctccgccgccatgcacttccccatgacctggctgcttaaggattcggcctggcagctggcagtgggcatgtccgtgatgctgattttcatcgctgcgagcgccgcgattgtcccggctgtttacgccgaactcttcccgacgtccatccgcaccgttggcgtgggggtgccgtactccatctgcgtggccgtgttcggcggcaccgcaccgtacctgcagcagtggctcggaaccaccatgggcatgccgcagctgttcaacatctacgcggtggtgctcctggcagtgagtgcggcgttcgtgtttaccattcccgagacgaagggcaaggacctgacgcactagggccttcttgaaacgcaaccaaaaagggtagacccggccctagcgcgtgccgaagcgcaggtggacgatttaagtaccggatcacaacattcaatgaggccggacatacgccccactagcagggcgtgcagtttgaaaatgggacgggcaggctgcggccgccactgatcaaccgcgacgctcagtcaggcgctggcttaccctgccccacatggggaatcgcgccctaacaaaattggtgaatcgcatccttttcaggagcacaaatgtccatcactccatcaacaggaatacgttcaacccgggccaggatcgccctggttccgcttctctcactgggcctgctcggaggctccgtggcattcgccggcccggcccaggcacatgacgaccggcgtgacgaccggcacgggtgtaccgtcaagccgctggacccaaaggaccttcacggaaagtgggtcgacttcagcatcaaggtcaagtgcgacgtcaagaatgacgggaaagacagcaagaggaccgtccatatccgccaactccgctatgaggacgagaagggtccgcggcgcaccgacgatttcctcggccgttcccacttcatcgaggaattcaataagcacgacgacgacaaggccaggatcatccacagtgttgacaaggtgcgcaacttggacaagagggacgccgaagaggtctaccacgtcgtatccttccgcgtacagaagggcaacggggactggtctgactggaccgagtggaagatgagcgagctggtcgaggtcaaggcacgccactaaccggcggctgttccttagaagctgcacggatccttagagacagcacccagagaaagagccaggggccaccgcccctggctctttgtcgtgtgcggacctgcccaaggactcagctgcgccccttgactcaccaccccctccttccctacacttttcataaagcagaatctaaattccacaaagcggaaagtttggaaaaactggaagcaagggaagatggatcaaagcccctccttggaaggacctacgatgacgtacacagtgaactgctccatcctcctcacggagctgcctctgctcgagcgccctgccgcagccaaggcagccggctttgacgctgtcgagttctggtggccctttgaaagctccgccccgtccgatgcccaggtcaccgaattcgagaacgccatcaaggacgccggcgtccagctcaccggcctgaacttcaacgccggcaacatgcccggcggcgaccgcggcctggtctcctggaagggacgctgctccgagttcaaggacaacatcgacgtcgtagccggcatcggcgagcgcctgggctgcaaggccttcaacgccctctacggcaaccggcaggacgaattcactcccgaggagcaggacgaactggcggtcaagaacctggccgcagccgccgaaggcgtcgcccggatcggcgggaccgtcctcctcgagccggtcagcggggcacccaggtacccgctcctcaccgccgacgacgcactcaaggtcatcgcccgagtgaaggcggaggccggcgtcggaaacatcaagctcctcgccgacttctaccacctgtcagtcaacggcgacgacgtcgagtccgtcatcgaaaaccacgccaaggacttcggccacatccagatcgcggacaaccccggccgcggcgcccccggcaccggcaccctccccctcggcgagtggatcgcccgcagccgtgaactcggctacgagggctacatcggcctcgagtacaaggaaccgcaggaaacggccttcagctgggccatccgcgaccacgcttcccgctaatcccccgccccgcccaactgagtagcgccaagtgtcgttttgagcccccataacgacacttagcgctacctagttgggcacccccctcacagacttcagagaaaagagaaccaccatgagcaacgttgcagttatcggactcggaatcatgggcctgcccatggccatcaacctggtcaaggccggccacaccgtcaccggcttcaaccgcagccaggacaaaatcgacaagctcgtctccgaaggcggcaagggcgccaccagcatcgcggacgccgtcaaggatgccgacgtcgtcatcaccatggtgccggactcccccgacgtcgaaggcgtggtcagcggcaaggacggcctgttcgccaacgccaagcagggcaccttgtggatcgacgcgtccagcatccgccccgacttcgcaaagcgcctgtccgatgacgcccgcgaagccggcatccgcccgcttgacgccccggtcagcggcggcgagcagggtgccatcgacgccgtactctccatcatggtcggcggcgagaaggaagacttcgaggcagcctcggacatcctgaacgccgtcggcaaaaccatcgtccatgtaggcccctccggctccggccagaccgtcaaggccgccaaccagctcattgtcgcggtcaacatcgaagtcctgggcgaggccatcgccttccttgaagcctacggcgtggacaccgacgcagccctcaaggtcctcggcggcggcctcgccggctccaaggtcctggaccagaagggccagaagatgctggaccgcaacttcgaccccggcttccgcctggccctgcaccacaaggacctcggcatcgtcacctccgccgcccgcgaagccaacgtcgccgtccccctcggcgccgtcgtcgcccagctcgtcgccgccaccgtcaaccaaggcgacggcgcacttgaccactccggactcttcaagcaggtcctccagctcagcggccggaagtagcccgccccaccccacgaagtttttgtccagatatgccgacttggacgccccataaccctgcatatctggacaaaaactcccttcagcacacccaaaaacagcccggtcaaactcatccgccgggcacccaccagacttttagtaggagcacaccatgagcaagatgcgtaccgttgatgcagcggttgcaatcctggaaaaggaaggcgccatcgaggcgttcggcctgccaggcgccgcgatcaaccccttctattccgcaatgcgcgcccacggcggcatccgccacaccctggcccgccacgttgagggcgccagccacatggcggacggcttcagccgcgccaaggacggcaacatcggcatctgcatcggcacgtccggccccgccggtacggacatgatcaccggcctctacgccgcctgggccgattccatcccgatgctctgcatcaccggccaggcgccggtggccaagctgcacaaggaagacttccaggccgtggacatcgaatccatcgccaagcccgtcaccaagatggccatgaccattttggaaccgggccaggttcccggcgccttccagaaggctttccagctgatgcgctccggccgccccggtcctgtgctgctggacctgcccatcgacgtgcagctggccgagatcgagttcgacatcgacacctacgagcccctccccgtcgaaaagcccaaggcctcccgcaagcagctggaaaaggcgttggccatgctgaccgccgccaagcacccgctgatcgtggccggcggcggcatcatcaacgccggcgcctccgcacagctggttgagctggccgagaccctgaacatccccgtcatccccaccctgatgggctggggcaccatcccggacgaccaccagcttatggccggcatggtgggcctgcagaccagccaccgctacggcaacgagaactacctgcagagcgactttgtgatcggcatcggcaaccgctgggccaaccgccacaccggcggcctggaaacctacaccgccggccgcaagttcgtgcacatcgacattgagcccacgcagatcggccgcgtgttctcgccggacctgggcatcgcgtccgacgccggtgcggcgctggcggggctggttgagctcgccaaagagcgcaaggcggcagggtccctgccggactacagcgcctgggttgccgagtgccaggaacgcaaggcctcgctgcaccgcaagacgcacttcgagaacatccccatcaagccgcagcgcgtgtacgaggagatgaacaagtccttcggccgcgacaccatctacgtatccaccatcggcctgtcccagatcgccggcgcgcagatgctgcacgtgttcggcccgcgcaagtggatcaacgccggccaggcaggtcccctgggctggacggccccggccgccctcggcgtggtccgcggcaagcccgacgagaccgtggtggccctctccggcgactacgatttccagttcatgatcgaggagctggcggtgggcgcgcagttcaacctgccgtacatccacgtggtggtgaacaactcctacctcggcctgatccggcagtcccagcgcggcttcaacatggaacagaacgtctccctggcgttcgacaacatcaactcgcctgagaccaacggctacggcgttgaccacctcaaggttgctgaaggcctgggctgcaaggccgtgcgcgtggaggatcccaacgacctcgccgccgccttcgacaaggccaaggcactcatgggcgagttccaggttcccgtggtggtggaagtgatcctggagaaggtcaccaacatctccatgggcgtggaaatcaacgcggtgaacgagttcgaggaactggcggaaaccgcagccgacgcccccaccgccatcctggcgctgcaggcctagaacggaaaaggcaacactgctcatgcgcatcgtcattgccccggacaagttcaaaggatcactgtccgcccccgaagtctgtgcgcacctggaaaagggcctgcagcgcggcgcgggcgggaaccttgacgtggtccggattccagtagccgacggcggtgagggcaccctcgacgccgccgtcggctccggcttcacccgccgcagcgctgtggtggccggaccattgggggaaccggtcacggccgagttcgccgtccggggcaatgaggccgtcatcgagatggccgcagcctcgggcctggcactgctcccggcaagtgctttggtggacgggcgcccgggttcgacggcggcccgcaccgccaccagcctgggcaccggccagctcatcagcgccgccctggatgccggctgcaaccggatcgtcctgggcgtgggcggcagcgccaataccgacggcggcgccggagtcctgcagggcctgggcgcaaggctcctcgatgccgacggcagcgaacttccgtccggcggcgcagctttggcccgcctggaccggatcgacttcagcgggttcgaaccccggctgagggacacacgctttgtgctggcatccgacgtcgacaatcccctgctgggcgcccagggcgccgcggcgattttcggcccgcagaaaggcgccacgcaacaggacgtcggcatgctcgacgccgccctggccaggtttgtcgaagtcctggccagggaaatcggttcggaaggcccgtacaacagggccttcaaagcggcggaagccccgggcgccggagcggcgggaggcgttggctatgcggccatcgccgtcctggccgcaacccggcgcccgggcatcgacgtcgtgctcgaattcaccggcctggccgaacggctggccggcgccgacctggtcatcaccggcgaaggcagcctggacgagcaaagcctgctgggcaagacccccatgggcgttgcccgggcagccgccgcgcagggcgtcccggtggttgccgtctgcgggcggaccaccctggcgcaggggcaggcggccgccgcaggattcgaggacgtttacgctttgaccgagcttgaaagcaatgtagacaggtgcatagcagaggcagcgccgcttctggagcagctaggcacacagatcagcggaaggctggcagccaccacgctgtcccgttccgccaccaccaaggaggacctccatgtctgaagaacgttttgacctggtcatccgcggccagcgcatcctcaccaccgccggcctggctccccgtgaagtgggcgtccgcggcggcaagatcgtggccctcgagccgctgggcaacggcctggccggcgcggaggtcatcgaactggccgacgacgaaaccctgatcccgggcctggtggacacccacgtccacgtcaacgagcccggccgcactgagtgggagggcttcgcctccgccacccgtgcagcggcggcaggcggcgtgaccaccatcatcgacatgccgctgaactccgtccctcccaccactaccgtggagaacctcaagctcaagcgcgaggtcgccgaggaccaggcgtttgttgacgtcgggttctggggcggggcgatccccggcaacaagggcgacctccgtgccctgcacgacgaaggcgtgtttggcttcaagtgcttcctcctgcactccggcgtggacgagttcccgcacctggacgcagacgagatggaggaggacatggccgagctgaagtccttcgactccctcatgatcgtccacgcagaggactcccacgcgatcgaccgggcacctcaccccggcggcgaccactaccagaccttcctggcttcacgcccgcgcggcgcggagaacaaggccatcgccgaggtcatcgaacgggcccgctggaccggtgcgcgtgcgcacatcctgcacctctcgtcgtcggacgcgctgcccatgatcgccagcgcaaagcgcgacggcgtgaagctcaccgtggaaacgtgcccgcattacctgacgctgatggccgaggaaatcccggacggcgccaccgcctacaagtgctgcccgcccatccgtgaggcctccaaccgggagctgctgtggcagggcctgctggacggcaccatcgactgcattgtctcggaccactccccctccaccctggacctgaaggacctggagaacggtgacttcgccgtcgcctggggcggcgtctcgtccctgcagctggggctctcactgatctggaccgaggcccgccaccgcggcatcccgctggagcaggtggtgtcctggatgggcgagaagcccgccgccctggcccgcctctccaacaagggacagctggcgctgggctacgacgccgacttcgccgtcttcgccccggacgaggccttcgtggtggacgtttccaagctcaagcacaagaaccccatcaccccgtacgacggcaaggccctctccggggtggtccgcaagaccttcctgcgcgggtccgtcgtggacgggcagacccccacgggcaagctgatccgccgcggcggagtctaaggacgcgccatggcagtggaagcccaccatccgaggacgggggtacgtcccggaaccatcgccaggcctgccttcaccggggcagccgcccgcggcctcgccgtgtgggtggtcccggaggaaggcaccagcccggaactccttgcccgcgccgcccaactggtcctggccagggcccttcagactgctccggaggcggaagtccactggcccgccgccggagctcccacaccggggtcctccgctttcgcggggggaggcacagacgactcctctcatccttcctccgcagcggagaccccttccggcgccccatccggggcaccaggggaggacgacggcggcacgaggctgccgccgtcggccggccccgtcagccgcatggcggtggacctcgccgctgaccaggtcctgctggacggccggcgggtgccgctgaccggcgtcgaattcaaggtcctccggtacctggtcacccacctgtcccgcactgtgggtagggaggaactgcaggagttcctggactcgttcgaaacccccggagcctcggcccggtccatcgacgtttacgtgggcaggatccgccggaaactcggaaatgcccgccatgccgtggccaccgtcaggggcggcggataccggtttgtgccgggttcctgcgccaccgtccgcgggccggcggaatactgcatatgacgccggagttgtatcactgagcgggaagccgcttcacttgatgttttgccagtaatgacaaagtcttccaaaggaacaccatgagccccaccctgaccaccaagctccagcccggaaccccggcccctgacttcacccttcaggatgcccagggccgcgagactgccttggccgattaccgtggcaagaacgtcatcgtgtacttctacccgaaggccgccacccccggctgcaccaccgaggcctgcgacttccgcgacagcctggcctcgctccagggcaagggctacgaggtcatcggcgtctcccccgacgccccggaggccctggccggcttcaccggcgacttctccctgaccttcccgctgctctccgacccggaccacgcagttgccctggcctacggcgcctggggcgaaaagctggtcaacggcgaaatcaccgagggtctggtccgctccacagtcgtgctggataccgaaggcaacgttgtcctggcgcagtaccaggtcaaggccgatggccacgtggccgcactgaaggaagccctgggaatttaacgctctctcacttaacgcggctttccccggacgctctctcactagatgcggcttttccccggacgctctcccactggtcaccaattcaccagtgcgggggcgttcggtatttatgcggcggtgtccgttgcccgcgactcttctgctgctgcccgggcgtacgacgccgagacccggcggtagaccggcgtaaggaatgccagcagcgcggcgatgaccataatgacaccggccaccaggaataccagggcaatgccgcgggaggtgccctcgcccagcagcggggccagccgggcggcgccgtcggcggaccgggcgtagggaatgatccagaactgggcgatcggggcaatgaggaacgccgtgacgggcgatgctgcggattcgaaggccatggcgaacccgaacacccggccctgccgctgcaacggcaccacctgctggatgacagtctgctcagcggcttccacgaagggcaccaggaccaggtaggcccagattcctgcgatgtacagccacgcccattcccggattgtgaacactgcaccgaggaagcccatcaaggcgaccgcaaggagcagggtgcgcaacgggtttgaacccagcccgaacttgccgatcagcgcgccgcccacaaggatccccgtgaaccccacggcggaaaagattccccacagctccacagggaacatctccaggccgtagggatccatcaaggccatgtagacgccgccaatgaaattgttgaatgtggagaacacgatcagggcgaacagcccggaaatggccagcacggcagcgagggagccgcgcaggtcgaagctgccgtgggcatccgtggctgccgcccggacttcctcgggcatgcgcagggtgagcaggtgcaggaacgccagggccgtgagcgccagggcgacggcgatggtccagcccatgccgagcagccccaccgagagcccggagagcacggacgtgacaatgaacatcagtccctgcaccatgcccaccatcccgttggcgttggcgcggcggtccggctcgatcaggatggtcaccgtggtggagagggcgatgttgcgcatgttttccaccaccgcgccgatcaggataaccagggtgaaaacccagaaccacggctgggtcaggtccaggagccaggctgtgggcgtcagcaagaacatggcaccggacagcgcgaacatcaccagggtgaaggcggcggcaaaccgcatcacggccagcttgcggtagcggtccacgaaggtgccgaagctgatgctggaaagcgcgatcaacagcatgtacgcgccgcccacaaccccggtggcgatcacgttgcgcgtctccaggtacacccagaacgtcagtgcgaaccagagatagctggtggtgacgttggcggccgcggtgttcgccagtattccggtgaaggtgcgggaccgctgtgcctgcgtgcgcagagaagtgtcgacggcgtccggatcagtgaagcgcggcgcctcaccatcctcgggtgcggcagacgctaccgcaacgtcctcgctaagtcttttcccgccgtcggaagccgcagcggcgcgcggcgggaccggctcctgctcggtcatgcgtcccagtgtaatgacaccccggggtcatggacacggtcagggacgggggtctgtcagcgcttgtcgcggtcgttgaattcctcgtccagctcgtagtggcggaattcggtttcggggtcgggttcgccctccgccactacctcgtggtcgagttggcgctgaacctggctgtccaggacctgcagttcctggtccgtaaccttctccaggtcctcgggaaactgatcgtctggagtgaggtgcagcttgtcgttcattatgcccgccatgtctatccgcagttgccgtgtcggtacagtgtagcggtggcgtcgccagcgttgcaggtgccattgcgtgccatacagcccggtgacaggatggccgcatgggcatcgaggtccgtcccgcaaccagcttcgaggacgtcaagaccatggtcggacccaagcggcccgacgccaacgtttgctggtgcctgagctaccgcatcccggcgaagcagaaccaggccctgcgcgggaccgagcgcggggagcgggtgaagcagctggtggcggagaatcccccgccgggggtcttggcgtacgacggcggcgaggtagttgggtgggcagcggtccacccgcgtgcggacaccagttttgccggcaaccgcaagatcccgcacgtcgatgacgcggaggtgtggtccgtctggtgcatcagggtgcggcccgggtaccggggcaaaggcatttcgcaccaactgctggccggtgcggtggacatggccaggaactacggcgcgccggctatcgagggctacccggtggacaacggcggccggaaagtggacctcaccatggcctatgtgggcacgcgcaaactgtttgaggatgcgggcttcaccaaggcagcggacaccgattctgtgcttaatgggttcccgcgggtgctgatgcggcgggacctgggttaggcgcgtagagcgttttgccaccggccaaacagccacagcacaagggcaccctgcagccaccggcagactttgtcacacctgcccggcgccttctcggcatattgtcaataatatctgcggggttgactcatcagtatgcttattattagtttcgttgtaacggtgatgctagtcacgcaatgccgttgggatgttttgtaaagcgtccgtcatcagcaaatcaagagttccgccggcagttccgcatgggggctgagcgccgggggttcaagagccgtcaaccggcactgaaagggaacacagatatgcgaacacgagtccttgcacctatggcagcagtagctctttccggagcaatgatcttcggagcaggcgccccggcctccgctgccccgcccgcaccggtacccgcagcgtcggcgagcacggcagacgcaacgaaagttgcgtcttcggtcaccggcaccgcaagtgatggatctgcttttgcgggttcattcacacccacaagctttcaggtccaggatggcgttctgaccgccaccggcctggtatcgggcactttgacctcagccaccggcacggtgaccgaggttccggcaaccgaggtaacaacagccgtcacaagcggcgttgagaaaacactcgcgggcggcaatgccgcctgcgacgtcatcaacctagacctgggaccgctgaacctcaacgttctggggctcgtcatcgatctcaaccagatccagctggacatcactgctgtccccggagccggcaacctggtgggcaacctcctgtgcgccgtggccggcctgctggacggcagcggcaccagcggactggcgaacctgcttaaccgcctgctgggcctctaggctccaagccagtgtcaaagtctgtgggcggtccttctggaccgtccacagtcttgtgttctaatgggaagggccgtcagggtttcttccaccatttgccgggccagtcctcgtcaatggcccacagggccagaagcagtgcgtcgactgtcatgagtcccgcaatgaggtacgcccaacctgtccaccaacccataacaatctcctgacccggtaacccccagccactcgattgctcataagtgtggcacctaaagcgccaggacggaacgccctccacccgcagacttgaaaagcgcctccagcctcacgtgtgcttccgtctccagcttgaggcggcgggtcaggcgctccacctgctgcgacatctcatcccctaccggaagacggtctcccggccagctccacacctcccgggactcggccaaagcagccgccagcgccgtggccgcagcgcgtactttccgcctgtggaaatacacacgcagcagcgcccggcctttgtccaaggcccccaaggcggccgcctggaccgccgcctggtctatgatcctgatttgccccatgacctgcacctttttccgagccgtgcagccgtccggcaggccgcccttggccctggtccggtgaaagctgctccgtccctcgagtgtcccgggcggacctcaatgtccgggcaagcaggtccaaggatttccacaagatccggcgccgccaaccgaggcgtggctgcccttgtgaagcgccgcgacatgccccgtaggggttaatactgtagaagtagacgtatggtctctccctccgaatcccgtcgtgccgttgtcatcgaagatgacccggacatccgcgggctgctggtccgcgtccttgttaagcagggattcgatgtcacccaggcgggagccggcctggcaggggtggaggaagtgcgccgggtgcagccggacctggtcacgctggacctgaacctgcccgaccttgacggcctggaagtctgcaaactgctccgcgaattctcggacgccttcatcgtgatgctgaccgcccgggccgatgagttggacaagctgaccggcctggacaacggcgcggacgaatacctcagcaagccgttcagcccgcgcgagctccagtccaggatcaatgccctcttccgccgccggccctccgcagccgcggattcagccgcgcgcagcgaactgcagcgcgccacggaggtgcagaaaagcctcctgccccaggagaacatccaggttgaaggctacgacgtcgccggggtgttccggccctcgcggaacgttggcggggacttctacgactggtaccagaccccggacgggctacacctgaccttcgccgatgccatgggtaagggcatgggtgccgcgctcatcgccgcaacggtccgcgcggtgatgcgttcgacgggcctgcggcatgacctggacacagccttccgcgcggcgagcaaggcgatcgccgctgacctggactcctccaattcctttgtcaccctcttccatgcccgcctggacgccgcttccggaacggtcagctacgtcgacgccggccatgggctagcgctgcatgtccagtccggcggcacggttcaccgccttccctccggcggccccccggtgggcgcctggccaggaacggagtggccgcagtcggccctggacctgctgccgggggattccctggtggtggtcagcgacggcgtactggacgtcttcgactccgtggaggacttcaccgacgccgtgctccgggcaacgcaccaccaggagtcggcgcaggctgcgagcactgccatcctcgccctcgccccggccgcgacggctgaggatgacgtcacggtggttgtggtccgccggcttccgcaggaggccgcggcatgacccgcttctggacccggcttgttgttgtcctgaccgtcatcacgggcgtcaactacatcgcctggcgctgggccgcctcactaaactgggaagcctggtggatcgcgctgccgctggtgatcgccgaaacctacagcctcatcgacgtcatgctcttcggcatgaccgtgtggaagctgaagatccgcaaggccgccccgccgcccccgccggatgccaccgtggacgtcttcatcaccacgtacaacgaagacctggacatggtgatgaccaccgctctggccgcgcagaagatcaggcacccgcacagcacctggatcctggacgacggcgcccgccccgagctgaaggccctcgccgaacagcacggcctgggctacgtcacccggagcgaggactggacctccaacctgccccggcatgccaaggccggcaacctcaacaacgcgctgatgcagacgcacggcgagttcctcctgatcctggacgcggaccagatcccggagccggacatcctggaaaagacgctcggctacttcaacaaccgccgggtggcgctggtccagacgccgcagtacttcagcaacgtccccgccgacgatccgctgggcagccaggctcccctgttctacggccccatccagcagggcaaggacggctggaatgccgccttcttctgcggttccaacgccatcctgcgccgcgaggccctgatgcagctgggcctggtgggctacgtcaaggagaccgagaagagcatccgccgggcgctggccgcctcgcgctccgccatcaagcaggcccggaagtcagcggacatggaaacgccgctggtggcccaggtgctcgatgaggttgaagctgccacacgcgaggcccagcaggagctcgacgccgggcagccgctgggcgagatcacctaccgggtccgccgccgcgtggacgctgccgtgcagaccctggtgatggccgacgtcgaagccctccaggcggacctcgaggagatcgccgccatggaactggcccacgtgggcgagtccggcgtcccggtggtggcggacgacgccgtgcagcggatgtccgcccgcgactggtcgccgctgggcgcccttgagtcggtgcaggccgtcctggacgcgctgtccgtggaacgcaacgacgaagcccagccggtcatgccgctggccaccatctccgtgaccgaggacatggccaccgccatgcgtatgcacgccatgggctgggagagcgtctaccaccatgaggtcctggcgtacggcctggcgccggaggacctgaagaccatgctcacgcagcgcctccgctgggcgcagggcaccatccaggtgctgctgcgggaaaacccgctggtccagaaggggctcaaactgggccagcggctcatgtactttgccaccatgtggacctacctgagcggctacgcggcagtcatctacttcgccgcgcccatcatctacctgctgctgggcatccttcccgtcaccagcctgagctgggactttttcatccggttcatcccgttcatggtggtcaaccagctgctgttcgccgttgccggccgcggcatccccacctggcgggggcagcagtacagcctggcgctgttccccacctggatcaaggcgtgctcgacggcggcccgcaacgtgtggttcggccgtcccctggggtttgccgtcacccccaaggcccgccagagcggcggacccagctggagcctcatccagccgcagatcgtggtgtctgtcctgctcgccgtggccgccgtcgtcggaatcatccgcctggccaccggcctggcggaacccctgggcaccctggtgaacgtggcctgggtcattttcgacctggtggtcatgagcatcctggtccgcgccgtgctgtacaaggggtacgaaccggccgcagaatccgcagaaccaactaatacggagaggaattccgatggagtttagttatgaggtcaaggactcgtacgccgaggtgaaggcggacgggcggctcaatatggtctccgcgccgaagctgcgggagttcgtcaccgacgtgatcgcgggcgggtccaaccggatcgtggtcaacctggaaaacacggcgttcatggactcgtcgggcctcggggcgctcattggctgcctcaaggccgcgcgccaggccggcggggacctccggatcgccgcggtgcagccgcaggtgaagatggtcctgcagctgaccagcatggacaaggtgttgacgtcctacggttcagccgaagaggcgttcagcaatgactgacgtcttggcgtcccgcagcttccgggggccgtctgcggaagaggcgatcgaatccgtccataaccacctggacagcctctggctcgacgtccccttcgtgggggacgtggaccagatgacgtttaccacggcggtgatcgaatcggcgtcgaacatcgtccagcacgcggaacccgtggcgcaggatcctgtggagcttggcgtggacatcgaggtgcagcccgcgctgctgcaggcccgcgtcagcgcctataacgccaagcccccgttcggaccgatggtccccgggtcgccggatgaggatgccgagtcgggccgcgggctggcgctgatcgaggcgctggtcaccactgtcacgttcgagcgccaggacggcaccaacacctgggtcctcacccgcacctcccagcacggctaagcaccctcaagactgcgcaccccatggtaaggggcgcttagggcttggcggggaacagcacggagacggtggccccgccgcccggggtgtccgtgatggacagctctcccccgtgcgcctgaacgatccgctggcaggtggacaggcccagccctgttccggggccgtccccgggccggttcagcctgaccagcggttccacggcccgctgccgctctgacggcagcatgcccttgccgttgtccgccacgtgaacggtgacgcccagcggcccgggctcggcgctgacggccacccgcagcgggcgggagccgctccggtagttcagggagttggccaggaggttttgcaccagggtgcgcagttgtgaccggtctgcgaacagttccgcatcctcgcaggagattccgctgccggcacccaggtccacgccaaggtcccgcgctgcctccgcagtgaccgccaacagggacacccgcccccggttcagcgctccgtccgccttggaatagtccagcacgtcctccagcattcccagcatgcggcgcccgctgctgccgacgtaccccaggtactccacagaggggtggtccgccgtaatgtccggatcgtcctccgccagctccacgtaccccaggatggcggtgagcggggcacggaggtcgtggctgacccgcccggcgaactcggacaacagtgtgttgctgcgccgcagctcggacagggcgtcgttgagctgcagggtgcggtgctgcagctccaggagctccaccacctgctgggccagcatttccagcatccctatctgcccggcactggggcgtccaggctcattggagaagacacatagtgaaccgagcaccagccccgacggggtctccagcggaacagacgcgtagaagcggacgtcggcgatctctccggtgacgaacggattggcggcgaagcgggagtcccgcgaggcatcggccaccaccgttgtcctctggctcaggaagaccgtggcgcacatcgagtcctcccgtgagcagatcccggggtcgatgccgaaggccgcgatctgcagctgctgctccgcggtaatgatgttgaccacgctgtagggcacgccgcacagggaggcggcgagctggaccaggttgtccagtgcactccgggtcgaggcgtccgcaagtaccggcagttcatccgcagcggcagggaacaacccgtatttccgtagtccggcctcacgtgcggcgtcctgatcggtcagcatttgcatagccgtcccgtccatcttcttttgaacccccagcatcatccattcgagctccccggctctcccgtgatgataccggctggttctgggcgctgttgtagtcttcttgacaccaccggaagcctgcctttgaatattacgtatgctgaaataacagttccatgatgcggaagcctaggcggacgggaagttgcgtcgccgggtgccgggaagtccggcctccgcatagccgtcaccatggatgccagcagattctcaccaagggaccagccagcatgaagcttgccgaattcaactccgcggaacccgcccgggccgccgaaaccctccgaccctgcatcgacgtcgcccgctgggtggagacggtcgccgcagcccgcccgttcgccagcaaggactcgctcctggcctttgcgtcccaggctgcgagccccttcacgtcggccgaggttgagtccgccatggcgcaccacccgcgcatcggggagcgtccgacggcggccaccaccgaggcgtccatgtcacgttcggagcaggccggggttgaccctgcggacagcactgttaccgaggccctggcccggggcaacagggactacgaggaaaagttcggccgggtcttcctgatccgcgccgccggccgcacggcccctgaaatcctgcgggtcctgaatgaacggctcgccaacacgccagccgaagaggacaccatcgtggcccagcagctgcgcgaaatcgccgtactgcggctggaaggactgatcaccgaatgagcgtctcccacgtcaccacccatatcctcgacacaggtgccggacgcccggcggcgggggtcgccgtcgtactttaccggaacgacggcggcacctggcgccatgttgccgactccaccacggatgctgacggccgtgccaaggaccttggcccggagcagctggaggccgggcactacaagctcaacttcgccaccggggactactacgccggcctgcagacggccacgttctttcccgaagtggacctggtgttcgaggtgaccggcccggagcactaccacgtgcccctcctcctcagcccgttcgcgtactccacctaccgcggcagctgacctggcccctggagtttttgtccatctatcgagccgaaacgcgcgatcaacggccgttacgtggacaaaaactccggcagtaggcttgatgcatgccttctgaacaaccccccgccgagcgccgcgaagttaccgtccgccgcgcgcccaagtatgtgccgttccttatcctgggcgcactggtgggtatcgcggccgcagctgtggccgcctacgcggtgcccgcgaaccccagcttcgacgccggcgcggtcttcggcttcttcatggtgtggttcgccggcggcggcgccatcctcggtgccatactggcgctggtcctggaccgccggagcatcaagcggcagcagcgggccgtggtggaagccgtgccggactccgagccggacccggacgtcaagccctagcccggtcataaacgggcggccggaaaagtcataccccatgtcgtgagataatcgaccagtggcacgcggcgatggaaaactttcccatgatcttctccccggcgaaaaaggcccgcaggacgcttgtggcgtcttcggcgtttgggcaccaggtgaagaagtagcaaaacttacctattacgggctgtatgcactgcagcaccgcggtcaggagtcggctggtattgccaccagcgacggcaagcggatcaacgtctacaaggacatgggactcgtctcccaggtcttcgacgagaccacgctgaacaccctgaccgggcacctggcggtgggacactgccgctactccactaccggagcaagccactgggccaacgcccagcccaccctcggcgccaccagcaccggaaccgtggctctggcgcacaacggcaacctgaccaacaccgccgagctcaacgccatgatccacgaacgccacggcggccagctcaccggcgaaatgaagcagggcaacacctctgacactgccctggtcaccgccctgctggaaggcgagccgggcaagagcctcgaggaaaccgccaccgagctgctgcccaagatcaagggcggcttctgcttcgtgttcatggacgaaggcaccctctacgcggcgcgcgacacctacggcatccgtccgctggtgctgggccgcctggagcgcggctgggttgtcgcctccgagcagtccgccctggccactgtgggcgcaagcttcatccgcgagatcgagcccggcgagttcatcgccattgacgagcagggtgtgcgttcccagcgtttcgcggagccgacgccggccggttgcgttttcgagtacgtttacctcgcgcgtccggacgccgccatcgccggccgttccgtgtacgagtcccgcgtggagatgggccgccagctggcccgcgaaaacacccaggtggccgacatcgtcatccccgtgcccgaatcgggaacgcccgcagccgtgggctacgccgaggaatccggaattccgttcgcgcacggcttcgtcaagaactcctatgtgggccgcaccttcatccagccctcgcagaccctgcgtcagctcggcatccggctcaagctgaacgccctcgaatcggtgatccgcggcaagcgcgtggtggtggtggatgattcgatcgtccgcggcaacacccagcgtgccatcgtccggatgctccgtgaggccggcgccgccgccgtccacgttaaaatctcctccccgcccgtgaagtggccctgcttctacggcatcgacttcgcctcccgcgccgagctgatcgccaacggcgccaccatcgaggaaatctcccaggccatcggcgccgactcactcgcctacatctccgaagacggcatgatcggcgcaacccgccagccgcgtgagcgcctctgcaccgcctgctttacgggcaaataccccatcgagcttccgggctcggacaagctgggcaagaacctgctggaacgcaaggacctcggcggactgaagccctccccgtccgcccttcccggctccaccgccgccctctccgtcgactcccatgaggacccggcggaaaagtccggcgccaccggctgcgatcccgggccggactccgagtttgaaaacctcctcaccgaagccgacctcgtgccagagacccatcacgtagccaccacccccggcgccgacaagaaagagtccgtatgacttccgctgcccccgcctccggcaacacctccgggaacactgccggcatcacctacgcctccgcgggcgtcgatgttgaagccggcgaccgcgccgtcgagctcatgaagggtgccatcaaggccacccacaactcctcggtaatcggcggggtgggcggtttcgccggcctctacgacgtctccaggctgctcacctacaagaagccgctgctggccacgtccactgacggcgttggcaccaaggtggccatcgcccaggccatggacatccacgacaccatcgggttcgacctggtgggcatggtggtggacgacatcgttgtggtgggcgccgagccgctgttcatgacggactacatcgcctgcggcaaggtggtgcccgagcgcatcgccgacattgtccgcggcattgccgccgcctgctccgtggccggcaccgccctggtgggtggcgaaacggctgagcaccccggcctgctgggcgagcacgagtatgacgtcgcgggagctgccaccggcgtcatcgaggccgacaacctgctgggaccggaccgcgtccgagccggcgacgtggtgatcggcatggcctcctccggcctccactccaacggctactccctggtccgccgcgtcatcaaccacgccggctgggcactggaccgccaggtctccgaactgggccgcaccctgggcgaggaactccttgagcccacccgcgtgtacgcagcggactgcctggaccttgcccgcaccttccccgttaccggcggtgcggccgtgcatggattcagccacgtcaccggtggcggcctggccgcaaacctggcccgtgtcctcccccacggcctcgtggccacagtggaccgttccacctgggaactgccggccatcttcaagctggtgtccgagctgggcaatgtcccgctggccgacctcgagcgcaccctgaacctgggcgtgggcatggtggccatcgtgtcccccgaagccgcagacgcagcagttgcccgcctcaacgaccgcggcctgccgtcctgggtgatgggcaccgtcaccgaggattcggacgcgatcctcaagtccggcccggactacgtgcagggcgccaagggcgtggacggcggcgctgtccggctggtcaacgcctacgcctagaacttttatcgagtgctccgttaccgccgttttgacgcttcagaacggcctttacggagcactcgatgcgcttgacagggcatgcataagtcaccctccccttgactgctaagcatacttagctttagtgtttaactcggaagtgcataacagaatagtcaaccgggcctttccattggcttgatgccccgccggaatccaccggcgcctgggcgcccacccggttgaaccgccttcccccgccgaaccggcggaagccagaagaagcaaccacagagacgcccggtccccatgcgccatgcatcagcgcggccgtcaggcagtccagagtcactcttggactgcaggacagggacacagggcagatatcaagggagcgaaaactatgtcagttcttaagaaagccaccgccgcagccgctggaagcctgttcctcatgggcgccgttgccggaccttcgcaggcagcagacaacaccacgttgaatgacggcctcgtcagtgtcacggtgggggacatcaccgttgaggatgccgttgacgtcaatgtggcagccagtgtggcagcaaccctttgcgacgttgcggacatcggctcaatcgcggttctaggtgaagcggtagatgccaccggatccgaggaaaccgtctgcgaaaccgtgaccggtccggtcaccatcgtcaacaacaagtaggcggagccactgagggacaaacggcggcacatctcgcccaacaccctcttgtagagcttcacgcgaggagccccggccactggccggggctcttttgcgcacacgtaccatccccacgaacgaggcttacgccttgtgcatcttaatgcgaatgattattgatagcatgtgaaccggcccttatcagtcctcacatgaaatgacgttgccatgcctgcacccgccctgtccgtgacagaccttgcgctctcaagcggcggccgccagctggtgcaccccctgacattcgcagtagcggctggtgagcgcgttgcactgctgggcgcctccggatcgggcaagtcgctgacggccgcggcgctgaccggctcgcttcccgaggggatagcagccagaggaaccatcaccttcggggcaggatcaggcaagggcaaggccgcgctgatccgccaggacccgtcaaccgcacttaaccccctggtgccgatcggcagacagctcggcattcccctgcgctccgctggatacagccgggcagcagcaaaggctgaggccgcccggctgctggagcgggcgggcattgaagaacccggccggatcctgccgcggtacacgggccagttgtccggcgggcagctgcagcgcgcctgcatcgcccatgccctggcctgcggcgcgcccgtcctggtagcggacgaacccaccaccgccctggacgccgtcacgcaacataccgtccttgagaccctccggacgtggggcaccgaaggccgcagcctccttttcatcacccatgacctggcagcggccggctcgctctgcacacgtgccctggtgatggaggccgggcggatcgtggaacaggctcccatggcggagctgctgcgcaacccccagcacccctacacccgccgcatggtgcaggctgcttcgaggtccgtggcgcccctggcagcggcaaacgaggtagcaaccacagcggcaagttcagcggacagttcaacggaaggcgcggcgccacgttcggcaccagcgacggcggtggcagcgtgaccggaaccctcgccgcagacggcgtctccttcgcctatccagcgccccgcttcagcaggggcggggtacacggcccccgccgcatcggaaccctccacaacatcagcctgcacctggcccccggcaccagcaccgccctggtgggaagctcgggctccggcaaatccaccctggtccgtattctgctggcgctggcaaaaccttccgccggggcggtggccctgggcgtccgcgaggtaaaaccgggcccggcgcggtccctccgctggtaccggcaggccgtgcagtacatcccgcagaacccggccgggagcctggacccgcgcatgaccgttgcccagctgctgggggagcccctgcgccaacttcgcgtggcaggcaaccacagggcgctggtggctgaggcgctggaacgcatcgaggtcccggccgggctcatggaacgccggtcgggcgaactgtccggcggccagaaccagcgcgtggccatcgccagggccctggcagtgcagcccgcctaccttctggccgacgagcccgtcagcggcctggaccttcccctccgggacaccgtcctgtcgctgctcagcagcctggtgcgcgaggagggcctgggcctgctcctggtcacccacgatctgggcaccgctgcccggatgtccggcaccaccgccgtcctcgcacatggacgcatcgtggagcacgggcccacccaccgggtgctggacagcccgggcagccccgaagcggctgcgctcgtgcaggcatcagcagccctgcactttccccccgccgttccggccggcgctgccccgtgacggctcttgaaaccacaggacagaccgccacagcgccgcgtcccgctcccgggctgctcctggccagccaacttgtcttcaacatcggcttttacgccgtggtgcctttcctggccctggtcatgacccgcgactttggcttggcggcaacggctgtgggcatcgtcctgggcgcgcgcgtcttcagccagcaggggctcttcctggtgggtggcatgatcacggaccgttggggtgcgcggcgggcaatgctggcgggctgcctggtccgggtttcgggctacctcacgctggccatggccggaagctttccgctgttcctcctgggtgcggtgctcacgggcatgggcggcgccctcttctcgccggcgctggaatcactggtggggaaggcggaagaacgacggcggagcaccagtgggaaggttccggcgctttttgcgctgctcgccatctgcggggagatcggagccgtggcaggtcccctgctgggtgccttgctactgggtgtttccttcacctgggccgcgctggccggggcggtggtcttcaccgtgatggccggggtgctgtggcaccgcctgcctgcggaagagccacgtcaggcaccggccatgcagaagcccgccaccccgctgcggccggccgcccggcagaccgacagaaccggagtagtcgaaaggaccggaagaaccgaggggacagccgcaatgcttcgggacaggcggtttgtggcgttcgccgccctgtacagcgtgaacctcctcgcctacaaccagctctatttcggccttcccatcgaagtggccagaaccggtgcaggaccagaggcactggccggcctgttcgccgtcgcgtccctgctgaccgtggccctgcagtggcccatctcccggctgacagccaggataggcgcaggacgggccctcacggcggggttcatcctcaagggcctggccttcggcaccatggccgtactggcccaggttccggccgccggcaccatgcagctcctgccgccactgcttctcgtggtgggactgtgcctcggccacatgtgcatcggcccggtggccatgccgctggtcctggcccgcggccgccggaccgggatctactacggcctcctcgcgagcatgggcggctgcgccgtactgctgggcaacattgtcctgggaccgctttacgcaggggccgcccagccggggcctgacgccacctggccctgggcgctgctggcggcactcacggtgattcccgccgtcggacttccccggctcctgcctgccacaacgtagcctgccagaacctggcgccggcgccggtagacccggcaagacagcatcccaaaaacccaaccgaaggaacaggtactcccacatgtccagaccccgcctccgcccggcactcaccggcctgtcagtgctgctcctggccacgagcctgaccggatgtttcgcagccggaaccgaccaggcagccggacccggcaccgattcaggccggatcaagctggccatgctccagccgccgcggtccggtttgtccccgctgagcgatgacgcgttcaagctgtcccgctggaaaactgccgaaacgctggtggagctggacgagctcggtgaggcacagcctgcgctggccaccgcgtggcagcagaccggtccggcatcctggagctttaccctgcgggagggcgtcgggttccatgacggaacagcgatgaccgcagcagaagtagcggcttcgctgacagccgcggcgcaggccagccccaagccccggatcctggacggcgtggagctcaccgcagaggccggggacgccaactccgtcaccatcaccacggcgacgcccgaccccctcctgccccagcggctgtccagcccccagctagccatcctcgcagcctcggcgtacggggaaggcggcgtggtcagcccggtcaatgccggaacggggccctaccgcctggcttcggtcgatggtacgtcctcggccaggctggaccggttcgaggagtactggggaccgcaggcggaagcggacggtgtggacgtccagttcgtcccggacggaaccgccagggccgccgcgctccggaccggcgacgcggacatcgtcgaagccatccccgtgggccaggtggcccagatcgatccggcgctggtgcacgaggtgcccatgccgcggaccaacacgctgtacctcaacacggcctcgggaccgtttgccgatcctgctgtccgcgccgccgcccgggccgcaatcgacgccgccaccatcgtggacagggtctacgaaggccgggcggacccagccgccgggctgctgggccccgcccttccctgggccgcggagcagcgaaacagcggggattacgcggccgccctggccacccgggcggcggcaaccgcggtcccgggaacgcccatccggctcggaaccttcaccgaccgcgccgaactaccggaggtggctgtccagctggagcagcagctggaggcagcgggcttcgtggtggagcaggacgtcagggagtaccagcacatcgaggcggatgccctggccggtaagttcgatgccttcatcctctcccgcgccacagtgctggattccggtgacccggtggcctacctgtacagcgacttctcctgcgccgggtccttcaacatctcccagttctgcgaccccgcggtggacgccgccctggccaaggccgcgggcattcctgccggtcccgagcgaagggccgccatttccgcggccgaaagcctcatccttgcccgcgacgccgccgtccccctgctccacgaacgcgtcatccagggcgaatccacgcgcgtgggcggagtggagcgtgacccgcgcgagcgcgcgctggtgaccagcaagacccggatcgccggcagcacaggctctgcaggctgatgcccgggggaacggcttttgtgaaagtcaccgtttcacgggtcctcgccctcgtggccctggtggcgctgatcggcatgatgccgtggctctcgggccgcggcgccgagtacaccatcctccgggcacggtactcggaccgggagccaacgcccgaggccctggccgccgttcgggcggaactcggcctggagcaggggccactccccctcttcgtgtcctggatccgtggcgtgttcgccggagacctgggcacgtcctggatcagcaacacgcccgtggcgcccggcatcgcgtcagccctcagtatctccgtgaccctgatggcctttgcgcttgccgcggccgccatcatcgccctgctcctctgcacacccgcggtaagggacgggctgcggcaaaggaggaggccggcatcgggagccctttccgcagccctcacctccctcccggagttcctgctggccgccatgctgctggtggccggcgccgtctggctccagtggttcccgcccttcgggtggaagggtccggagtacgctgtcctgccggccctgtccttggggatccccgcaggcgggctgatcggactcctgatgtcggacgccatccgtgcagggttcgccgaacagtgggtaggtacctggcggatgtccggggccgggcctgtccggctgagcgcggcggtgctgcgccgcgcactgcccgcagtgctgccgcagatcgggctggtactgattggactgaccggcggcgcagttgccgtggaaaaggtgtacgccattcccgggctcggccgggcgctgctcggagccgccagcgcgcaggacatccccacgctccaggcgggcatgctggcgctcatgggcctcgccctgctggtgggaacgctgacgacggcggcgcggtacctgctgatcgggcctgcggtccgcttcggcacgcttccgctcgcggaacctccgcggccggggaaccgccgccagctggccctgcctgcagcggccggcatcaccttgctcctggttgtcggggccgggctgctgcgcgatcccttcacctcggaccatgcaaggatcgccgctcccggctggtcgcttccgttcggtgccgatgccagcggacgcgacctgctggcccgagtggggcacggagccgtggggacgctggggaccgcgctggttgtggtgctggcctgcctggccgtgggaatcgtcgtcgggctctttccactggctgcggccggaccccttgaggtggccaacgcggcgccgcccatcctcgccggcctggtggtggcggcgctcagcggcccttcggcacacggcgctgccgtggcggtggccgccgtcagctgggcacccctggcggcgcacacggcggccctggcgcaggaggcacgggcccagccctatgtgcagatccttccggtgctgggggtgggcagggcgcggatcatgttccgttacgtcctcccggcggtggcatggccgctcctgcgccacgcaatgctccggctgccgggggttgcccttgcgctggcggccctcggtttcctgggactgggcccgcagcagccctcgccggagtggggactcatcctggccgagggcatcggctacgttgaacgcgccccatgggcggtgctcgcacccgcgtccgcgctggtcctggcgtcggtggtggcggtggggctggcaggagccggacacccagccaggttcttcgcccggaacagtgcgggagccgtcccgccgcccgggacaaatgtggcgccggagcacgtgcaggcaccggcaggggtgcggtaggcctccggggcagcagaaagcccgctgcctgctccgtttccggtgcgggcagcgggcctaataactgaagtcagcccctgcggtccagcgggaccggggagctgaaaagaagcgctgcactggtccaaagacgaggatccatgcattgggtccactggtgctgcggcgtcaccagggctgccccgttacggcagcagcaccttgcaacaactagccgatccgacgggtgtctacctcgtcgtcgtcttcttccaaatcatccgcgtacttatccacataagccgaatagtcaggttcgactggctcattcgcataatggctcgtggcacgactgcccggacccgtcagctcacgctgaagtgccgagtagtcagtgttcggggagtagtacttgatatcccgagcctgcttggtagcttttgccttttgacggccgcgccccatggcgtgacccccttttgtacttggaccggaggtggtcaccttggcgtaggtgaggccccggaatgtttggtcaatttgtcgtacacctagattacatgctttcgactgcccccgcttgccacgcgcggtgccctgaagtggcttgggttaccatcagggcgccaatccgcgggtttcccggttttttcttcggtagagtcgctaaaacatctgttgatatccgggcagcgggccggcccgccgctgcgcagagaaccaggaggatgcaccacgtgaaccaccaggacgtcccgcccagaccggcctcgccgcccgccgcgggcctgccgcgcgtgcccgcacccgcagccgaaccggtcttggacccccgcatggaaccggaggaccgaacggcagcgcattccgggtgggtcaacgggcggacgctgtggattgcagtcttcgtcattgtgctgctggccgtcgtcggttccctggtgtggcttgggctgtggctgaactcaaatcaggaaccgggcgcttccggaagtggttctgcaggggtgctggaaaccacggtggcgcctcccgccacggcgctgccgctgccccgcgagggcgtcgcgcccgtcgacttcgcactgggtgactgcttcaaggatttcgaccccgaggcactggcatccaccgtggtggcatgcgataccgggcactcggcccagctcgtggccttgttccggtacccggaggatgattcctatcccggcgccgaggcgctgaaagccaaggcgctggaagcgtgccaggccgccaggctgggcccggccgccaacgactacgacctcaactacgaacgcagcttcccgagcaccaccagctgggaatccggcgaccgcagggtggactgctacgtgacggcacccggcggaaacatgatcaacgcaagcgtgctgccctagcggccaaaccgccagggcagcacccgcgccttcttgcccttcggccgccctagtccttgcggcggacagagaggccgctgctgcgtccttctgcggccgggaggtccgttccggctgcggtgagttctcctacgtccgcggccgtgtccaccaccaccgtgtcgccgtcgctgatatcgccggccaggatggctttcgccaggcggtcgccgatctcgcgctgcaccagtcggcggaggggccgcgcaccgtacgcgggatcgaacccggagagggcgagccaggcccgcgcaccttctgtgacctcgagcgtcaggcggcggtcgcggagccggcgccccagttcgtccacatgcagctccacgatgtgcgcaagctcttcgacggtgagggcatcgaaaagcacaacctcgtccagccggttaaggaactccggcttgaaggatgcgttgacggtggccatgacggcgttccgcttggcatccgcctccagggtctggtccaccaggaactggctgcccaggttggaggtcagcaccaggatcacgttgcggaagtcaacggtgcggccctgcccgtcggtgagccggccgtcgtcgagcacctgcaggaggatgtcgaagacctcggggtgggccttctccacctcgtccagcagcaccaccgagtaggggcggcggcggacggcttcggtgagctggccgccctcctcgtagcccacgtaccccggaggcgcacccaccagccgggccacggagtgcttctccccgtactcggacatgtcgatgcgcaccatggcgcgttcgtcgtcgaacaggaaatccgccagcgccttggccagctccgtctttccgacgccggtgggccccaggaagaggaacgatccggtggggcggttggggtcgctgatgccggcccgtgcgcgccggacggcgtcggaaacggccgtaacggccttcgactggccgatcagccgcttgcccagttcctcctccatgtggagcagtttctggctctcgccctgcagcatgcgcccggccgggatgccggtccaggcggagatgacctcggcgatgtcgtcagcggtaacctgttcggcaaccatctgcgtggatttgtccacgacggcggcctcggcttccgcggcagcgttcagctcgcgctccagggcgggaatctcgccgtagaggatgcgggaggctgtttccaggtcaccttcgcgggcggccttgtcgtaggcgctgcgcagttcatccagcttcgccttgaggtcacccacccggttgaggcctgccttttcggcttcccagcgcgccttgagggcgtttagctcctcttccttgtccgccttgtccgcccggagtgcggccagccgctcaacggacgcggcgtccttttcgtcctggagggccagctcttccatggtgagccggtccaccagccgctgcagctggtcgatctcctcgggtgccgagtcgatttccatgcggagccttgacgcggcctcatccaccaggtcgatcgccttgtccggcagctgccggccggaaatgtagcggttggagagcgtggcggcagctaccagcgcggcgtcagcgatggtcaccttgtggtgcgcctcgtagcgctccttcaggccgcgaaggatgccgatggtgtcctccacgctcggctcccccacgtaaacctgctggaacctgcgctccagggccgggtccttttcaatgttttcccggtactcgtccagggtggtggcaccgatcaaccgcagctcgccgcgggccagcatgggcttgagcatgttgccggcgtccatggatgaatcaccggtggcgccggcgcccaccacggtgtggatctcgtcgatgaacgtcacgatctggccctcggagttcttgatctcctccaggacggccttgagccgctcctcgaactcgccgcggtacttggcgcccgccaccatggacgcgaggtccagggcgatgagggtcttgccgcgcaggctttccggcacgtccccggccacgatgcgctgggccaggccttccaccacggcggtcttgccgacgccgggctcaccaatgatcacggggttgttcttggtgcggcggctcaggacctggacgatccggcggatttcggcgtcccggccgatcacgggatcaagtttgccggagcgggccatggcggtcaggtccgtgccgaacttctccagcgactggaacgtgttctccggatccgggctggtgaccttcccgtcgccgcggacacccggcagggcggcgagcagcgcttcatgggaggcgccggcgtcgcgcagcaggcgggccgcggcatcgtttccggccgagaggcccaggaggaggacctcggtggagacgaaggtatcgccaagccggtccgcttcctccttggcgttctggatggcctgcagtgcggggcgggagagctgcgcctgctggctggatccgccggaggtggccgggagcgccttgatggcgctgctcgcctggacgctgacggagtccgggtccgcccccgtggcacggagcagcgccacggcgacgccttcgcgctggtccatcagcgccttaagcaggtgggccggctcaacctgagggtttccggccgtggaggcgttcatcgccgcagccgagagagcctcctggctcttggtggtgaatttgacgtccaaagagagctccttccgggggcagtttttatgaacttgagtctactacgctcaactttggtttggtgccgttcctggcgactgtttgcctacagcgaaacagctccgcacggccggcgacagaggcgagagaccctgttgcggcggggcgggtgctttgtcccccagcggacatccctacagcgggtagacggacactgctgcggccttgaccacaaggtgcaccgtcattcccggcaccagcccaaggtccgtcaaagcggccggcgtgatgtcagccgccagcccgccgccccgcacgcggacctggtccccatgcggctccaggtccgtgatggccaccgcgaaggagttgcggggactgccgtgcgcatcggtgaggaataccgaaacggccgacggcgggaacacggccaccgcgggccggccggcggggaccgggtcctcgctgtgtccggcaatatgcccgcggctggccaggatgccgtcaccggcggaggttcccaccacaaaattgagtcccgccagcccggccgcgaaagcgctgcgcggcttctgcaggacctgccgggtggggccttcttctgcaatccggccgctttccaggatgaccaccctgtcggcgagcatcagggcatccaggacgtcatgggtgatgatgatggccggccggtccgccaggacgcgcttgagcaggcgccggagcagcggggcggaatggatgtccagcgccgccatcggttcgtccaggaggaggagcccgggatccgcggcgagcgcccgggccaccgccacacgctgcgcctgaccgccggacagttcggctggacggcggtccgcaaggtccccggcttcaacatcgtccagccaccgcacggcctgctccattgcctggcgcctcggcgtccccgcgctccgcggcccgaatgccacgttgtcagcggcggtgaggtgcgggaagagcagcggctcctgggccagcagcgccgtcccgcggtgatggggggcggtccaccgctcccatccttcccccaggtggaacagggtccggccgttcagctccgcccgccccctgtccggccgcacaagcccggcgatcaccgagagcagggtggacttgccggcgccgttgggacccatcacggccaccgtatccgtggggccgagcgaaagggcggcgtcgaaaccgcgctcgtccacggctgcctggaacgagaacgtcacgtaagggcaccgcccggtgtggcagccgtcgtcggccgctcccccgaagcctgctggttacgcaccttcccgcccgggcgcctgtaggccagggccaccaccgcaatggccaccgccaccagcaccagggaaagcgcgacggcggcgtccgggtcagtctcgcgctgcaggtagatttcgagcggcagcgtccgggtcaccccctgcaggctgcccgcgaacgtcaacgtggcaccgaactccccgaggctccgggcgaacgagaggaccgccccggaggccagcccaggcaaaaccagcgggagcgtgacgcgccggaagacggttccgggtgacgcccccagcgtcgcggccacagcctcatacctctggccgccggtccggagggcgccttcgaggctcaccaccaggaacggcagggccacaaacgtctgggccagcaccacggcagtggttgaaaacgcaatctgcagtcccagcacctcgatcgccccgcccaggagtccctgccggccaaacgtgtacaggagggcgatgccgcccaccaccggcggcaggaccaaaggaagcagcaccatcgcgcgcaggagccccagcaggggaaacctgccgcgcgccaggaccaccgcgagcggaaccccaagcacaatgcagagggcagtactggccgcggccgtgcgaaggctcaggcccagcgctgccagggcgggaccggacgtaaccagcgggatgaagttggcccagttgacccgtgccaccatcgccgcgagcgggaggaccaccaccagggccgccaggactgcaagtgcatacagccagcggggaacgccggtatacgcctggcgtcccgcgtgcccgccggtcacctggcgcccatcgtgtggaagcgcatcatacgggacccggtccaaagccgtccgccgccaggacctcctggccttcggggccggccagaaggtccaggaacctgccggccgcggcttcgttgcggctgccggccagcacagcggcagggtacgggttcactgcggcggatgcctccgggaaggggatgccctccacccgggtgccggccgaccggacatccgtgacatacacgagccctgcatccgcttcaccggagatgactttgcccaggacgtctgttacggagttttcctcgctgaccgggctgagcacggtaccggtactgtccgccaccctggccgcagctgccccgcacggtacttgcggggcgcaggccacaagcctggtaccgggtctgcccaggtccgcgaaggagcggatgcctgccgggtttcccggcgggactgtgatggccagggtgttggtggcgaagtcgcgcggttcgccgtgcaccaggccggcctcctgcacctttgccatggtgccggcatccgctgacgcgaacacgtccgcgggcgctccctggctgagctgggtggccaggtcagctgatcccgcgaagctgaaggtgacggtgatgccggggttttccgcttcgaagcgttcggcgatctcggtgaagctgctcttgagggaggctgccgcaaacacggtcagtgtcccgttactgcccgtcccgccccctccggcgcagcccgcaagcgcagtggtcaggagcagcgccggcagcacggcggccggcttccggctccgcttcacagcgccttgccccggggagtttcgatgatgaccgtggtggccttgaccaccgcggtggccacggaaccgggttccagtcccagctcccgcacggcctcgctgctcatcagcgacaccacgcggaacggtccgcactgcagttccacctgggccatgaccttgtctgcggtgatgttggtgaccaggcccacgaaccggttgcgggccgagctgcccgtgcggtggggatcgtccggaagctgcgcgagcttctgcgcatgcagggccagctccagcccgtcgactgccagccggccggcgtcgtcctttaccggggtgaggctcccgttctccgtccagcggcggatggtatcgtcactgacgcccaggaaccgggccgcctcagccacgcggatgattgtcatgggaccactctagtccgcaattgcggacgatgcaggagtttatggccgcatctccgggtgcatggtgttcgcggtattgagttccccggactgccgggcccgtgcgcttcctgaccggtgcgcgctcctgcccggatgcctccaccgacacgcccaatctgccggcgggtcggggaggaaaccggctgccaccgtcaggtaaccgggcaggagcgcaccgcctccgcacggcacagccacactagacttcccccatggccatcttcatcgacccgccgctgtggcctgcgcacggaacccacttctcccacctcgtttcggatgagtcactggaggagctgcacgtgttcgcagccgcggcaggcatcccggagcgggcgttcgacggcgaccattacgacgtcccggagcgccgctttgaggacctggtggcggccggtgccgttcccgtcgaagcccggatcctggtccgcaagctgatcgccagcggcctccgtatccccgcccgccggcgcaacaagtcgttgaaggttccgctgctgaaccgctggaacacggtgatgcccggccatgacgccctcttccttgacctgctggaccggtggagcgagccccaccgccggtaccacggctgcacccacctgctgtccgtccttgaatccctcgacctgctcaccgatccggccgacccgccacgcacggtcctgctggcggcgtggttccacgacgccgtctaccgcggggtggccggccaggatgaggaggagtccgcccgcctcgccgaagagcgcctgctggcggcagggcttccggaggctaaggcgtacgaggtggggcggctggtccggctgacctcgtaccaccggccggagcaaggggacgacgacggcgccctcctctgcgacgccgacctctccgtcctgggcggggaacctggggagtacgcacggtacgttgcggccgtccgccaggattacgcgcacattggcgacgctgacttcgccgccgggcgcgccgccgtcgtgcgccgcctgctggaactggacccgctgttccacagcggcagggcacaggagctgtggctggacgccgcgcagcgcaacttgaagggcgaactggcgtgaacgcatccacctccaacacccgccacacaatgacggccagcgcggcgcaccggcaactggcctacgccgtccggatggagtgggggctcgacggcgccagggcagtagcgtccggcgctgaccttgccgtggtggtggacgtcctgtccttcagcacctgcgtcagcgtcgccctggaccggggcgcggaagttttccctttcccgtggaaggacaccggcgctgaggacttcgccgcacaccacggcgcgcaactggccggtccccgcgacgggggcgggctcggcctctcccccgcaagcttccgggcagcggaatcgctggaccgggtggtcctgccgtcacccaacggttccgcgctctgccacgaactcgcccgcgaggtacccctggtggccgccgtgagcctccgcaacgctgcggccaccgcggagtgggtggcggccaacctccccgcggatgccgtcatcgcagtgattgccgccggggagcgctggcccggcggcggactccgccccgccgtggaagaccagatcggcgcgggcgcgttcattgccggcctggtggccgcgggcaagggcgggtacgagcccgaggacggccggcacggttactcgccggaggcggtggcggccatggccgccttcgaagccgcggagccgcgcctccgcgaaatgctccacggctgttccagcggccgcgaactcgccggtgggggttatggggccgacgtcgacatcgccgccgaactggacgacagcgacgccgtggccatcctggtcaacggggtgttcagtccccgctgaccagtgctgtcagcgggctggcctctacacggaggctggcgcccaggccggcaggcgaaatggccggcagctcccgcctaccggtaggtggaaacgaacggctggctagtgggtacgatctgtttgcccagcggcatcagggacaccggaatgagcttcaggttggcgatggccagcgggatgccgatgatggtgactgccatggcgaaagcggtgaccacgtgcccgatcgcgatccagacgcctgccaccaggagccagatcacgttgcccagcagcgggaagacgccggtaccgccgggcttgtccaccacggtccggccgaagggccagagggtgtaggcggcgatccggaacgaagcgatgccccaggggatggtgataatcagcaggcagcagatgacaccggccgcgaaatatcccagcgcgagccaaaacccgccaaaaaccagccagatgatgttgagcagtgtcttcattcatccattgtgccccggggccgccggcaaacagctcaggggcttccctgagctgcccctgaaccggaaaccgcagtgccgcctataccgccgtgccgctcaaaccgcagtgccgcctagaccgtggactcggctttcgccgcgtgcacgaaggcgcggaccttggccaggtccttgacgccgcgggatgcctcaacaccggaggacacgtccactccccaggcgcgggcgccagctgatgccttcccaacattctccgggtccaggccgccggccagcagccagctgcggccctggaggacagggaggcccgccaccgattcatagtcccaggcttcgcccgagccgggaacggcggcgtcgatcaggagcaggtcctcgccccagtcctccagttcctcgggcgtggcacccaaggtgacggccctgaccagcttcatgccggcgtcgtgcacggtggcaacgtccccgcgggtgcgcgtgccgtgcagctggatccattccaggctggcggcgcgggcaatggccacggcgtcaacaacgggctcgtcacggaacacgccgatagccaaaacccgttccgggatctcggccagcagggccgatgcctgcgaaggcgagaccacccgcgggctggcggtgaggacgaaacccactgcatccgctcctgcgtccaccgcttcgcgaacagattctggcgtgctgagaccacacactttgacgaacattcccggctccttcaggctgttttcgtgttgtccccccggaggagagtagcagggaaggatgggggctgccgacacctgctgtttgcaccccgccgtggggcgggcaactaggctgaacaaatggagatcatccgctttgacgaccttaaatccgaaccgtggcgcaacggcggcggggtaacacgccagatcgcgggccattccggcgccgcctccggacagggcgacgcctccaaacacgactgggactggcgggtcagcatcgccgaggtcagcaaagccggggacttctcgccgtttcccggaatggagcgggtgctcaccgtggttgagggcgagctcctgctgctcaccgtggacggtgctgagcatcccctcgaaaagtaccgtgcgttccggttttccggcgaagccagcaccacctgcgcccttcccacaggagacgtgcggaacctgaacgtcatcacccgggcggggaagtacaagggttttacgtccatcatcgagctctcaaagaaacgggcccatccccttttcgccggccagctgggtgtcctgctgcagggccaggctgctgctgccgccggttctgaggccggggccgcaacagggaccgcaggacctgggccggtggccctggaccgctacgacgccgtggtgggctcggacagcggctccccggagatcctgggccgcggcttcctggccgttgtatccatcgatgaggttactggctgaggctgaaccgcccaacgtccaccacggcattgttccggcgcgcttcctccgcggcgaacacggcggcgtggctgaccagggactcgtccagcccggacaccactcctgaccagtcgccgccggcgagcgcggcaacccaggcgaagatgaggccgcggtcgccgccttcgtgtttttcgccccggacctgcgcattggcagccggaacagggtggacggcggttgttccggtcaggaagtcgtagacggagatgactccggcctcgatggtgatctccccgtggctgccgaagacgcgtgtccgccgcgggcccgcggcggtgaaggcagtggcggtgaacgcggcagttgtgccgtcgtcgtattcgatgttcaccacctggtggtcaacgacgtcgttgtccgagaaatagacgcagcggccgtaggggcccgtagccagggcgtgcagcagtgactcgggagttccgccaggatccacgacgtcggcgaagtacgcccgtgcggggtccggcctgccgccgttcgatggccgcccggacccgtagatcttcagcgcggagtaggggcagcgtggttcagccgggcagtcggtgcagcgccgggctgctccctccggcgccccctcgggacggaagtgtgccagctgcccaaaggaggacacccgcacgggcctgctgccgatgatgaaggagagccagtcgacgtcgtgcgtgcacttggccagcaggaagggacttgagctttcctcgcggcgccagttcccgcggacgtaggaatgagcgaagtgccagaagccaacgggttccaggtgctggatggaaatgatccggcctaccgcgccgccggccaggagctgcttgagcaggaccgtcagcggggtgtaacgcagtacatggcagaccgttgccctggtgccggtttcacggctgatgcggtcaaggtcggcgcagccggaggggtcgacggcgacgggcttctccaggaggatcgggtagccgtgggctgcggccgctgcgaaggggcctgcatgttcacggtccggtgtggcgatgatgatgccgtcggccggcaggcgggtggccagcatcgtcttccagtcctcgtaaaccccgctgtccgggaccccgagttcttttgccagggggccgcgcagctcggcccgcggctcggctaggcctaccacagtggcgcggccggtggcggcggcgagccgcgcataagcggcaccccgggctccggcgccggcgatgaggaggcgaaccggccctgcgtgcttgccggcggcgccgtcgtcgttctttgcggggaaggccggcggcagggcacccacggttcagccgttcccgggatcggcgagccattccagtgccacggccgctgtccatgactggtccatgctgcccagcggttcgccggtgaagggttcgtagtactcaccgaagtggccctccatgagctgcgccagggaggcctccctcagttggccgtagcgcttcccgtcaccgcgcctgcgcaggcagtgggccaggtaccagttcatcaccggccacacaggtccccgccagtactggcggggcttcaacccttcatacgtggtggacgtggaggcgggcagcgggaaggccaggtgcgggtcgccggtccagtcgggcccctcgaagatctccagctgcctgtccaggagggcctggtccgcggtggaaaccaggggcgcgaaccccgccatagtgggcggcccgatccattcgcccgtcagcacatcccggtcccgcgcaagtcccgtctccgcatccacggtggcgtccacgccgtcgcggaattcctgcgcccactgccgcagctggggcgcttcctcgggcaggccgaactgttcagccagcacggcgaggtcctcgctggcggcggcaaagatcgcagacataaagacatccttgacctggaaggacatcacccccggcagccgggcgtcgtcgaacccaacgccggccatctgctgcaccagccacaggtagcggctgtactcctcgtcgctgggacgctggctgtggtccgtgaccttcaaggtgtccgtccggacgaacggctccatctcccccggctggaccctggagtacgggccgtcgaagcgcggcgagttgtccatcccggactcccagccgtggtagatggtgagcaggcccgagccgtccccgccgcgggcgctccgcagccaggcgtgccagtcgatccattgcggcagcgtccgccgggtgaaatcctccgcgagcctggcatcctcgccgcccgccgccgtcgccctttccacgatgcggcgcagcatggtggcgtggaccggcggctggcagatgccgctggactgcacgccctccggcgaaacgccgcgcgtcccccaccggtccacgtcggggaagtagccggggacgtcggagaacacgatgtgcgggatcatcccgctggtccactgcgcggccaccaggtagtccagctcctgcagtgcgcgggccacgctcacggtggagaggccggtggccacgaaagcggcatcccagctccacatgtgcgggtagaggttcggcgccgccgtcaccatggtgccgatgtcgttcgctgccaggacgtccctcgcccggctccccagctcctcaagggttcggatgggatagctgtactggctgcccccgtccggcgccgggctcatgccgtgagtccaagctgggtttccgtgtcgaagaaccggatggcggactggtcgaagcgcagccccaccttttctcccggggagacgcgcacggtggaggccacctgcactttgatggtctgcccgcccaggtccacggtcagcagcgtggcgtggcccagtggttccaccacttccacggtggcgtccagggtccccggcgtgccgcggtcctcgagatagatgttctccgcccggattccgaccatcacggggaggcctccggaccgggctgcggagtgggccaggaattcgggggccttggtgctttgaccggcgacttccagggcgccctgctgggtgacgcggccctccaggaagttcatgggcggggagccgatgaaccctcccacgaaccggtcggcgggttcctcatagaccgtgatggggtggccaagctgagcgatctgcccctttttcatcacggcgacccggtccgagaggctcatggcctccacctggtcgtgggtcacgtagagggtggtggagcccagctgctggacgatcttcttcaactccgcccggaagtcaaggcgcaggagggcgtcgaggttggacaggggctcgtccatgagcagcacgtcggcgtccatgacgatggcgcgtgcgacggcgacgcgctgccgctgcccgcccgacaactgggctgggtaccggtccaggtagggggtcagctggagcaggtccgctgcccacgcaaccttcttttccagttcgtcccggggaaccttcttcatgaccaggccgaatgcgatgttggtgcggaccttccggtgcgggaagacggcgtaggactggaacaccatggacaggttccggtcctgcggcggcaggtaggtcacgtccctgccgccgatggagatgcttccctcgtccgggaagtccagcccggccaccatgcgcagcagggtggtctttccgcagcccgaaggccccaggagcaccatgaactcgccctcggcaacatcaagggacacgttgttggtggccagctcggtgctgcccgggtaggtctttttgagacccttgatcgagatgtcagccatggaacagcctctctggaacgcactcagcggatggtggagccccacatgttggtgaggtagcggcgcatgaagaagatgaagatcagtgccgggatcaccagcaggaagccgccggcaaaccggtaggccagcggagactcggcgagggaactgaggacctgggccggcagggtgcgctggttcagggtaaggatcgacgcgcccagcacctcgttccaggacatcacgaaggtgaagatcgaggccgcggcgatgcccgggatggccatgggcatcaccaccttgaggaaggcctgcaccgggctgcagccaaagatccgggcagcttcctccacgtcgcgcggcacgcccaggaacactgaggaggtgatcaggatggtggtgggcagtgccagtgccgtgtggagcaggacgactgccaggacactgtcgtacagcccggtctggaggaagagctgggccagcggcacggaaagcaccacgatgggcagggcccgggtgaacagcaggaagagctggtacgggtccctgccggggaaggcgaaacgcgccacggcgtacccggccggaacgccgatgatcagggacagcaggagggtgaagatgcccacctggacggagttgataaggccgcccaggatgcccgtggactgcaggaacgtctgcatggtctcaagggagaagttgttcggaatgaagctcagcgggaactcctgcagggccgccctgctggaggtggcggacagtgcgatcaggtagatcggcagcgccatgaagagcgtgatcaggatgcagcccacctggagcagtatccggttccggcgccgctttgccagcggcctgcggtccacctccggctccgggcggcctgccggagcggttgccttgttggtggtggcgtggctcatcgcggggcctccgactggtctttcaggagcttgagatatccgacggcggtgaccatggacactgccatgaccaccagggccagggccgaggccacgttggcgtcctggagcccggtgtaccagcggtacgtttcgccgaccaccagcgggaagttctgcccggtgagggccagcgccaccgcgaaggtctggaaggccaggatggtccgcaggatcagggcggtctggaggctgggccgcagcagcggcagggtcacgtgccacagccggtcccagaagccggccccgaaaacgccggccgcctcctcatagtccttggggatggactgcagcccggcgacgacgatcacgaacaccagcgaggttgcccgccaaacttccgcgatcagcacggccatgaacatggaggcgtagttgtcgtaggcgagccaggagaccggttcgaggcccacggaggcgagcacggagttgaggtatccgcggtccgtgaagaccgtcagccagaccaggccggcagcaaggtcgctgaccgccagggggatggcccagatatagaagtacaccgaggatccgcggggtttggcccggatcagcagggccatggccagcgccaggacgaactggatggggatcatcaccacgatcagcagcaacgtgttgcccactgaagaccaaaagtaggggtcctgacccatccgggtgaagttcgccgtcgtcagtccttccgggccgccgaacgcctggaggatgccgctgaccatgggccagccgaacagcagggtcatgaagacgatcgacggggcaatcagcagcattgccgccgaggttccgctcctccgcggcggccggccgcgcggcctggctggccggggcctgggcctggacctggcggctgcgggcgcgtccggggaagccatcacgcaaccctgcactggtcagcgtcgggatccggggcccagcagggaacattcagcgtgtccatgatgctggccaggtccgccccctggcggtccagcgtcgccttgacgtccgcgttgttcaggcagatctcctggaagcagttcttgaacagttgcgagacctgcgggtccttgtcgcccaggcccaccggcgggagcgcaaggatggcgtccggggcttcctgctgcgctttgacggccttggcctccagggcgatgccgcccgggaggtcgcttccgatatccgcctccaccaccgggaagaaggcgttggacttcagcgtctcgatttgcgcctccggcttggacagtgccttgatcagctcgaaggccttgtccttttccggcgaaccctggggcacggccattccgccgacgacgagcaggtagcccttgcccttcggtccggacggggcgggcaccatcagccagtcgtctggcttgtcctggaccgcgttgatgaggcgtgccacgtggtcccacgccaccaggacttccccgttgcccagcggttcctgcatgaagtcgtaattcgcggaggccggattcatgttggcccacaggtcacgcatgtaggtccaggcggtgacggcgtcggcattgcggaacgtggtgatctgcccgccggtaaagctggggagcaggaagccctggtagaagcggtggtggagtcccttcggcccggcgggaatgccgaacaccggacggcccccgttcgccgccttggccgcctgggcccacgccaggaagttctcgtaggtgaggttgttgacgtcggcgcctgagggcagccagtccagcgccttcttgttgaccgccaccacgtacgtcgcctggatccaggggatgtagcggggagaatccgttccgagctttgccagctccagcaggtcgtcggagtagccggcagacgaaaggtcgctggtcagggagctgaggtcctcgaactgggatgcaaaggggatgaggtcgctgtgcaggcccgctgcgatgcctatttcaaccttcccggcggcgagctgggacttcagggtggtgttgaagacgccggtgtccacggggttgtaggccacctggatatcgccggcgaacttcttcagcgtggcttcatatttctgccgctcctccacgggggagaactgggtggaaaggaagttaacggagccctcacctccgctcccgctggtgttgacgccgcaggctgccagcagggggccggtggccagggccatcaaccctcccttcagcatggtccgccggctgaggtcgcggtgggcaagatccgacattggaacctcctgctgcgagggcagatagtatttttgtctgatggtcgatcataattgtgtgatccagaccacgtcaatggccgggccgcggcgctgacaggccacagatgcaaaggaagcgggcatgatgacccagcagaggacgctcgtcggcggctccggccaacctcccgtggggcccgccaccagcgccggccacgtcctccagctcctgcgttcaagcccggacggatacagccgggcggacctgctggacatcacgggcatggcccggtccaccctttatgagcggctggacgcgctcttcgctgcggggctggtctacgaatccacgccactgcgttcccagcgcggcaggccgccccgggccctccgcttcgacgaccgcaacaagctggtcctcgcgatcgagatcgggcacacccacgccagcatccacctcctgtccctgggccgggacatcgtggcctccgcccggctgcccatcgagatcagccagccccaggaaggcgtggtcaccagcgtcatcggggaagccctgcggctcctcgacgggcggcagccggtaggagcaggagtggggctgccggccccggtggaccccctccaccggctgggcctggaacgcaccgtcctggcccactgggaccttcagcgcctgcaggacgtcatggaggcgaggctcgactgccccatcctgctggaaaacgacgcccgctcgatggccgtcggcgaggtccgggagccgctcgagtcccttgtggcagtaaaggtgagcaccggcgtcggctccggcatcattgtgcggggagccctggtccgcggcgcgcacggggccgccggggacatcgggcacgtgcggattcccgaggccgcgggccgccgctgccgctgcggcagggacggctgcctcgcggcagcggcgtcaggacgcgcgctcctcgcggaaccggaacttgccggctacggcaccctgcgccagctcgtcgatgcgtgcggcagcgatcccgccgtgcgctccgccgtcacggaagccggacgggtgctgggacgcgcgctcgcagcgacggtggggacgctgaatcccggccggatcgcagtgggcggactggtgggggtacttccggatttcctggcggcctgccggcagcagatcctcgacgacgcttttgaaccgtccctggtggaccttgaggttgtctccgcggacagcaagacggccacggctgtgggactgtgcaagctcgtggaggagagcctctacgcgccggagcgggtggaacagctgctggcgcagcgggccggctgagcagggtgtcacagggcagccttgccttgcagaagcagagcctttccacactggtggctcccccgggccgtccctagactcgggctatgaccacttcaacgttcaatgcgctcctgtccacccagatcggcaacgagttcaccgcgtcgcagcagtacattgccgtggccacctggttcgccaaccaggacctcccccagctggcgcgctacttcttccgccagtccgtggaggaacggaaccacgccatgatgatggtgcagtacatgctggaccgggacatccccttcaccatccccggtgttcctgctgtccgcaacgacttcgcctccgtcaccgagccgctggccctcgcactgcagcaggagaaggaggtcacccgcagcatcgaggacctgttccgggctgcccgcggcgaaaacgatgccctgggcgagcagttcatgctgtggttcctgaaggagcaggtggaggaagtggcgtccatgaccaccctgctgaacatcgcggagcgtgcggacaaccttttcgacatcgagaacttcattgcccgcgaaaccatcggcgacggcggccgtgacacctctgctcccgaggctgccggcggaaccctctagccccagcctggcccaactaagtagcactaagtgtcgttttggaggctcaaacgacacttagtgctacctagttggggtggagggcaccttggtgaggttgggcaccaaagctgcccgccgtcgtcgggcgttgctacgctggaaaccaaggctccgcacctgagcctccggacgacggttcagtacccggaacgcgacaagactggccaaaggatctgccatgtcgtggttaatacttcttctctccggtgcgctcgaggccgtctgggctgcgtccctgcaccgcgccttccaggcttctgggcggaagcgcctcgcccccgccgctctcttcctggtctccgtcgccgcgagcacgggcggccttgccatcgccatgcagtccatccccaccggcaccgcctacgcggtctgggttggggtgggcgtggtgctgacctccgcctacgccatggtcaccaaggtggaacgcccgacggcggcgcgcctcctcctgctgtccggcatcgccgtgtgcgtggtgggcctgaaggtggtggcgtaatgctgccgcgttcactcccctggctggtgctcctggcctcggctgtcctcgaagccgtgtgggccaccgcactggggctgtccgacggcttcagccggcccgtgcccacccttgttttcgccgtgacggccaccctgagcatgctgggcctgggctgggccatccgcaccatcccgctgggcagcgcctacgctgtgtgggtgggcatcggcgccgcgctgacggtgggctgggcgatggccaccggtatggagccgttcagcgtgctgaaggttgtgttcattgccgggatcgttggctgcgccgccggcctcaaggcgctgccgcaggaccggtagaacccctcagcaccaggtcggaccccaggaccaccggcgagtgcgtggtctgttcaccggccatctcggccgcgagcgcatggaccgcagcatgggcgatcgccgcagcaggctggcggagcgtcgtcagtggcggatcggtgagcgccatgagcgtggagtcatcaaagcccacgatggatacgtcctcaggcacccgcagccccctggcccgtgccgcacggatggcacccagcgccatgacgtcggatgcacacacaatcgccgtgtggcccgagtcaaggagttcgttggccgcgctctgcccgccttccaccgtgtacatgctcgtggctgtgtggggcgctggatcgtcgacgttcaggtagtccgccagcgcagagcggaagcctgcgagtttctgccggctgggaatgaaacggtgcgggccgattgccagtcccaccttccggtgccccaggctggccaggtgctggaccgccgtcctgatcgcggcggcgtcgtcattggacactgaggccgcaccaagctcagggcgggggccgttgaccaggacgtacgggatgccccggccccgcagccggtggtagcgctccaggctggcctggccgtccgcgtgggcgctgcagatgaagatgatgccggccgccccctgggccacgagcatctcgatgtactcgtcctccgaccggcccccgccgggcaaagcgcagatgacggggatgaagtcctcctgggagaggagggagacgactgcctgggcgattgccgggaagatcgggttggtgaggtcagggacaatgattcccacctgccccctggctgcgctgcgggtgcggtcgggccgctcgtacccgagatcgtccatggcagcgaggactgactggcgcacttccctggacacgccttttcgcccgttgaccacccgggacaccgtggcgatgctgacgccgaccttccgcgcaaggtcttcgagtttcggccgttcggctgcggcgggttccgccccgctcccggtcatgctcatgatgctccttcgccggaacaggattccggaagtctcgtgcttcccagtgtacggaaaacggcagacgcaccgagtgaaaacaaggcgtgaaattttcagcaaaccgttgacgtgtggatgtggcgaaacttaggctcgtgggacaccccgctccccaccgttgccgttcggggcgtttccaaggaaggtcttccatgtcccacaagtccctaccagccgggccaccgcctgcgctcaacagaaaactggcagccgccctggcggcagcctgtgccactccccttgcactgggcggcctcgccctcccggcctccgcggaccacaccgccgtgccccaggccgtggccctcgtcggttcgctgcagtccgaaatcggctgccccggagactggcagcccgattgcgcagccagcatgctgcagccggtggaaggctccgcatcgctctaccgcgccacgttcaatatccccgcgggcacgtacgggatgaaggttgccctgaacaattcgtggggtgaaaactacggtgcaggcggcgcggccggcggaggcgacctggtgctcaatgctccgggcgggcccgtgaccttcacctacgaccacgccagccacgcactgacggacgacgtccctaatgccctcggcaccgaggcaggcgcgcactggttgtcggcggacatcatcgcctggcaggcgccgactgccgacggaaccacctaccgtctttacagcgcgcccgacggcggcctggcggtggcggacggccaggtcaccggcggcagctacgtaccacttgagaagaccggcgacgtgctggatggcgcctttgcagccaagtatccccacctcgccggattcgcctccctgcagctggcggcaggtgacgcggcccgggcccaggacctgttgaagggccagttgctcgttgccgcgatcggtgcggacggccgagtcaccgccgccaccggagtccaggtccccggggtcctggacacgctctaccagggcgcggcggggcgcgaactcggacttgcctggaagggcaaccggccggagctgtccctgtgggcgcccacagcgcgcagcgtcaccgtccacacctacgcttccggctccggcggtgatcccgtctccagccgccccatggaaccggcgcaggacggcgtctggtccctgaccggtgagaaggactggaagggcgcctactacctgtacgaggtggaggtctttgtcccggaaaccggcaaggttgaacggaacctggtcaccgacccctacagcgtgggcctttccgccaactccgggcgcagcctgttcgtggacctggaggacaagtcgctggcccccgagggctggaagaagctgcagaaaccggcccttaccaagcccgaagacctttccctctacgaactccacgtccgcgacttctccatcacggatgaaaccgtcccggacgcgcaccgcggcacctataaggccttcacggacaccgacagcaacggcatgcggcgcctccgggagctgacggccgccgggatgaacgcggtccacctgctgccggtcaatgacatcggcaccatcgaagaacggcgcagcgagcagctggaaccggcctgcgacctcgctgccctgccggcagattcagaggagcagcaggcctgcgtcgcagagactgcagccaaggacgggttcaactggggctacgatcccctgcactacacaaccccggaaggctcctacgccaccaacccggacggaaccaccaggatcaccgaattccgcgagatggtggccgccctcaacacagccggggcgcgggtgatccaggatgttgtctacaaccacacctcgagtgccggccagtccgggagcaacaacctggaccgtattgttccgggctactaccatcgcctcaacccagccaccggatcccttgagacgtccacttgctgcgccaacacggccaccgagaacaccatgatgggcaagctcatgatcgattccctggtgacccttgcccggacgtacaagctggacggcttccgctttgacctcatgggccaccactcgaagcagaacatgctggacgtccgggcggccctggacaagctgaccctggccaaggacggcgtggacggcaaggtcatcaccctgtacggcgagggctggaacttcggcgaggtggccaacaacgcccggttcgtccaggccacccaggaaaacatggccggcacgggcatcggcaccttcaacgaccgcctgcgcgatgccgtccgcggcgggggccccttcgaccccgacccccgggtccagggcttcggatccggcctgtacacggatcccaacgattccccggccaacggcaccccggaacagcagaaggaagcactcctcttggcccaggacttggtaaaggtgggcctgaccggcaacctgaaggactactcctttgttgaccggaccggcgccaccgttaccggggcggacgtgcggtacaacggcgccccggccggctactccagcgacccgcaggaggccgtcacctatgtggaggcccatgacaacgagacactcttcgatgcccttgcgctgaagctgccgcaggacacggcgatggctgaccggacccggatgcagaccctggccctcagcaccaccgctttcggccagggcatctccttctggcacgcgggcggcgaggcgctgcgcagcaagtccctggaccgcaacagctacgattcgggtgactggttcaacatcatggaccacacggacggcaccaacggcttcggacggggattgccgcccaaggcggacaacgaggacaagtacggctacatgcgcccgctgctggcggacccttcgcagaaaccggctgccggcgagatcgcagaagcgcgcggccgggctgctgagctcctgcagatccgcaagagcacgccgctgttccacctcggcgaggccggcctggtccagcagaaggtgtccttccccgacggcggtcccggacaggcaccgggcgtcgtggtgatgcacatcgacgactccgtgggcccggacgtggacaaggacctgcgcgggctggtggtggtcttcaacgccgccgatgacgccgtcagccagacggttgccgctacggcaggctcggcctacggcctgcacccggttcagtccggcggcgtcgatcccgtggtcaagacggccagccacgatcctgcgaccggaactttcactgttccggcccgcaccgtggcggtgttccagctcggctaggcccgcccagctgtcctgcctcttcaactgaataacccaccgctgagtctccccgccttcaaggacggccgacggcgtgtcccggcgaaacgccgtcggccgcgtcatgtgccgcgcgaaaggcggggagactcagcggcttctgcgtgggccagcagtttaggcttttgctatggactcccccgagatcgccgaggccgttgctgcgctgcgcgatgccttgagcggcgccccgcacggagggcggcggatgctgctgggcatcgcgggcgcgccgggcgccggcaagtccaccttcgctgcctggctgcagcagcagttcgggctcgggcaggctgtggtggtgcccatggacggcttccacctgggcaacgccatcattgagggcacgccgttgcggcagcgtaagggggccatggacacgttcgacgccggcgggtacctttcgctgctgcgccgcctggtgcggcgggatgaggcagtggtttacgcgccggagttccgccgcaccctggatgaaccggtggcggcctccattgccatccctgcggaagttcccctggtaatcacggaaggcaactaccttttgtttgagcaggaaccctggaaggacatccgggcgcagctggacgaggtctggtttgttgatgtgcccccggcactgcggctgaaccgcttggtggaacggcacatatcgttcgggatggagcgggccgcggcagaagcctgggcagccggcccggaccaggccaacgcagtgcttatcgaggccacccgcccggcggccagcaggattattccctggcaatagggggttaccactaccaacggcgtctggaacagcgccggcaaaggcgaagaaacaggagaactgatggcacacgcggtaaccctcggcgacggactcaacgtcagccagctcggcttcggcggcatggccctgacgcccgtctacggggaggtggaccaggaagacgcgctccggactctgcaccacgccgtcgactccggtgtcagcttcatcgacaccgccgacatctacggcggcggcagcaacgaggaactgatcgcccagctgctgaaggcgcggcgggacgaggtccagctggccaccaagttcgggctggtgggcacgccggcggacggctacacggacatccgcggcgacgccgactacatccgccaggccgtggaccgcagcctgcgccggctgggtaccgacgtgatcgacctttactacatgcaccgccgcgaccttcgcgttcccatggcggaaactgtgggagccatggcggagctggtgcagcagggcaaggtcaggcacctggggctgtccgaggtgacggcccaggaactggaggaagccagtgccgtgcatcccatagccgctgtccagagcgaatggtccatctggagccgcgacgtggaacgcaacgttgtccctgccgctgccgccctgggggtgggcttcgtgccgtattcgccgctgggccggggattcctcaccggcaccgtcgacgcctccagcctgggggataacgacttccgccgccggatcccccgtttcgcccccgatgccgcaggcgccaaccaggcagtggtggacacggtgcagtccgtggcggacagcttgggcgcgacgcccgcgcaggttgccctcgcctggctgctcgcccagggcaggaggctggggctgcccgtcgtccccatccccggcacccgcaaagcccaccggattgacgagaacctcggcgccctggacctggaactgaccccggcgcacctggacgcgctcggcgaagcctcggacgccgtcgtcggctcccgttccgccgaccctgcgtgggtgtccgaggggcgtgaatagactcaagcccatggactcactcattcacgacctgcgtgacatcaccatccgccggatttccgtcagcgagatggacaacaacgtgtacctgctgactgccaaagccagcggcgaacaggtgctgatcgacgccgcggatgatgcgccagccatccagcagttgctggcagacggtgccgcggacacgtccgcggcaccgcgtttggcgctgatcgccaccacgcaccagcactgggaccacgtgcgggcactgaaggagctcgtggaggccaccggtgcccccaccgctgcaggaacggacgacgccggcgcgctgccggttgcggtggaccggagcctggagcacggggacacggtggccgtggacggcttttcactgatggcggtccacctgcgcgggcacacgcccggctcgattgcctttgtttatgaggccccggaaggacccgtgcacatcttctccggcgattcgctgttccccgggggcgtgggcaacacccagaaggacccggaacggttcaaccagctcctcaccgatgtcacggagcggctgttcggtgcctacccggataacaccgtggtgcatccgggccatggcaagccgacaaccctgggggccgagcggccccatcttgaggagtggcgcgcccgcggctggtgacctgccgcgggggcgggtaatccggttaaaagccgacgggcccaaccatccctggttgagcccgtcgaacttagctggtgcctagcggctgcgccgttcgttagacgccggagccgacgcgcggcgggggccgctgcgcgcgggacggccggagccaccgttgcctgcgtaggagccgccggaggtgccaccggtgttggaggaccatacggctttgttgccgccgctggctgcgccggcccctgcggagcgctgtccgccggtccgggcacccgttcccgtgccggctgcggcacgctggccggttgccgggcggccgctgcgctggccacctgaggaagccggacggcccgagctggccggacggccggtgccgccacgcggagcgtcgctgcgggtgacgcgtgattctgcacgcccgtccgatccgcggccagccgatgcacggccacctgccgcggggacgtcattgcggtgtgtggaggccgtgccgcgtccgcggttgttgcggcgtgcggctgctgctgccactgcgcggtcctcgttctgctcagacacccggtcgaaggcggcccgggcttcggtccggccttcgaaagcgacggcacggcgctctgcgcggggaatgtcggtgcgggtgggctcagccgaaacccggccgcgtccaccgcggccgccacgtccacctgcagtgggtgcagcctggcggcgggcccgcttgcgctcggcgttggcaccggtggaggtgccgccgccctgctgcgcggccttcttggccagcagcgcagcgcgggtgcgcggatcgattttctcggccatttcgcccacaagctctgcaaccagcggggagttggcggtgacgcgctcgaagttgacctccacgccggcagccttcatcagcttcttgacgtcggtctgctgctccgggagggtcagcgtgaccacggtgccgtcggacccggcgcgggcggtgcggcccgagcggtgcaggtacgccttgtgctcggtgggcgggtcaacgtggatgaccagttcgacgtcgtccacgtgcacgccgcgggctgcgacgtcggtggccaccaggacgcggacgtcaccggaggagaactcggcaaggttgcggtcgcgggcgttctgcgacaggttgccatgcaggtcgacggcggggatcccggcgtcggtcagggtcttggcgagcttgcgggcgtggtgcttggtccgcatgaaaagtacgcggcggcctgcaccggaggcgagctcaacgatcagctgcttcttgacggtctggtcattgaccaccagcacgtggtgctccatggtggtcaccgcggcctgcggatcgtccacggagtgggtcagcgggttggacaggtagcgctggacgattttgtccacgccgttgtccagcgttgcggagaaaagcaggcgctggccctggctgggagtcatgtccatgagcttcttcaccacgggcaggaagccgaggtcggccatgtggtccgcctcgtccagcacggtgatttccacggcctcaagggtgaggacgcgctggcggatcaggtcttccaggcggccggggcaggcgatgacaatgtcgacgccggcacgcagcgccttttcctggcgcgcctgggagatgccgccgtagatcacggttgtgttcaggccggcggccttggccagcggctcgatggtggcgttgatctgggttgccagctcacgggtgggggccaggaccaggcccatggggcgtccgggcttgcggaagtgcttggcttcccgctcagcgagtcttgctacaagcgggatagcgaaagcgatggttttaccggatccggtccggccgcggcccaggacgtcgcgcccggacagcgtgtccgggagggttttgacctggatggggaacggttcaacgattccctgtgcggtgagggtgtctgcaagggccttgggtgtaccgagggcagaaaaagtagtcatgtatttatacggtctttcaggcggtatccaggcggatatcggcccccgatgccggttggaccaggggttcgccgaagaaaagtcaggtgatcaaccgggccgctgcaaattttggcagtcagccgggaccaaatggaacgcgttcatcgacgcaggatgtgcctctcacatgaaaaatgcccagtccctggctggaggtgtacctccgaacaggaaaacctgggcatcactgcacatcaagttccaccagtctagcatcccgccgccgtcgacccgttccccggtcacgtccccctccccaactaggtagcgccaagtgtcgttttgagccctgaaaacgacacttagcgctacctagttgggggcgttgccttgaatggcgccgcggggcaggcttaggggatgagcgaacacgcggcccaccggaacgaagcgcagcatcctgaatcacaccagaagccgcacgacggcgaccccggcctttccggcggcacgcttgccgaggacgcggcaataggcggcgccgatgccgcggccacctgggatgagcggtaccggagcaaaccccggatgtggagcggcaaacccaacccgcagctggtccgggaggcagggggcctgcggccgggaaaggcgttggacctgggctgcggtgagggcgcagacgccatctggctcgcccagcagggctggaccgtgaccgccgtcgacgtttccgcggtggcgctggaccgggcccgctcgcacgagaaggcggcgctggcccgggaaagcgtccacgccgcggacggcgccatcgcgagccggatcacctggcagcaggcggacctggagcagtggcagccagggaactccttcgacctggtgacagcgcagttcctgcactcccaggagctcgcctggcagggcccgctgcgcacggctgcgtcagcggtcaagcccggcggcacgctgctggtggtgggccaccacccggaccggctgccgccatggggcggtgccgggcaccaccaccgggacatgttctacaccggcgatgagctggtccaggaactgggactggcaggaccggagtggcagctggaggtccagaccagccgggagcggcccgtgaccggacctgagggccagcacgcaaccatcgccgacgtcgtggtgcgcgcaacccggctcccctgactccctacggagtttttgtccaaatatgcagacttccgaggcctccaaccctgcatatctggacaaaaactcagggggtttcggcggtgacccggggcgcgacggcggccgcggctgcggcgagcacggcggcaaggccaaagaccccggcgaaggaacccgccgtcgtcgtaaaggccgcgaagacgatgcctgtggtggcgagtgccagcgccccgcccagggaatccgcaatggacatggcggagctgttgaagccctcgttctccttggtggacagtgccagggtcatcacgctgagccgcggatacagcagtcccatgcctccgccggcggagatccagcctgcgatggcgacggtggcaggccagttgagcgctgccgttgccagggccaggaccaccgctccgaggaccatcagcgccccgatgcccacggcgcggcggtgcggcagcctggcacccaggcggccctggacggctgacgcgcccgcccaggacagtgccccggcggtgagggtcaggcccgcgaaggtgggcgagaaggcgtactgctcgatcagcaggtagggcaggtaaacctccgcgccgaagaatccggccgaggcgagcccgcgggtaaggatgacgctgggcagtccgcggcgggcagtgagggtgccccggggaaccagcggcctgactgccagcagcgccacgcccaccgcgacgacggcgagggcgcctgcagctgcaggtaggccgggaacgcgcaccccggcggacaggttgagcccgagcaccgcggcggcggccagcgccgcccaccccagccggcccaccgcccatggtgtgacgggctgcgcggcgggtttgctgtccagcccccgcaggaccggggcgatcatcagcagcgccggaatgaccaggcccaccacgcccaggaacacccagtgccagctgaagacctgcgccacgatcccggcagcgaacggccccaccagtgacgggatcacccatgccgcggagaacgcggcgaagattttggggtgcagcgcgccgggataaatacgggccaccagcacatacagcgagacagtcagggctcccccgccgaggccctgcaccaagcggcctgccacgagcaccggcatcgatacggaggttcccgcaatgagcaggcccagcacaaacaatgcgacggacgtatagagcggggcggtgggtccgcgccggtccgaccagtttcccgctgcaaccatgccgatcaccccggttgccagggggccggcaaaggcgagggcgtagagtgccgcgccgtcgagttcgcggctgacgaggggcatgatggtggtcacggctagggattcgaatgctgccaggaacaccagggcgcacgtcccaaccgtcacccagaggtacggtccccggaggatgcccgccgccggacgggtggcgggaacaacagagtcctgcactttatcccctcagctgacgtaccggttgcggccggcgcggtacccgaagattcccgccagcaggccgaccaccaggaacaggactcctgcggcggtaaaggacccggtggcctggtgcagctggcccaccatcagcgtccccgtggagcccagcccgtagcccacgccctgcatcatgccggacaggtgcgccgcagtgtgcccgtcacgggtccggagcatgatcatggtgagggccacggcggtgaggcttccctggccaaggcccagcagccccgcccacacccagaccaggtcaagggggccgaagatgctgagggcgaagccgccaccggtcatcagggccaccacggtgttgatggcacgctggtcccggaacctggctgcgagcgccggggcaaacagcgagccgagcatctgcagcacgatgcacacggagacgatcagccccgccgttgccccgtccacgccccgttcccgcaggatcggcgccagccaggcgaaaacgctgaaggacatcatggcctgcagcaccatgaagatggtcacctgccaggccaccgcggagcgccacacattgacgccgtccctgacggcctggtgctggatgcggggctggcggagtgccaccggaaggaagagcaaaagtacgacggcggcaggcgccgcccaggaccacagcgccagggtccactcccccgaagccgtgtacaccgggtaggtgaagcccgccccaagtgccgccgaggcgcagatggcagtggtgtagagccctcccatcaggcccagccggtgcgggaagtcccgcttgaccagcccgggcagcaggacgttgcacagggcgatcgcggctccacaggccgccgtcccggcgagcagcgcgggcaggtggctggcccccggcagctcaacggggcggagcagcagtcctgccgtgagtaccgccatggcaccgaggagcacgcgctcggcgccgaaccgcctcgccaggaccggggcaaggggcgcaaacacacccagcagggtgacgggcaccgtggtcagcaccaccacggcccaaccggggagggcagcctgggccgtcacttcgggcaggactgccgagaagctggagaagactgtgcgcaggttaagcccgatcaggaccaggcacagccccaggtaggcgagctgccgccggctcccgacgcgcgtgggtccgggtgcaggcgtctcatcaacctcggcgtcaaccagtgtgcccggctgctcccgcacggcaggttcaacagcccgctgcttccttgccccggcgttcgtcgcttccctcacccgcccattcttgcaggacttgtttccccggttatccacatacgggctgcgacatcttccggctcctccgctgcctccgtacgttggagctgcagttgtgcgcaggcaaaccagccggttgcgtcgtcagccatcagccactcagagcacgaggagagcaatgggtgttccgccaccaaatgagcccccggagaaacggacggcgcagcacgagtcgcttcgtaaagcggaagcccatgaagctttcgaagaccgcagcgtccgcaaggcaacagccagcctggtcctggcaattcttgccctggccagcatggttatcaccgccccactggccatgttcgcgatgcttgccacctatccctcagacgggccgtcggagatgccctgggtgacgcctttggtgttcttcagcctgccgctcctttttgctgtaccgtccctggcgctggcggtacccgtcgtcaaccgcccgcctgagtcgtcgcctgaccggccgtcggcggctgccgccttatgcattgccggtttagtcgtggcccttgctttgggtcctgcgcttgacctgctggggaacctgtaagtgaagctctgctcctgcgccgctattctggaagggatgagcgaatccccagaaaacccccagcagccgcatgtcccgaggcccgtcacgcccggaacgcaggcttccttcggcacgtatggcggacggccggtgagctttgtccgccgcggcacgcgcctgcagggccggcggcaggcggcatgggaggagcacgcagagcggtgggctgtggacgtccctcggcacgttgccaacacctccgtccaccctgactacacctttgacgccgaagcagagttcggccgcacggctcccctcattgtggagatcggctccggcctgggcgatgccgtgtgccatgccgccgaacagaacccggacaccgacttcctggcggtggaggtctacacgccgggcctggccaacaccatcatcaagatcaacagccgcggactcagcaacgtccgggtggttgaggccaatgccccggaggttctggccacgatgcttccgcccggatcggtcagtgagctctgggtctttttccccgacccgtggcacaagtcccggcaccacaagcgccgcctcatccagcccgagttcgcggacctggcagcgagggcgctgaagccgggcgggttgtggcgcattgccaccgactggtcgaattacgccgtccacgtccgcgacgtcctggcggaccgcgaggacttcgaaaacctccacaacggcgagcgccgcgggccggaaagtccgctgacgcaggtgtggcagtccggcgtcgagtccgttgtgggcggggcaccggtccgggagggccgcgccccggtcagcactgcgcacacaggaccgaatgagggcatcgatgaaacgggcggctgggcaccccgcttcgaaggaaggatccggaccagcttcgaggcgaaggcccatgaagccgggcggctgatcttcgacctctgctaccgccggcgctgaccagcgccaggggcagccaggagccaggagccaggagccaggagccagggtcagggtcaggagccagggtcagggtcaggagccagggtcagggtcaggagccagggtcagggtcaggagccagggtcagggtcaggagccagggtcagggtcaggagccagggtcagggtcaggagccagggtcaggctacgctgatggcggccacaatctccttcagcatgccgagcctcggttcaatggacgggtccgtatagggccagatgaccaccacgccgatgaaccgcccgttctcccagacgcccactgtggctgcgaccttcgccgaacccccggcgtcgttgtagcccaccacgacggcgtacgcggctttctccggaaggttcagttcgccctcggccaggagggagccaccccgctcgtcccggtagaactcggacatcagatgcgcccacccgttcgcctgcggggcgccctgcacggaggcgtcgtccttgatgacggtcaccaggacatcgcccaggagtccgtactgctcggtgttgggcccggcggtggaatcctccaggacctgggtgtgctcgggaaattctgcagtgaaccccagcggggattcgatgtgcactgacatgggtcacagcctctcgagcttggtgtcgttgggcaccttatagtacgtggacacgttggtggtggcctggttttcggtcttgacctccacctcgcccaccttcacgtcaaggcccgcctcatgggaggcggtgacaacgctgttgacctggacggtggcagacccggcctcgtacagcctcgccgcgtcccgggccgcgccatagtcgttccccagcgcgacgttccgcagatagctgtcgatcacgtccctgttctccggggtgtagtcgacgttgatcttcacggtgccctggctgcccacgctgacggacgattcgaccttggccgccttgacgtcggtgcctgccgtggcgccctgcgctaccgttccgtccatcgacaccgtcaccgagtcgatgttgctgtctttgtccaggctgacctgcagtccgcccttgccggaggcctcgaacacccggccgtccaggttgagcttgccctgcgcagaaacttcgctgcccgccgtcgcggtcccgtccgtcaggttccgttcgtaggccaggtccagcttcgcggagccggaagcggcgcctgcctccccctcggcctcaagggacagggttcccttggccttgtccgtctggcctgtggagccgttgtcgccagcggcctcgttgatggtgtccagaatgtaccccggcgggttaccggcaacatccttgatctcgcccacgctgtccggcggcaggtcccggtacatctgctcgcgggcctccatggcctcctccacgctcccgaacgtgtactcacgcgaaacctcgccgctgagcgtgactcccgcagcgccggtggtgtcattcacccccagccccatattcccgtacaccttcatggtggcggagccgtcagcgttctccaccacttccgtccccacttcggcgccgccgtggacccaggcgacccgggcctcgatggaagctttgccggtttcggagtagacggggatgtccgccttggcgagctcctggaggtgttccctggcctgctcctgcacggaggcggggatcccgccgtccatgcgcatgaggtcccgggcaaacgggccgtcgtcgttgccgccttcgatcaggtactgccggtcagacgcggaaaggctgtcccaccaggcggcctgctcttccgggtccgcctccagcatgcgctccaggtccgactgcagctcccggcggtgttcagcagctgctgcggcagcagcggcctgctcccgcagccagtcccgggcctggccagccagtgacgtgatacggtcccaggcgctgtttccgccgctgccggccggggaggatgacgatgatttctcctgttcctcagcgtgctgcagcaggatcctggagttctcccgcaggatggacaccactttttccaggccggggcggtggtttccgctccactcctgccggaaccggtccccgtcgctgcccttccatggtgccgactggatctggctgtgcagtgagcttgcctgggtgctcagcgatgacgccgccctgtcggcggccttggccagggcccgcagctggctgacgtcagcgccgtaaaaagtcatggtgttcccccgggagaagttcgcggtgcgtgttcaatcgatggtccatatcgttgcacagcgtccgcagccgggcgatggggatccctccccatcccccgccgtgtcagaaacatccgggcagtggccggcgggggcgcaactgccttggtccggccacagccggcggccactgttccagtaccgcccgggcgtggcacgattgccctagtgtgcaggggcgcacaccggaagagcatttgcacaaaggaaccgtcatcaaaagagaactgaagcaggccgccgatgcagcggagaacgtcaccaactcgcggacgctggaactgctggcgagggccgggttcgcagccagcgggatcctgcacctgctggtgggggcaatcgccatccggctggcgtttggcggcaccgggaacgcggacttcagcggcgcggtggcagagcttgccacccagccggccgggccgttcctcctctgggcaagtttcgcggcctgcgctgcgctggcgctctggcaggtcagcgatgcgatcttcgactacaaccgcctgcccaccaaggaaaaagccgggaagaaggccaaggcgggcgcccaggcgcttgtgttcgccgggcttgccctgaccctgatgtccttcgccctgggaacgggctcgggcggggacaaccagaagactgccagcgacctgaccatatcgctcatgaaggcccccggcggcgtagccctgctggtcctgctcggtgtcggtatcgcggtgaccggggtggtgtacggcatccgcggggtgaagaaatccttcgagaaacacctggtcatgcccgcatctccctcggcgcggaccgctgtgaccgtcctcggcgtcaccgggtacgtggccaagggaacggtgctgttgctgacgggcctgctgatcgccatcgccaccctgcaggcgcatccggaggactccaccgggctcgacggcgggctgcgggcactgcgcgaccagcctttgggcgtctacctcctggccgcggtgggtgccgggctcatctgttacggcgtgttcatgatggtgcgggccaagctggccaaaatgaaccgctaggtcgatactgctgggtcgataccgctgggtcgctcagggcacggtcaccactgccacggcctgctgggtgccgtcccgtagttccacgcttgaaatgcttccgagctggacgggcgtggcccccgtgatcctgaccctgccgctgggggttgccgtccaggcgcaggcacggtcctcgccgcccgcccggtcccggacccacagggacagcgtcccgtcctgcggcaggctgcttccgttcacggccagctccgtaccccaggtcttccgggcgaggtcgatgctgaactggaggccgtccgcggcctgtaccgagtaggtggcgtccggctgcggcggccgggccaagaggggcccggcggccaggcccaaggcaaggcacgcggcggcggccgcgcccgccagcgccgtccagcgccgtcgtaatgtccgacggcggcgggccagcttacgcagcagcggaccggaatcggcggcaggcacgcggtccgcccctcccggagcaaccgtcagcgcaacggcgtccggcaccggaagggcgtccagcaacacgggcactttctccaggccggcgagctccttccggcactgcccgcactcctgcaggtgggcttcgaaggcctgcaggtcccctgcgtccagtccgcccaggaggtaggcgcccaacaggtggtgcgattcggtgttcaccgttccacccccatctcgtccagaatggtgcgcatcgcccgcacggcatagaaggcgcgggatttgaccgtgccgctggggatgttgagctggacggcggcctcgttcaccgtgaatctgcggtaatgcagcgccaccaggacgtcccggtgttccttgctcagccgcagcagcgcctcctccaccagcacccggttcagcagctcgtccaccctctccggatcagcggccggctctgtcaggccgctttccagggtctccgcgggacggcgccgtgccctgcggtagttgtcgatcatgatgttcctggccgtccggtacaggtagctgcggaggctgcccgtgatctcgggggtgtgctgccagacgcggagcaccgtttcctgcaccacgtcctcggcaagctgggggtcgtgggaggcgctgagcacgaaccggcgcagggcagcgccgtggtcgcggtagatggacgccaccacgtcctcatccagcggcatgccgttcctcctgccgagcccctgccccacattcctgcttaccaccgtaaagacgccgcccgcggccggaaggttcaaccgccggaggccgcccatgtgaaccattgttcaccccagtacgtcgtaagggttagcgtccggcggtccgacgccgggcccagccagcaaggagcaacgccatgaaacttcacgtgggcgcaggactcgccgtcctggccctttccgcagcactgactggctgcggcggcagcaccggaacggcgccggccaccaccagtcccgccgtcacggagggttcacctccggcctctgcaacggcccccgccgcgtctgtcaccccgccgtccgcgccgccggcaagtgccgccgtcgaccttatgaccgccacctcgagcgccggggacatcgttgtggcctccaacgggatgagcgtgtatttcttcacgaaggacgtgaaggactccgggaccagtgcctgcacggacgcctgcctggcagcgtggccgccggtcaccaccgccgctgagacgccccaggtggaaggggtcaccgggaccgtgggcaccatcacgacgccggacggcgcgaagcaggtgacgctcaacggcctgccgctgtactacttcgccaaggacaccaaggccggcgacatccttggccagggcgtgaacggcgtctggtacctggcggatccgtccggcgaaatgatcaggatgggtgcatccggctactgagccggctttcctgtgccggtccctgctgtgacgggcccggcggcgtcacgggagggggacggacggaaggttcccgggcagcggaacctctgaggggaccgggacttccggcgccttgcccagtccgttggcaacgtgcccgggcacagtgtcgggcaaggttcctggaacggggacatcgccgcgcttgcccggggaagctggctggcctgcaggggcgccaggaacaactgcactgtccgacggcgggacggcggccggttgcgtggcttcggcagggtccgcgggcaccgaggttggtccccctggtgcagtgccggacggcacggttccggcgggtgcggttccggcgggtgctgtgggcagcggcgcggcgggctgtccggtctggtgaccggccggggatggggcggcacccgtcacgaaggaggtgatggtgtggttcagctgcgtgagggagtcacggagcccctggtccgatgctgcggcaacagccccgccggcactcagcgagaccaccacggagagggtggtgagggcgatccggcgcttggccctgcggcgggcggccagttcgtccacccgcgggtcctcgtcgggggcggcaggaccagatagggcaggatcggctgcttctgccgttcctgcaggggccatcagcgccgcgatcgctgcggagggctcgggcgcactgtccgcgagcgcacgaagctccagcagggcagggcggaggcggccgtcgtcgtccatgcctgcctcgagcagcagctggtccacgaaggcgtcgctgcgggttcctgccgtgtcactcatgattcgcctggtttctctggagcgtttgtgccttgaggttctggagggccctgcgctggagctgcttgatggcgccggggcttttgcccataatctgggctacttgttcgatggacagatcggccaccacgcgaagggccagcacttcctggtgttcctcgctgagtccgtccagcagggctgccgccccaccgtggagttcaatggcgtggtcctctgcggacgatgtggttcgggcatcctggtgcggatcgtatgggctgagctggggcctgcgctccacccggcggtagtaatccaccatccgcgcgtgggcaattgagaagagcagtgacttggcgccctggagtcccccggtaagttcactgattttcgggtagaaggccaggaacacgtcctgggcaactgcttccggatcatccacgcccctggctttgagatatccctgcaccggcccggcgaaggaccggtaggcagcaccgaagagtacagccggatctgttacggccgcactctcgaatatgtcgatctcttcttgggccaaagtgctgagcaccagcggctcctccatcccaggatgcggggtgcagctgtcccggtctccggagcggacagccagtcccctgtttttcctactgcctgtcggcaggcgctcccggcgcggtcccggacggcggtgcgtccgggcagccggggctgtctgtactgcgggaacagacctatggccggttcccgcagtacagactagcgatcagtccttagcggaccgaaacggcgggggtgtccactacgttgccgccttgggcgggaacagcggggacggcaggaacggcgggctcgccgtcaacgccgggaacggcgggcactgccggaacggccggcagttcagggcgctcaacctcaacagctgcggaaccgttggctgcagcgccggcctctgcggctgcgttagcttcggtcacgacgtcggcgcagtagctttcgacgttcgcttcgccttccgcggcgatcaccagggaggagaaggcttcggaggaagcgttcaggccaccgttggtgaaggcggtgcacaggccgaacgctgcggcgccggctgcgtcaacggcggtgtccgcggcagcggaggccgaggcctcggcggacgcgttctcgttggtgacattggcgtcggctgcggcagaagcctcaacgtcggcgtcggcgtcgctcttggcatcgtcagcagcagtctcgacagcggctgcggcggttgcctggccttcagcggctgcttccgcggcgaattccggggcgggtgcgccgaagaggtcgtgggcggtctgctgcgcctgggtggggaggacaccggaaactgctgcggcgccggttccgccgacggcaatggtgccggcggccaggactccggcagcgactttgctggtggcgaggacggtgaacaacgacataagacactccaaaacctagacaacacttgtgattcttgcccgccgggcgggcccatcacctcctacatcgcaggggacggcggaaaggttacgggtggtcatgaacttttttgcgcgccttaggcctggcccgtccgcactacgatcgatacatgtccagcgagatcggtatggaggactacgcgggtttcctgccgccggccagaaggaaggcagtggcgccccctgcctctgattggtggccctggaggaaccatcggatccaccttcttcgggtacgggacgcaaatgccccggttaggctactcgtcgtccacggcgccggagcccatgcgtcggcgctctggcctgttgcggccctcctggcagggcggggcttcgacctgactgccgtggacatgccgctctacggccgaacggtgacaacctcgcgcggaacagtgacctaccaggactgggtcgacttactggtggacctcatttcagctgaggacgacggccgtcccgtcatcctcctcggggccagcatcggcggtctgctgaccgtggaagccggagcccgctcacaccgcgtcgcggccgttgccgctacctgcctgctcgacccgcgggagaggtccgcccgctcagcgatgaccaggttccattctttggccctggttttcatgcctctgctcaagctggtccgcggcccgatcgccaggatccccgtcaaggtctcctggattgccgatctcaggaacatggggcgcgaccccggcttggggcggctctgcgccaaagattcgcgcggaggcggcgcgtgggtccccctcgggttcctcgccagctacatgcagtattcacattccgatgcccgaatggtccactttccagtgcacctgatgcatcccgaactcgacgagtggaccccggtgacgctcagcgaggacactctgcaaaccctgcacggccccaccaccagccaacttctccgtggctgcggccacttccccctcgaagaacccggtttggcagatctcctgggcggcctcgaaaaagtggcggccgatgcagtgtcaggtatcgaggcggcgccaagctgagcgcagtctgcctggatatacatgtgcctcgtatccctagggttttgaggcactgagtctctgagacacccaagtgggttcagaggaggagtcggcgtccgcgggcggcctatcgcatcagctggtcatttgtcggacttgaacacgatcgaatcgaacacggcgcgtgcttctctcgtcagctccggattgattgattcgtggagttggctcactgcgatcacagcgcgctggccgttcaggtcgagcactcggtaggtttcgcgctcagcgatgcttgagtaccagcgtgagcattggtatgcggatcctgcgtggatgcataacttgccgccatcgcatgctgtgatgtccacgtcgccctcgacggagtggtcgaactcgaagccggagtaattgccgaccataacctccacgggaggggtgcttgccgttgacgtctgcgccgccatcgcgtcaacgaaggactcggccgacggatcaatttcgacgagcgcgcccacccacgcgcatgcgtccgtcggcacatagtccgcgggccaaagagtcaggtagacggcccattcagccgggtgctccgggtcgtccttgatcaggctgtcgccgtcgagtgcaaaccagccgtctgggacggtgatctcgaaaggctccgtgtagccggcgacggggacgaggtatgtgccggcgtcgatgtcgccgctctccggcagcggtgggaccgtgcgggtgtcgccattctccggcagcggtgagccggcgcgagcctccgtagtcggagtactggcggacgggagggacacgttatcgggctcatactggcacccgccgagacatccaatcagtgcgatagccaccaggggcaagagatggcgcgaccgctgagcggccttttcgaggggtgtcatggagctcatcgatccgccaagccgctacagggtactgtggggccccgcagccgggtggtcccgcgggcggcccgagatgggaggccgtcgcctcaagtctcctccggcacagaactcgtgacaatgaagagttgtacgcagaccagtttcgactcatgcaatccccgaaatggcaggagcgccctgaggcagtgttgaggaaatgccaaatttgggggctgcttttcacctccagggtctaactagcccgagaaatctggcggcagtctgcctctcgtaacccttgggttttgaggcgggcgagttcaggtggtgagtgcaacaccctgaattctgtggggtgtcgtcgatgggtaggccgtggtcgccgttaagtgttcgactagcgttctgggaagggctggatgccgggctgtcggtagccgtggcggcgcaggccgcgggggtgtcgcgtccgaccgcataccggtggttgagcgaccatcagaaggtgttgccatcgcccgttccgaatttcagtgtgccccgtgcagggcttttgtcgttgcgtgaacgggaagagatcggcttccagctcgcccagggccatggagtccgtcatatcgccgccattctgggccgggctccgtccacaatcagccgggagatcgcgaggaaccgcgtcagtgaccggtattcgccatcgctcgcacaggagcaaacgtgggctcgtgcccgcaggccgaagccgcggaagctggacgggttagccttacgggaccaggtcacgacgatgctcaccgaccggttcagcccggaacaggtcgctggccgactgaaggtggagcatccggagaatccggagatgcaggtgtcacacgaaacgatctatcaggccctctacgtccagggccgcggatccttgtgcctggaagttgcgacggcgctccggtccggacgggtgcgtcggcggccgcaaaggccggaaggtcctcgcccgcaacggttccaggaaatggtgatgatctctgaccggccagccgaggtcgaggaccgcgccgttcccggccattgggaaggggacttaatcatcggttcaacggcatcgaaatccgcgatcgggaccctcgttgaacgcactagcggatacgtgatgttgctgcatctggctgaggaccacaccgcccgcaccgtcgccgccgccatgatcaccgcgatgaataccctccccgagcagctgcgccgttcgacgacctgggatcaaggagcggagatgtcgcggcatcaggagatcactatggctaccggcatgccgatctatttctgtgagccacattcaccctggcagcgcggcagcaacgaaaacaccaacggcctccttcgtcagtacttcccgaaaagcaccgacctgtctttccatgggcctggaatcctcgagaacgtcgccgcggaactcaaccgccggccacgcaaacgacacggctaccgaacgcccgcagaagtcctcgccgagctaatctcgaacccagtcaactaaatccggtgttgcaggcaccactggaattcgccccgtgtactgactattagttatgagacacgtcccagcagcagcctgacagacctggccggctataggcgcgtttccagccttcggcagtccaccgaccagcggacccctaacccaaatccgcgttcccggccgaagccagcggcagcatccgctcccagaagtcctccgggatgctccaccccgccaggcgtgcggcttcggctacccgcccgggctccgccatccccacgatggtggacgcgatgcgcggatcgcgggtggagaactgcagcgccgcggcggcacgcggcaccgagtactcgcggcagaggtcctgcatctcccggacacggcccagcagttccgggctggccggccggtaacagtagttggtggtggcatcgggccccttcaccagcaggccgccgccaaatggcgcggcattgatgaaggcgacgccccgccgtcgtgcgtcctcgatgagcggctccgccgtctggtccaccagggtgtaccggttgtggctgatgacaacatcgaacacgtccagggccaaatacttcagctccaggtcaatgggcccgccggccacgccgagatgcccaatcagcccctggtccctcaggtcaacgagtgcctccagcggcccgccagcggccaccccctccccaaagctgatcttctccggatcgtggagatggaccagcggcagcctgtccagccccagccgctccaggctttcctcgacgctgcgccggacacgctcgccggagtagtccgccgtccccacgatgggatccactttcgtggacaggacaaagccccccggcagcccgcccgcttcccggattgcctgcccgatccagcgctcgctgccgccgtcgtgcccgtattcgttggaggtgtccaggaagttgaaaggcccggccagggcggcgcggacggcggccactgccgttgccgtccgctccgcgtggctgccgttccgcgggtggtttcccagcgaactcgtgccgacgcacacgtcggtgacagggaggccggtgcggccgagggtcttcatggctgtgggtatcctcgcctctgtgacaggttccatcagactacgacggcggaaacgtcgccgccgcggacggtgacctcgaacgccgtggtggaaccgtccggcgagggcaccccaatgcgccgtgtcccgtccgccgcggcgaacgcccggaactgcatatcccgcgcccagtcgtagtccggccggtctgacactgtgccgatgggcagcacagcgccttcgcggacccaggtggcagcctgcatcaccgaatactccttgcggtgccagcgcgggccggccagctgctcccctgtttccaggtgggtccaggtgccctcgggcaggtagaaggacacgctcccggacgggtccatgaccggtgccaccaggatgtccggccccagcatgtactgccggtccagatgcgcgcagcccgggtcctccgggaactccatgaacagcgggcgcatcaggggaataccctctgcgtaagcctgctcggctgccgtctgcaggtagggcatgagccgcattttctgctccgtaaagtgccggagcacgtccacggactcctcgtccaccagccacggcacacggtaggagttggacccgtgcagcctcgagtgcgaggacagcaggccgaacgcgatccaccgtttgaagatttccggctcgggcgtaccctcgaatccgccgatgtcgtggctccagaaggagaagcccgacgccgccagggacagcccgccgcgcagcgattcagccatggccgcgaacgtggactcacagtcgccgccccagtgcaccggcatggtctgtccgccggccgtggctgagcgggcaaaaaccaccgcttccccttcgcccagctccttggacagcaggtcgaaaaccgtcctgttgtacagctgcgcgtagtagttgtgcattctgtccggatcggacccgtcgtgccacaccacatccgtggggatgcgctcgccaaagtccgtcttgaacgagtcaacgccctggcccagcaggccgcggagcttgtcctggtaccagagcacggcctcggggttggtgaagtccaccagccccatgcccgcctgccacatgtcccactgccacaccgacccgtccgaccgtttgaccaggaagccccgctccagaccctcgcggaacaggtgcgagcgctgggcgatgtacgggttgatccagacgcagaccttcagcccgcggtcgtgaagccgggccagcatgccctccgggtcagggaaagtggcggggtcccagacgaagtcgctccagtggaaggacctcatccagtggcagtcaaagtggaagacggacaggggcaggttccgctcctccatgccgtcaatgaaggagttcacggtcttctcgtcgtagtccgtggtgaaggaggtggagagccacaggccgtaggaccaggccgggatccgtgatggccgtccggtcagctcggtgtaccgccggatgatgtccttcggcgaaggcccgtggatgacgaagtactggagcttctggccctccacgctgaactgggtgcgggacaccacctcggaccccacctcgaaggacaccttctccgggtggttcacgaacaccccgtagccgtcgttggtgatgaagaacggcacgttcttgtaggcgaggtcgctggaggtgccgccgtcctcgttccagatgtccaccgactggccgttcttgacgaacgcgccgaaccgctcgcccaggccatacacattggtgcccacgcccaggctgagctgctcgtgcacaaacgtccgcccgccgtcgtccgtgatgacgccgacgctgcgcggcgtggaggtggtcagcagcctgccgttccccaggaaatcgaccccccagtccccgtccgtgctgatccgtgccgtgagcccgccggaggtgatgctggccgtgtccccgtcccggctgaactgcggggccggtcctgtccggttcacgtcgaagtgcgggccgttgtccagcccgccctggaagtgctcgatggtcacgccgatgacgtccggcaggggcgcatcgaaggtgaccgtcagctggggaaggttcagggcatcgccgcgggagttgatgcgtttggtgggtgcgtaaaccgtcaggctccgctcgtcctccaccacgtccgagacgtcgcgcgggtgcagcgccgagaagcctttgcggtacagccagtagccgtcggtgaatttcatgggatgtcagtttccgttctcaagaggtgcagtgctgtctttgaggaccagggcgccatacggttccagggtcaggtggcgcccgcaggcgtccccggtaagcacgtccacagactgcccagcgagcgtcacggtgcgcggttccgggctgtggttcagcaggaagtgttggccgccgcgggtggcaagttcgacgtcgtcgggcagcattcctgccaccggcgaggagatgcgggctgccgccagggcctcccccacgatgtgccccagcgcgggaccgggcaggtcgcacccggcgtaccaagcggtgccgcggccgtggctgttgcggactaccgccggctttccagccagggcgccggaggcgaacgaggccgccgccgcggcgccgggaccgtccaggcgcaggtcctcggaccagacagtggcctggaggccggcgggtgcgtctgcagagacgcttcccggtccggatgaagcgaaatcgagcccaatgccttccgccaggggccgccattcctcgccgctggtgccgagcatggacgccaggaccgaggggaaccgtccctgccggaggtggccgttgctgtccgccacccccgtgaagggcccgacgacggccgtcccgccccggtgcacccattccgtcagtgccacggcatggtcctccgccaggaggaagaggctggggacgagcaccaggtcgaaccggtccagcgccgtggaggggtgcaccacctccacggacaggccgcgccgcagcagcggccggtagtaggcctggagctggtccaggacgccgagccggtccgtggggcagtccggggactccgccgcccaccagctgtcccaatcgaacaggatggcgatccgggacggcgcgggggtgcctgcaatgagccgcaggtcctgcagctgggagccgagttccgcgacctcgcggaacacccgggtgtcctccccggccagcggcaccaccgcggagtggaagcgttcggcgccgaaggaggactggcggaactggaagaagcagatgccgtcggagccgcgggccagggcggagaacgagtccacgcggagggccccgggttccttggcgctgttgtggggccgccagttcacggcggaggctgctgattccatcagcagccagggtgtgccgccggccagtccgcggcacaggtcgtgggtgagggcgcccagttcccaggtctgcggctgcccgggatccgtgtaccagttgttgcccaccaggtccgtctccccggcgaagctgaagtagtccgcgccgcggaagaagcccatcaggttggtggtgacgggaacatccggtgagtactggcggatgatgtcccgttcggcggtgaagagtttgagcagcgactccgaggtgaagcgcttgaagtccaggacctgcgtggggttgtggaggtagggtgccgtgcgcggcggcaggatttcctcccaggtgctgtagccctggctccagaaggtggtcccccaggcggagttcaggtgttccagggagccgtagcggcgcagcagccaggtgcggaacgcggcggcggtctcgtcgtcgtaactgatctgtcccagctcgttcccaacgtgccacatcaccacagcggggtgctggccgtaccgctcggcgagcgccgcggtgacctgccgtgcggcgctgcggtacacggccgacgacggcgagaactggttgcgggagccgtaccagagcgttgtcccggctgcgtccgtgggcagtgtgctggggtagcggtgtcccagccagggcggcggcgatgcggtgggcgtggccaggcagaccttgatgtttccctcgtcgaggagggcaaggatccggtccagccagccgaagtcccaggtgccctcggtgggctgcaggcgtgcccagctgaagacgcccagggtcaccaggttgatgcctgcctgctgcatcaggcggatgtcctccggccagctttcctccggccactgctcggggttgtaatcggcgccgaagagcagcccggcccgctctgtcacggcgctcaggccgtggcttcgaggatgcatggaattccttggttaaatgatggatatgagtaatcgaaaggcttcaacggcggcgaccatcagtgacgtggccaaagaggcgggggtttccacgagtaccgtgtcctacgtgatgagcgggaaccgtcccatatcgaaagaaacccgcgaaatcgtcgaagcggcgatgcggcggctgaagtacagtccgcggtccagtgcccgcgccctggcctccagccgctccaatgtcctggggctggtggtgcccctccgcgcggatgtcaacgtgggtgtggtgatgcagttcgtcactgctgtggtgaccaccgcccggacgttcaaccaggacgtcctgctcctgacccaggacgacgccggcagcattgagcgggtgacgtcccagtccatggtggacggcctggtgatgatggacatcgaggcccgcgatccccgcatccccgtgctggccaagctggacaagccggcggtgctgatcggcatgccggacgatccgcgtggcctcagctgcgttgacttcgacttcgccggcgcctcccgcaccgctgtccgccatctggccgaattgggccaccgcggcatcgccttcatcggttccccgcccgcctcgctgcgccggcacgcaacctatgctgaccgggccctgcgcggtttcgaggaggcgtgccgggaacttgaggtcacgcatgtctcggtggcctgcgaggcgaactccaaggacctggcccgggcgctggacaaggtcttcgccggcccggagtccatcaccgccctcctggtgcacaacgagggactgctgcccatcctgcgcgagaacctcgccgcgcacagcttcaccgtcccggaggacatctcggtggttgttattgcccccgccgatgtggccacgtccgccttcctgccctggacggcggtgtccatcccggcgatggacatcggccgcgccgccgtggagatggtgatggatcggctgagcctggccaagcccgccgagctgcggctcatcgcccccaccctctccgagggggcaagcaccgcggcggtccgctgagggctgccgcagcaagggcaccgcaccgttcatcccttgaccgcgccgatcatcacgcctttggtgaagtgcttctgcacgaaggggtacacgatcaggatggggatcatggcgagcacgatcacggccatctgcagtgccgggccagccgctgccccggtgccaacatccacctggccgggcaccgagacgccctgtagcacgtaggaccgcagcaccacctgcagcgggttcatggagctgtcattgatgtagaggatggcgttgaagaacgcattccagtagcccaccccgtaaaacagggcgatgacggcggtgacggccttggacatcggcagcacgatctgcgtcagggttcgccactcgctggcgccgtcaatccgggcgctgtccaggatcccccggtcgattcccatgaagaagccgcggaggatgatgatgttgaacaccgagatgcagctgggcaggatcagcgcccagtaggtgttgatcaggcccaggccggacaccagcaggtacgccgggatgatgccggcgctgaagaacatggtgatcagcagggtgaacaggatgggcgtgtgggcaaaggaccccggccgggacagtccgtacgcgcagaggatggacaccaccatgctcagggccgttccggtggccgtgacgcccacgctgaccagcaccgccctggtgaccaccccgccgctgaggatctgctggtaggcggcgaaggagatttccccgggaaccaggaccagtccgccggcctgcgtgatggtggcctgggcggagatgctggtgaggacgatcgtgtacagcggccccaggactgccaggacgacgacggcgagcaccacgatcttgccggccttcgccgccgctccgggttcttcgtcccagatggggcgttccggtttggtgcgcggttgcctgggtggtctggcggcgccggctgaagcgggcgcctttctggttagtgtgctcatttggaatagacaccgctctcaccgaagatgtgggcaactttgttggcagtcaggatcagggccaggctcaccaggcccttgatgaggccggcggcggcagcgtagctccagtcgccgttctgcacgccggtgtaatacacgaaggtgtccaggacttctgaggcttcggccccgacggcgtcccgctgcaggatcatctgctcgaagccaaccgtcagggagtcccccagcctgaggatcagcagcagcacgatgacgctgcggagtccgggaagggtgacgtgccacatccgcttccaccggttggccccgtccaccgccgctgcctcgtactgggcgggatcgatggcgctgagggctgcgaggaacacgatgatgccccagccggcgtccttccagaccgcctgggaggtaagcaggaacaggaatgtgtccgggttggtcatgatgtccacggcctgccagccgttggcgcgcagcgactggttcagcagcccggcgccgccgaagatctgctggaagacggagaccaccaggacccaggaaaagaagtgcggcaggtacaccactgcctggatggcggccctgagccgcgggttcaccagggagttgaggagcatggccagtgctatggggatgggaaagaagaacaccagctggaacgccgtgatcaccagcgtgttcttgacggccagccagaagtcgggatccgccagcacccgcgcgaagttgtccgtccccacccacgggctggccggaatccccacatacggggagtagtcctggaaggccaccacgttgcccagcatgggcaggtacgcgaagatcgccagcaggatcacggcgggcagtgccatgaacaccagggagcggtcccggttgaaccgcagtttgaggttggccttcggcctcagggggacggccgtgctgccggcctccgtgctgccgccacccgagccgccggcatcctgcgtcccggcatcctgcgccgcagcacccaacccgccagccgccgtcgtacttcctgccgaatgcccactgtcctgcgccgcggcgacctcctgccgcagcgccgcctggcgttctgttccggtgctcatcctcgccatctcctaggccaggaatcccgcgtagaagtcccggagttcgtcgccgcccttgctcttccaggtggcgagttcggcgtcgaggtccttcatgcccttgcgtccgcggatgatgtccttggcaaggtcgtcaaacggcttggacagtgagccgaacttggccggctcctggatctgcatgccgaagaaggcgtcctccacaacattgggtgcctggcgcgcctcccactcggactgcgactgcaccagccccgggtactggaccatggagttcacgatcggggcgttcaccaggaacgcataggtgctggtgacttcctcggtgcccttggccgtggccttcgggatgccctgggcgtcccgggtgaagtgcacgccctccacgccgttgttgatcagcacgttctcctcggtgccgaacggggccgccatgaagttggccagcgccagcatctcctccaccttggcggggtccgttttcttgataaagctgaagatcgctgccggctgtgcacggaacagggtgggcttaccgccgtccggagcgaagtagtccatgggctgcatgttgaacttcgggttggaagggaggacgcgggccagggcctcgtgccaggagcccatgccgtccgaggccatcagcgaggcgccggattcgaagcgctgcttggactgctgcgcgttgccggccacggcgtccgggtggaccgagccgtcggcgaacagtttcgccgtccactcaagcgcagcccggtactcgtccgtttccaccttgttctgcagcgtgccgtccacctgcttccacttggggaccacgccgtgcatgatctgcgcgccggtccagacgtcctcggaaccccagcggttcttggattcgtccgtgagttccttggccagcgcgcggtattcgtcggcggacgtgggcggcttgacgccgagctcctcgaagaggtctgcgcggtagaagatggcatccgagatcagggcaccggggtagggcaacccgtaaaggccgccctcgaagcagcccatcttccacgccgccgtcggaatgttcgccaggttggggtacttgttgaccttgtccccggcgatgaattccgagaggtcctggaagacgcccgcggcggcctgcccgaagcgcggcggcaggttccaccccggaacgaccatccagtccggcacgtccttgggcgaggccaggaccgtctgcaccttgtccgcgtaagcgttgccatcgttgacctggaagttgatggtggcgccgagcttttcgttgaccgcctggtagtagctgttctccggcagtgcgggcggaacggcccaccaggcgggcgtcatggccgtgtaggttccgccgcttccgggaggcgcgggcacggacttgaccagggacgaggggatgctggtgaagcccggcgtggagcccttcacggaagggatgtccggtttaaccagctccagcggcttgtacgcaggcaccagcttggccaccgtttcggccaggctgccggaggtggctgcctgcggcgcggcgcctcctccggagcaggccgtcagcgctgcaggggctgccgccaggaacaccgcaccgctgaggatgccgaggaaggaacggcggttgaccccggcggaggcctcgttgagcaggcggctggcggatttatgggggcgtccccttgacgggtctacctgggaaccgagcatgacagcactcctttgtgtgagccaatgagggaagattcaatgattcatcgaaccgattcgacttggatcagggtatgacaccagcacgggatccggcaagggcaaaatgtgttgcgcctcacaagcgggagtggaacactgggtgtcgccagaatttgtataagcgattcgataacccgctgattggactgccgtgcgtctagaacccgccattcttccctcccctgccgctgacgccgcgggtggcgacattgttggtgccatcggcggcggcgccacggcgggcgcggacggacatactgcagagctggcccaccagatcctccgcacgctgtccctcgagcagaaggtggccatgctgcaccagcacgccccggctgttccggagctggggctggcgcctttccatacgggtgcagaggcagcgcacggtgtcgcctggctgggaccggccaccgtcttcccgcagccggtaggcatggcggccacctgggatgcggacctgatcgaacggctcggtgaggccacggggcgtgagctccgcggcaagaaggcggaggacccgtccgtgggcctgaacgcctgggcaccggtggtgaacccgctccggcacccgctgtgggggcggaacgaggaaggcttctccgaggacccgcacctcaccgcgcagctggccggcgcctactgccgcggcctcaagggaaaggacccgcacacgtggctgacggttcccaccctcaagcatttcctcggctacaacaacgagctggacaggaacgtcacctccagcaccctcagcccccgcatcctgcacgagtatgaacttcccgcgtaccgctcccccatcgaggacggcgtggcaggggcggtgatgctgtcctacaacctggtgaacggccggcccgcccacgtctccgacctggtgcagtccgagctgcggcagtggcgcaacggggagtcggtcaccatcgtgacggacgccggcgcgcccggttccctcttccgggcggagaagtatttcgacgacggcccggcagcctacgcggccgccctccacgccggggtggacagcttcacggacgacggcgacaacccggggccgtccatcgcctaccttaacgaggggctggagaaggggctgatcagcgagtccgacgttgaccgggcggtgctgcggctccttatgctccgggccaggacgggcgagttcacgccggaaagtgatccctatgcctccatcggggcggacgccatcggcgcggccgcccacgtccggctggcacgggaagcagccgccaaatccgtggtggtgctgcgcaacattcccggggctgatgccccctccggcgccggcgccggcctgcttccgctgggcagcgagcccggaaccattgccgtcatcgggaccctggggtcacgggtgctgagcgactggtacagcggaaccctccaggacgaggtcagcatcgccggcgggctcatccgccgctacggcggaggcaagggagccgacgttgttgccgaggagggtgccgacgtcgtggccctgcggagcgtcaggaccggaggctacctgggcggggccggcactgccgtcctcaccgtccaggccgctgttcccggcgaagcggagcggttcatcgtcaaggactggggcaagggggagctgaccctccagtcggaactgaccgggaagttcgtgacggacaccggggacgggtacctgcgtgccacggctgaccgtgtgggcggctgggttgtgcaggagacgttccggctggaccgtgccgcggacggcacggccgcgctgcagcatgtggggaccgggaaatggctgcgggttgaagccggcacggcgagcgcagcccttgttcccggcgccggcacagccgaccgctttgtgctccgtacgctcacgtccggccacgaggccgcccggcaggccgcggccgctgcccgcaccgccgtcgtggtggtgggaaacgatccccacctcgggggccgggagacgctggaccgcaccaccctggacctcccgctggcagaccaggaactggtccgcgtggtgcgtgaggccaacccgcgcacggtgctggtggttgtgtcctcctacccttatgccctcggcgcgctcgccgatacgccggccgtcgtctggacgtcccacggcgggcaggagttgggcaacggcgtggccgatgtcctgagcggcgataccgagccgtccgggcggctgccgcagacctggttccgccgggacggggacctggcggacatcctggactacgacatcatcacctcgcgctccacgtatctctatagccgcgcggaacccttgttcgccctggggcacggcctcacgtacggtgaggtgcactacgaatccgttgccctgcgcgagctgccgggcgaaggcccttggggtgcggacccggcagaactggcggtggagctgcgcaacaccggtgcgcgcccggcgtcggaactggtgcaggtgtacgcgtccgctccggaccaccgcttcgacttcccccgcaggctcctggtgggccaccagcgggtggaggtcccggctggaggcacggccacggcaaggatccgcgttccgctcgagaggctggcaacctacagcgtggtggaggagcggatgctggtggaaccgggcacgtaccagcttctggtgggcgcgtccgcggaggatctaccgctggcagtgccgctcaccgtggcgggaagtcccggcgccgggcgccgctccggccggtggttccgggcagagaacttcgactcctgccacaacctggcgctggtacccgagacacagctggccggcacggcggtagccccggcggacactaccaggcccggctgggcgctctaccgcggctgggagccggcccctgccgacggcaaccaggtgcttcttcatgtagtttccggcgaacctgcgggcaccgccggcctgttccggatccaggtgcccggccccgccgacagctggaacaccgtggggagcgccagggttgccccgggctacagcggagaactgcggatacagcttcgttccggcacagcattccgcgagggcagcggcgccttccggctgttgctggaaggtgccgttacggtgagccgggtgcagctgacgtagcccaggccgggtcggccgtcctaggcgtcggccatctcagcgtccgcttcttcgaactccacggctgccacaatgtcctgagtttcggggttgatcatgaaggcctcgtcgtcctcctcgaccatcaggaagtcgccttggtcggtggcgaagtgccaggccagggcacgttcgccgttgtggacgtagttggggtcgcccatggtgatcttccggagttcatgcccggcaatgctgcacagttcgcggatgatgatctcgaagtcgggcgcgttctccagggactcggcgtccgcctgcgcctggcgctccggcagatcgggaatcagtgacgcaaggcgctcgatgtaggcaccgacctcttcgtcgtccagcaccaggagctctgcctggccgcggagccaggcggcgttgagtgcggtgatgttttcccgttccagcagctcctcaaactcgccgtcgagctcctccatccggaggacgccgtcgggaacttcctcggagtcttcatccaggccgccgtccaggtagcgctcctcgtcttcttcggacaagtcatcaaatgcctccactgcccggttgaagaggtcaagatgggcaggggcgcccatgcccgccatgccttcgcggaccagggtgtccgtttcggagcggtcgacggcagtgaagacgtactgcgcgaagccgccctccagtgcctgggccagatagaaatccacgtagtagctgcggacggcgacgggcgacatctcctcggtccggagcagggcgttatgcatggcatccacaatgctgacgttcgcctctacgacgtcctcgtcgctggagtcgatgctgctgctggtcaggacgacgggctgctggctggtgatcatggcaatcctcacgggtggtacgggtggtgctcggaacgtttttcacgctacgtggaccgggccgctgcgccgtcgaggaggaaatgaacgtccggcgaagtttacgtcgccggcaggctttcgttccgttggccgtggcggccgcccttgccgccggacggcccgcccaccgagccgcgcttgacgagggtggcggcaaattcaggtgtggccgccggcgctttcctgccctggatctgccggatgagggcctcggcggctgcgacgcccatctcgtacacaggctgcgcgatcaccgtcaatggaggcctggtgaggcgggtccaggcgaaatcgtcgtacatgaggaacgagacatcatccgggatagcgaggccgaggtcctggatggcctccacaacactgagtccgatcaggccgtccgaggcgatgatggccgttgcagggtccggctgctgcagcagttcacgcgtgatcttcttgatggtttcgggtccgtcggcattaaagcgcaccagatcgtcgggttccttgagtcctgcttcccggaaggcccgcatgatcccgtcccgccggtccgagatctgggaggagcccagggacaagcccgtggagtaggaatcatccgtccggagtgtggaaataaaggcgatccggctgtgtccggcctcaatcaaatagcgggttgattcgtaggaaatgccttccatatccaccgcaaccgtgtccacctccaggcccttggccatgcggtccagcaggaccagaggccttcccgaatggtggacgtcctggaggtgccgggtctcaacggaggaagcgggggccacgatcaggccgtcaacccgcttgtccagcagcaccctgacggcgtccacttccgccgcccggtcttcgtccgtattgaccaggatgacgttgaagccgcttttcttggcggtgtcggtgatcccccgggtggccaggccgaaatgcgggttttcgatgtcgcccaccaccacgccgatggtgttggattttcccgtgttcatgctgcgggcaagctcgttgggccggtagttcagctcttccgcggcagccagcacccgctcccgcacgtcctcgctcaccgccccgtagttgcccagggcgcgggcggcctgggccttggacacctgcgcggctttggcgacgtcggcaacagtaacgtcccgtcgacgtgaagcatcagtactcatgtcggcctttcgtaatggacccttgacgccggaagtggcgtcgattacatttctatccatcgatgtgagtccggtctcaatcgtaggcattgagaccggactcagcaagggtttccggcaaacccgccacggcggatctcgatcctccatctcccgcttcctcacgattggaaaactcgctgtgattactcgaaccactgtgcgccccgcggcgctcattgccgcggctgttgccgccgtcctggcactctccggctgcggcggctcctcatcagcctcatcctcgccggccgaaaacccctacggcctcattgagcccggctccatccgcgttgcgagcctgggcgattcgaagccctacaccttcacggacgcccaaggtaaattcaccggtttcgacgtggaactcttcacggacgttgccgcccgcgccggcgtagacaatgtggtcttcaccggacaggacttctccggcctgctggccgccgtcgcaaacggacagttcgacgccggcgtggccgccatcggcatcacggacaagcgcaaggaaacggtggatttctctgacggctacctggccggctacctcaccgtcatcaccaccaagtcctccggcatcagcaacgccgacggactttccggaaaacgccttggcgtggtgcagggaacgctgcaggaagcctacgcggtgaagaatttcacctcggccagcctggtgcggttcccggacaacaacacggcaatctccgccgtcaacagcggttcagtggatgcacacttcctggactacgaggccgccaagtcctaccaggagcagtttggcctggtcagcgccgcggacatcccgtccttcgacgcgccagccgggttcgccgtcgccaagggcaagaccgccctcaaggacgcccttaacaagggcctggcagaagccatggaggacggcacgtggaagaaactctacgagaagtggttcccgggttccccgatgcctgagcagtacctcccgaaggcagaacagggcgcaaccccggccccgacagcaagcaagtagaccacgggtatgttccgggcgggccgaacgcttccatgccaaggcccgcccgggagctaccggaacaactaacacctgagagcattcaatggactggctcaacaccatcatccgcaccttcttcgacttcggcgccatggctgaagtcctgccccagctcctggcggtaggcctcctcaacaccctcatcatctccgtcgcagccactgtcataggcgtggtcctgggcatggtggtggccgtcatgggcatctcaccgtccaggtggctgcgcatcccggcccgcatctacacggacctgttccgcggactgccggccatcctgaccatcctcctgatcggccagggctttgcacgcctcagccagtcgatctttgggccctcgccgtaccccctgggaatcatcgccctgagcctgattgccagcgcctacatcggcgagatcttccgcgccggcatccagagcgtggacaagggccagggcgaagcatgccgcgccctgggcatgagctacggcaaatcgatggcactggtggtcatcccccagggcatccgccgcgtactgcctgccctggtgaaccagttcatcgccatcgtcaaggactcctccctggtctacttcctggggctgctggtcagcgaacgcgaactcttccgcgtgggccaggacgcagcggtactctccggcaacctctcccccctggtcatggcgggcgtcttctacctcatcatcaccgtgccgctcacccacctggtcaactacttcgacagccgcttccgcgcaggaaagcgccgcccctcggcccccaccagcggcctcaacgaagtcaaggaactcgacgcggcctcgccgctcactaccgggagcaacacatgatcaccaccaccagcgccaaccccaccgctgacatcgaaaccttccacggctccagcctggagctgaagaacctgaccatggcctacggggacatcgaggtcctccgcaacgtcagccttaccgtggcccccggcaccaccacctgcatcatcggcccgtccggctcaggcaagtccacccttctccggggcgtcaacaggctgcatgaacccaaaagcggagacgttgtcctcgccggcgacagtgcactgaaggtcaacccggacatcctgcgcagccggatcggcatggtgttccagcacttcaacctcttcccggaccacaccgccctggaaaacgtggcactcgccctctggagcgtcaagaagatgtccaaggccgaggccagggaacgcgcacgccgccgcctggccgaagtgggcctcgccgaacgcgccgaccaccgcccccgggacctttccggcgggcagcagcagcgcgtcgccattgcccgcgccctcgccatggaaccggaagtgatgctcttcgacgaggccaccagcgccctggaccccgagctcgtcaaaggagtcctgaccctcatggcctcgctcgccaaacggggaatgaccatggtggtggtgacgcacgagatgggcttcgcccggaaggttgccgaccaggttgtctttatggacgaaggcgaagtggttgaagcgggcacgcccgcggagatcttcgacaaccccaagagtgagcgcctccagcgcttcctctccgaggtcctttgatgcgttccgcggggagcgggccgatccgtaccgccgtcgtcggctttggcatctccggacgcgtcttccatgcacccctcgttgaggcaaacccctccttctcactcgatgtcattgtcaccgcggcccctgaccgcgccgccgcagcggccgcccgctacccgaacgcgcgcatcgtgcccacggcggaggccatgttcgcgctggcggcagacctcgacctggtggtcctgggaacccctccggccacgcactttggcatggcttcgacggcgatcgcccacaaactgcacgtggtggtggacaagccgttcgtcaccacctcggcccatggggaggaactcatggcccaggcggccgaggccggcgtgcagctgacggtcttccagaaccgccgctgggacgctgatttcctgaccctcaggaagctcctggatgcaggcgcgctgggcgaggtccggaccttcgaatcccgcttcgagtggtggcgccccgaggggttcgggaactggcgcgattccgccaccacagccgagggaggaggaatcctccacgacctgggcgcccaccttattgaccaggccgtccagctgttcggccccgtggcccgcagctacggcgaaacagcgcaccgtggactgagcccggatgcggccgacacggaagcattcgtgtccctgctgcacgattcgggggtccgctcccgcctgtggatgaacggcatggccgcccaggcaggcccgcgcttccacgtcctgggctcccacgccggctacacaaagtggggactggacggccaggaacccgcgctcgacgccggactgccgccgtcggacccggcgtatggcgtggagccccaggagtcttgggggcttctgggtgtcgacggccgctcaacggccgttcctgccgagcggggcgcgtatccccagttctaccggctccttgccggcgccctcctgcacggcgggccggtccctgttgacccggcagacgccgtcgatgtcctgaaagtcatcgaagaagtccatgccctcgcctgacgtaccgagcaacggcagatcttccaaccacgtatcttccaacccaggaaagcgagccaccatgtactccacaagccccgccaggaaagtcgccgtcatcggcggcggaatcctgggcatttccaccgccgtccatctggcaaagggaggcgcgcaagtaacacttgtcacgtccggcccgttggcgagcggagcctccggccgctcgatcgcctggctcaattcttccggtgcccgctccgcggagtaccactacctgcggatgcttgccatcgaccgctaccgcacctggagcgcgcaccaccccgaaagccgcgagtatctgaggttcgatggtgcgctgaaatgggccggcccggacgaaaccttccgcgaaaccttcgccttcgagcgttcgggcggataccactccgtctgggtggacagcggggacgtggcccggatcgccccggatgtggacgccgctgcggtggccgacgagggtgccatctataaccctggtgaaggctgggtcaacatgcccgacttcattacggcattggcttccgaggcggcggacaacggggcggtgatcatccaaaatgccggggatgtccgggtggatgtgcgggacggcgccgcggccggcgtcatcctcggtgacgggacgcggctggaagccgaccaggtggtgctggcaaccggcggtgaggtccccgcccagctcgcagccctgggtgtgacggttccggatgccacgccggccgccttcgtggtgttcaccgaaccgctcgacgtgaaagtgcagaccgtgctgaacaccccccgcgtcgctgtgcggcccatgcctgacggcaggctggtacttgatgcggactgggcagagcagtctgtaatcatcgaagatgacggatccttcacggttcccgaggagtccgtccagggcctgctcgaggaagcctcgaaggtactcgcggggaatccccggctgaccgcccagcgggtggctgcaggcctgaaacccattcccggcgacggtgaaccggtggtgggcccggtgccttcgataccgggcctgcacacggttttcacccactcgggcgcgacgctggggctgatcctcggtgagctcctcgcggaggaaatcctttccggaaccccctctcccgtgctcgccgccttccggcttgaccggttcgacgccggggccccggaccgggaggccgtggggacgggcgcctgggcgccggtgcaccagagctagcaggccggaaggtggtgcgggcctgggccgcacccctcccgggccggctgcggcttcccggctgcagttgcatcccttggttgtccatgtgatcccatccagccgccctcaaagagccggcggcgctccccgccccgccggcgaactaagatggatcagatgaccaaccaccggcccggccccgccgtggcctgctgaaagtagcgcgcaccatgccatcccaaccggacgagagtgcggcactggcaatacagactcccgccatcaacgaccgctccctggcggccgggctggcgtatgccatgggaagccgcgtctcgggcatctcgttcgacgccgccaccgggctcatgctgggcaaggtccgcggcggcgcggacctgccctactccaccacggccaagctggtccgcaagggcggcggctggagctgcaccgtgggcgtgtgcagctgcccggtccgcaaggactgcaagcacgtggcggcgctgctcttcgccgccgaggacaacccggccatccgggtccagctgctcacgccgtcgacatccacccaggtgtcccgcaacccttccgtttctgcgctgtccgactgggagcaggccctcagcccgctgatctcccagccgggagccaccccctccaacgccggtgtcccgctggcactccagttcgaggtggaggaacccgcgccgcacttttcctacaccggccggcgcgatccgcagcgcagcgtccgccagctcaaggccaggcccgtcatcatgggcgccaagggcaagtggatccgcggcgacgtttcctggaccacgctgaactatctgaacttccggcgcgagtgcaaccccgcgcacgtggaatggctgcaggagttcctggctgcccattccgcctcgtccggccggacctacaactcctccggcttctggctcgggctgaactcctacgctggaaagaacctgtggagcctgctggaggacgccggcaaaatcggcctcgcgctggtgcactcgcgcggcaccgagccggtgcgcctcgcagcgtcacccgccgccgtcggccttaatttgagccgttacggctcgccgttggccgcccctccagcagcggacgcggcgcctcccgccgcaccggccaaggaccaggcgtccgacggcgggctggagcttgcgcccaccatcgccgttgagggcgtggagactgatccggcgtccgtgggaaccatcggacgccccgcccacggcatcttcttcaccaccggggaggccacgctccccggcgttcccgaccccgacggcatcctcacgcttgccccgctggaggccggcctgagcgaggaactgctgacgttcgtgaccgcgggcagcacgctgcatattcccgccaaggacgagtcccgcttcctgacgggcttctatccgaagctgaagcagacagcccgggtcacggcccgggacgagtccgtggaactccccgcactggctgtccccaccctgtccctgctggcgaactacggcgccgaccacagggtccgcctgcactgggagtggcactacaagagcggaaacctggtcacggcgcagcccctctggcggcatcccggggaccacggctaccgcgacgacaccgccgaggcccggatcctggaaggcctcggccacccgtgggacgtggtgccggccctgggtgagtccgccaccggtggctggggcactccgcggcttgcggcgtcagcggaactgaagggcctggacaccctgggcttcaccgaggaggtcctcccccggctgcgcgaagccccggacgttgaggtggacaccgtgggtgagatcgctgaataccgcgaggccgaggaagcgccggtggtgtccatttccaccaaagccaccgagcagcgcgactggttcgacctcggcatccagatcaccttggaggggcagccggtctccttcgcggccgttttttctgcgctggcgtccggccagaccaagatgctgctgcccagcggcgcctatttctccctggacctgcccgagctgcaccagctgcgtgcgctgatcgaggaggcgcgctccctgcaggacaacaaggacgcgcccctgcagatcagccggttccaggccgggctgtgggatgagcttgcccagctggggatcgtggatgagcaggcggccgcgtggcgttcagcggtgggcggcctgcttgaaggcggcgtggacggcctgccgctgcccgccacccttaatgcggagcttcggccgtaccagctggagggcttcaactggctcacgttcctgtaccggcacagcctgggcgggatcctggccgacgacatgggcctgggcaagacggtgcaggcgctggccctgatgtgcgcggcgaaggagctctcgctggcggcagcagatgcgtcagcaggccagtccgacgccggtgctccctttttggtggttgcccccaccagcgtggtgggcaactgggcggcggaagcggcgcgtttcgctcccggcctgaaggtccacgccgtcagcgagaccttcgccaagagcaaccaggccccggcggaggcactggccggcgccgatattgtgatcacttcctacgccctgttccggatcgactacgaggcctacgcttcccgcacctggtccgggctggtgctggacgaggcgcagttcgtgaagaaccaccagtccaaggcgtaccagtgcgcccggaaactgccggcggccttcaagctggccatcacaggcacgccgctggagaacaacctgatggagttctgggcgctcacctccatcgttgcgcccggcctgttctccagccccaagcgctttgccgagtactaccagaagcccgtggagaaaaacggcgacaaggggcagctggacaagctccgccgtcgggtccgtccgctgatgatgcgccgcaccaaggaccaggtgatcaaggacctgccgcccaagcaggagcagatcctggaagtggtgctcaacccgcgccaccagaaggtgtaccaaacacacctgcagcgcgaacgccaaaagatcctggggctgatcgaggacgtgaacaagaaccggttcaccatcttccagtcgctgaccctgctgcggcagctcagcctggacgcgtccctggtggacccggcactttctgcggtgcggtccagcaagctggacgtgctgttcgagcagctggaggacttggtggctgagggccaccgggcactgatcttcagccagttcaccgggttcctggggaaggtccgggagcggctggacgaggagaagatcgagtactgctacctcgacggcggcacccgcaaccgcgcggacgtggtcaacgaattcaagaacggcagcgctccggtgttcctgatttcgctgaaggccggcgggtttgggctgaacctcaccgaggccgactacgtgttcctgctggacccctggtggaacccggcttccgaagcgcaggccgtggaccggacccaccgcatcggccaggcacggaacgtgatggtgtaccggctggttgccaaggacaccatcgaggaaaaggtcatggcgctcaaggcacggaagtcgcagctgttttccgatgtcatggaaggcgatgccctggccggcggcgccatcacggcggaggacctcgcggggctgttcaaggagtaacggtaaaggcggggctttgtgccctacgcctgcaccaggaccggacctagtctgggatcagcagagcgactggcgggcgcctgccgaatcccgggaggcaaaccgtgaaaacggccaacgcgagcatcatcgccggcatcgtcctgatctcggcgggcgtactgctgctgctggacctgctcgacgtcatcgagagcgccgcctacgtcccgatgctgatcttcgccgccataggggccgtgttcctgtccctcttcatccgcagcccggagaactggtgggccgcgatccccggctcggtgttcctgggcctggcagccgtgattgccgcctcccaattttcggacggcggcgccggggcaagtttcctgttcctgttcatggccgccggattcgccgcggtctacctgcgccagcggggcaactggtgggctgtgatccccagcggcgtgatgctcacgctggcagtcattgttaccctcccgcaggatctgcagggcatgccggtggctgccgtcctgttcctgggcctggcggccaccttcggcgtgctgtccacggttcccgttcccgacgccggtcccgccgggcggatgaagtggcccctgatcccggcgtccgccctgggcgtgctgggcgtgatcttcgcactgcagtcgacggcactgctgatcgctgcggacatcctggtcctgaccctcatgatcctggcgggcgtcgctttgttgatctacgcttaccgcgcccttcatggcggccacggcaaggcgcacggctaagctgagagctccaaggaactacaacgttggagaaccagtgcaagagccgctcacgaccctgcgccccgacgccttcgggacgccctaccgcgatccagtctgggacggcccgacggatccgatcctggttcctgaccacctcaccggtgagtgggtgctgttctacacccagcgccgggccacggcgcccggcctctcaggagtggaatgggtgcacggcactgccattggcgcggcccgctcctccgacggcggtgcaacctggcagtaccagggcaccgtgaacggactggtgccgcccgaaactgaacttcctgcaaccctctgggcgcccgacgtcgtacgcatcggcgacgagtggctgatgtacctcagcgtcctgggcggagtgcggaaggactggagcggcaacgcagaaatcgtgcagtttgccagtagggatctggtgcactgggagtacctcggccccatcaacctcgattcgccacgcgtgattgacgccgccgttgcacgctgcggggacggccgctaccggctctggtacaaggacgaggcacgaggctccaacacgtacagcgcggtgagcgatacgccgcgtgacccctcgtcctggacggtggaaggcatcaccattcccggccgcccgcacgaagggcccaaggtcttcaggctcgagggaacgtactggatgatcgtggacgagtggcggggccaaggcatctaccgctcggcagacgccaccggcaactgggtccggcaggagcacttcgacggcctgatcctcacccaacccgagcacgtggacgggcggcccgtcgtcggacgccacgcggacgtggtgcctctcgaaccgggggaagatggcaacgaacgggccctgctggtctacttcacccacccccactggggcggcgaggacatcgacaccatgacgccggaccccaaaacccgcctgagccacatccggaccgccgttctggaagtccgcggtggcaacctcgtctgcaccgaacactaaacactgagttctggactaaccaggcacttcagaacatgacagagggccaaccctggaactataagccggctgctgccggcaccggcccagggtggccctctgcctgactcgtcctccggatggcaccacccggaatctttgggaacctacgcgcgctgcggagagcccagctccaccggatcctcatccgtaaggtaagcgagctcggagtgtgccgccaggtcgatgccgcgcatctcgtcctccgggttgatccgcaggccgatcgtcttgtccagagtcttggcgaggacccaggtgatgccgaacgagtaagccagcaccgtgacggttgcgagcgactggacgccgagcagctccacgccgccgccgtagaagagtccgctgactccgttcggggcagcatcggtggcgaagaggccgatcagcagggtgcccaggatgccgcccaccaggtggacgccgacgacgtcgagcgagtcgtcatagcccaggcggtacttcagttcaatggccagcgagcagactgcaccggcaatcgcgccgatggctaccgcacccagcgggctgaccgcaccgcaggcgggagtaatggccacgagtgcggagatcaggccggaggctgcgcccatgctggtggctgcgccgcggcggagccgctccaccagggcccaggccaggaggccggccgaggcagccacggcggtgttgaggaagaccaccgacgccgagtggccggcggacagtgccgagccggcgttgaagccgaaccagccgacccagagcaggcctgcacccaccagcaccagcggccggctgtgcggcttcgcgtgctccaccttgggccagcccgagcttttgcccaggaccagtgccagtgccagggcggctgctccggcgttcatgtgcacggcggtgccgccggcgaagtcgatggcctcgatgccgctggcgatccagccgccggtcacgctgccgtcctcggaggagaaggcgaacacccagtgggccaccgggaagtagacgatggtggcccagatgccggcaaacagcatccaggcaccgaacttcatacgcccggcagccgcgcccgccaccagcgctgtggtgacacaggcgaagaacaactggaaggccgcgaacagggccaccggaatggacgcttctgcgtcttcggccatcagctgccccaggcccgggaactctgtgacgtcaccgatcaggcccagcccgcccactgaattgccgaaggccagcgagtatccgaacagcgcccagaggacggccaccaggctggcgccgccgaagcacatcatcatcatgttgagaatgcggcgcgaacccaccatgcccccgtagaacagggcaagggcggggatcatcatgcagaccagcgctgcgctggccaaaatccaagcgacatttcccgaatccatgggaaacccctttcgtgatgcgaggagagaacgccaaatcgcccgttggagccactccggaggagggacgcggagtcagtaccacgttcatcggagggcagctattgccgtctggttccaactgtatggcggcagtattgggctgggtttccggggtgttaaatgatcgtttcggtcctccactcgcgagtttcagccgtcccgcagagcgcaggagcactaaaaccggcactggcgtcacgccaggcacccttttgggcggcagtggcgacaacccccggaatcacggcaaacccggcctgcacgggggccaaaagcgtgccgtgggtgacgccgcgggcggatcggggagcttcaacacctcacgccggatggcaaccggcccccggcaggcggctaagctgaggaaaacccggcagcacggcatacgcacggcggggggttcagcgggtccggcagtgaggatcctcgtcactggccgcggaaggaatacgtcatggcgcgagcgactgtccaagacgtcgccaggacggctggcgtctccgtggggaccgtctcccgcgtcctgaacggaagtccggccgtcagtgagtcgagcaaggcaaaggtggcggccgccatccgccacctcaattaccggccactggcttccgcccgcgatctgcgccgggaccgcaccatgcggatccttgccctggccaagaacttgtactcgccggtcatcagcgaagtcttccggggcgccggggatgcagccgccctgtccggctacgtcaccctcatcgccccgacagccggggacatggaacgggaacagcaattggtggacatgctgcgcaacggctcggtggacgggctgatcatgttttcgccaacaatgccggacgacgacgtcgaggagatggcggagcagctgagcgtggtccaggtctgcgagatcgctgacgccgaagcagcattcggcgtatccatcgacgaccggcaggcagccttcgatatcacaaggcacctcatcaggaccggcggccggcggttggcgatgatcggcaccagggtagcccggtccggccggctccgcgaggaaggcttccgcagggctgttgccgaagcggggttgtctcccgatcacatgctcttcacggacggggacttcgatttccatgccggccggcacctcgccagggagctcctcggcatgcgccccctgcccgacgccgtgttctgcggcagcgacacagtggctgccgggtgcgtccgtgaaatttccgacgctgggttgcgggtcccgggcgacatcgccgtcgcagggtttgacgactccatccaggcggagatgtgcgtcccggagctgaccactatcaggcagccggcctacgccatgggccagctggcttttgaagcactccttgcacggatgaccgagccggaagggtaccgccgcgggcggaccttcctcccccacgagctggtggtccgggattccaccaacggctgaggccaagggttgacagtccaacgtggctcctgtcacacttctttggaatcgattccaaacattacggacgttgcttttcctccgccatggaatcgattccaaatgaccctcgaaaaagaagccaaccaggcaaaggagccactcgtggacttgattcgaccttcctctccgtcgcaggaggacaccaccgccgcatccgtgctcagtgcgcgcaagagcgcaacgggcagcgcatcccggcggcgcacacgcatcaccgccgccgcggctgcggccatggctgccggcctgctgctgaccgcgtgcggtggcggagctgccacccagggaacggaggcacccgccgcggatccggcgtcggccgccaatgccaccggcagcctcaacgtctgcggcggcaaggacgcttccggcatctacaagggcacggttgaggccttcaccaaggccaacggcaaggtcaccgccaagtacaccgaaatcggggccaccaccgatgaggcccgcacacaggccgtacagcggctcgaaggcaagtcctcggagtgcgacatcttcgtcacggacgtcatctggacctccgagttcgcatcccagggctggatccttgaccaaaccgaactcgtcgaggccagcaaggaccgctttatcccctccacggtggagaccgctaagtacgaggacaagtactgggcttccccgttcttcaccaacgccggactggtctactaccagaaggacaaggtagccaaacccgaaacctggcagcagctctatgctgaggcagccggggctgagggggacagcttcgtctaccagggcaagcagtacgagggcctcacagtgaacttccttgaaatgctttacagcgccggcggagaggtgctggacgagaacggcgaagtcaaaatcgactcaccggagacccgtgaagttctcgacttcatggtgcagggcctcaaggacggcgcggcggaccgcgcagtgctgacctacaacgaggacccggcacgcctggcctacgagtccggcaactttggctaccagcgcaactggccgcacgtctaccgcctgctcaacgccaccccgctggcgggcaccttcggcgttgccccgcttccggcctgggaaggcggcaaggcctccggcgtcctgggcggctggaacctggccatctcggcccactcggcaaaccaggccggcgctgtggccttcattgatttcgccaccaccccggactggcagaagcacgtggccatggacttctcgcaggcccccgtcaacgaagcagcctacgcagaccccgaggtcctggcgaagatgccgtttgccaccgaactgctcgcctcggtgaagggtgccaagccgcgcccgatctccccggtctacccgcagatctcccaggcgatctacaagaacgtctacgccgtgctctccggcaccgcgacaaccgagaatgcggtgaagacgatggccgaagagctcacggccgcaaaggcgagcttctgagcatggcgaccaaattcctgtcccccggccgccggggaacaagccgcggcgtcagcggccgtgaccgggaggagcggcgcctggcgttccggatgaccgctccctccctggtcctcatggccctggtggcggcagtccccatcggctatgccctctggctgtccctcaaccagtacagcgtccgtaccgccggcctgtcacgcttcgtcgggctggataactacgtcgcagccctcaccgggacgcactggtgggccgccttcggccagaccttcctctttgcagggctctcggtctcactcgaactggtgcttggcacggcaatggcactgctgctcaacctcgccttcaagggccgcgccctcctgcgcaccgtggtgctgctgccctatgcggtggtgacggttgtcagcgccatcacctgggaaacgatgttccagcccaacctgggcctggtcaccaacgtcctgtcaacgctgggccttcccggcggcgatgtcgtatggctcggcgagcacggctacgcgatggccgtgatcgtccttgccgatgtctggaagacgacgccgttcgccgccctcatcatcctggcaggcctgcaggtcatctcggccgagacctacgaggccgctgaactagacggcgccagcaagtggcaggccttcctttacgtcaccctgcccctgctccgtccggcgattgtgctggcggcgatcttccgcaccatggatgccctgcgcgtcttcgacctgccattcgtgctcacccgcggcgccaacggcaccgagtcaatgtccatgctggcgtacaccgagttgcgcgaaaaccgcctggtgggtgaaggatcggccctgtccatcctcaccttcctcactgtcatggtggtctcagtggtgtacatccgcttcgctggcgggaacatccgtgaagttgccaaggaggaacaatgagcacgctgaccccacagcgcacggcggcggagcccgccgcccccggcgcacggacacccaggcgcaggccgcgcggcagggcagagctgcacccggtggtgtgggtattcgtcatcgccgtgatgggcttctcgctcataccattctactggctggtcaacacctccctcaaaaagggcgtaagcctgtcccagggtgaactcttcccaagccagccgaccttcgagaactatgcggctgtattccagaacgcggagttcctcctggccctgcgcaactcggtgattatcgccgtcgtcaccaccacggtggccctggtgttggcatccttcgccgcttatgccctggccaggctcaaaatgcgccgtaaggcgctgatccttaccctcgtcctctctgtcaccaccttcccggccattgccatcgcggctccgctgttctccatctggcgggaaatcggcctgtacgacactctccttggcctgatcatcccgaaactgacattcgcgttgcccctggcgatctacacgctgacctccttcttcaaggagatcccacgcgaactggaggagtcggcctacatggacggggccacgccgttcacagccttccgcaaagtcatcctgcccctggccgtcccgggccttgccacgacggcgatcctcgtgttcatctcggtatggaacgaattcctgcttgccgtcaccctgaccacttccccggaggcccgtccggtcccggtggccattgctttcttcagcgggaccagcgagtttgaccagccgctgggcaccatcagtgcggcctcggtgattatcacaatcccgctggtcgtcctggtgctcctgtgccagaagcgcattgtctccggcatgaccgccggcgccgtcaagggctagaaacccaaaagttcccacccacaagaaaaaggaaaaatcccgtgagtaacgagcagtcccccagcctgcaggcttctgccctgcaagaaccacactccaaggaactgagggtaggcgttgtcggcatcggctgggccggacagcagcacctcatggcctaccacgccctggaaggcgtccgcattgtggcgctggcgggaatggaggaggaactccgcgactcgctgcaggccgaatactccattccgaacgcctttgccgactggaaggacatgctggaaaacggcgggctggacgcgatcagcgtggcagtgccaaccttcctgcacgcacccatcgccatcgccgccctggaacggggaatccacgtgctgagcgagaagcccatcgcgcgcaacgccgtcgaaggccaggccatggtggacgccgcccgcaaggctgggcgcgttctggacgtcgccttcaaccaccgccgccgtggcgacatcaaagcgctcaagggtgtcattgacgacggcgggctgggccggccgtactacgccaaggcctcctggctccgccgctccggcatccccaccctgggcagctggttcaccaacccggagctcgccggcggcggaccgctggcggatatcggcgtccacgcgctggactacgccctgcaccttctcggtgaacccaaggtggtggccgtctccgccgcaacgcactcggagctgggcccccaggggcggggcggcggaagccggtactcggcgcaggccaccagccacgcgttcgaggtagaggacttcgcgtcggcgttcctccggctggagggcggcggcacactggtgatcgaggccagctgggcaacctaccgggaaacggacgaccttctggacttcaccgtctacggcaccgacggcggcgccgagctcaaggtgcagggcgcgccgttcccgcctgtgggccagctgcgggtcttcaccgacaaggagggcgaatccgccgattacgtaccgccggtgcttccgggccgcgcccatgacgcagtggtggaagacttcgtaacggcagtgcgcggcggcgagcaggcctggggcgagcacgacggctccctggcgctgtaccgggcacagatcatcgatgcgtgctaccagtcggcacgcgaacagagggaggttcgtctctaatgaccgacaagctgagaatccgcgtctggaacgagggcgtccacgaggctattaacgagccgtcacacatcggggagatctaccctgacggcatccacggcgccatcgccgcagggctccgctcccactaccccgaggcggagatcacgacggccgtgctggccaccgacgacgagcacggcctggacgaggaggtgctcgccgagacggacgtcctgctctggtggggccacatggcccaccacgaggtgagcgacgccgtcgtcgaacgcgtccaccgccacgtgctcggcggcatggggctgatcgtgctccactcggggcacttcgccaaggtcttcaccaagctgctgggcaccacctgctcgctggcctggcggaacgacggcgagcgcgagctcgtgtggaccgtgaagccgtcacaccccattgccgaaggcgtggacagccccatcgtcatccccgagcaggagatgtacggggaactgttcgacatcccggacccggacgacctgatcttcatcagttcgttcgccggcggcgaggtgttccgctccggcgtcaccttcacccgcggcaagggacgcatcttctacttcagccccggcgaccaggagtacccggtgtaccaccacccgcagatccagcgggtcctggccaacggcgtgaagtgggcggcccagccggagctgcaccgttccgtcccggaggtcaccaaccctgcgcggaactggttcggcgaggcgtaggagtttttgtccaggtatgcaggcttccgaggcctctaagtcgtcttatctggacaaaaactccaatgctgcggcgccggccccgctgccctagctgcggatttccccatagccggagcgggttccagcaggtagaactgagacatgactaccccagagctggtgctaggccccatgatgcggtacgtggaccagacctcggcgagcatctgggtggaaacccgggacaacgcccgcgtgacggtggccgccggggccggggagtgggaagcccggaccttcgccgtccacagccaccactacgcgctcgtggaagtggacgggctggagccgggatccgtaactccctacacggtggcagtcaacggagtaccggtgtggcctgagcccggaacccggttcctgccgccggtgatcgccaccctcaagcccggcaagccgctgcgcctggcctttggttcctgccgcaccagcgtcccgcacgacgagtccggaaaccggagccacggcgtggacgcgttgcgggcctacgccctggaaatgggctccggcggcaaagagccctggccggacctggtggcgttcctcggggaccaggtctacgccgattccaccagcgagcagatgcaggacttcatcaaagcccggcgggacatcacggcgcctcccggcgaggaactcaaggacttcgaggaatacgcgcacctctacaacctggcctggtccgaccccgccaaccggtggctgctgtccacgctgcccagtgccatgattttcgatgaccatgacatccgtgacgactggaatgcgtcgcggagctggcgggaggccatgtccaaaaccacgtggtggcatgggcggatcgtggcggggcttgcgtcctactgggtgtaccagcacctggggaacctgtccccggaggagcgcgccgcggatgtgatctggcagaagattgccgcccaccgcggggacggtgaaccggacatcagcgccgagctggaccgtttcgccgaacgggcggaccaggacccggaagcctatcggtggagcttctgccgcgattttggcgacacccggcttctcgtggttgattcccgcgcggcccggaacctggacccggaccaccgcgccctgctggatgatgcggagatggactggctggatgcccggatgcgcggcggtttccgtcacctgctggtggcaacatccttgccgttcctcctgcccatgggactgcaccacctggaggcctgggacgaggcagtctccgaaggcgcctggggcagattcccggcgcggatcggtgaaaaactccgccaggccgcggacctggagcattggggcgccttccaggagagcttccggcgggtggccgcgatggccaaggaagtggccgacggcgggcgcgggcctgccccggacagcgtcaccttcctgtccggggacgtgcatttttcctacgtctccgaggtggagcggactgcgggcagccgcatcatccaggcggtctgctcacccatccgcaatccgctcccgcggctgatgcggtccttcggcgccgtgatgtcctacggcctggccacgccgatcggagcattggccgcacggtcagccaaggtcccggacccgccgttccgctggtccgggatcaagggcccgtggttcgacaacaacctggcctgcctcgaagtggtgccggaagggctgaagctgtggtggcagcggggcgtcgtggagggaggcgacaacctcaatccgcgcctggaacgcgtggcggagataacggtcgcgtcccgcaaggccgggtcaccggccagggaacggatgtaaaaccgctgacgcagggcccaactgccgcctgagccgggccacgagcgtggcggcgagcagcgccgtcgtaagttccaagccaatgaccatcaacagttgggcagcgccggttgtgtccggaatgcgcgacgagggccctccgccgtgggcgtgtcccgcaccgcctgctcccagcagcaagacggcatgcagcgcggccattgcgacggccgccgccgcgacctgctgcagtgcgcccacgcggccgtgccgccagatatggaaggcacagggcacgcacacggcggccagggcaaccatcaggacgccaagccacgggtcatggtggcccgaggccgccaaccacaggtgcaccaggcaggaacctgcggtgaccgtggcacacatgcgccggtgcaggacgggccctgcctcccggaccctgcccgccgtcgtcgctatgtccagaatcccgtggccggtcctagtggcagccaccaacgcctgcatcactgtggcaggccgacgccggctggttcgggttggccggaacgtccaggacggggctgtggtcgaagaagccctcgggacggagcttgaagcctacggtgtccaccggcatgatgggccagtcctcaacacgcgggaagtgcgtcagcccaaaggtgtgccacaccacgatgtcctggccgtcgatgtcccggtcctgcgcgacgtattcgggcaggcctgctcccccggagtgctggttcacgaaatcgcccgtcgggtagcgctcctcctccgcgtaacgggtgacccacaggtccttggtggcgaaagcggcgcggcgggcgatggaggagtccggatcggccagcagcgtgggctggttgtgcgagtggagcttgtagcccaccggctcacccagccggttgcgggactcggggttggagatgatccaggtccggccggcgcgtgcgtcgccctcccggacggcctccgattcacgggccaaaacggtgcgcttgcgggagaaggcgttgccgcgctcattgcccggccccatggcctggcggaccacgtcctcttcctccacccggttggtaaagccgtcgatggccatgtccaaccgggcactgaagagatgctggtggaacggagcgcccaagcccggtgccagttgggagatgttggcggaaccgccatccgggaacgcggaggtgaacacaacgccggtggccttagcctcgaattcgatggtgccgtccaggtagaggtaccagtagaagccgtaatcgtagttgccgatggtggtgaagaaggagatcaccaggcggcggttgcggcgggtgtagttgatcccggaccagagatccgagtgcttggacaggatgccccagtcctcctcgtgcatgcagatgccattacggatctcgcgggggttgccgaaggcgtccgagatgaccgggctcaggtaggtgatgtcccccaggcagtcacagcccagttccagggagttggcgtactggcccaccaggtactcaccggtgtcgaagtagttctgccaggaacggatgggtgacggatcgccgtaagggaccaccatctcggcaatggaagcacggttgatgatcggccggaggcgctctccgtcctggaaggagaggttgtgcaggaccacgccttcacggacatcgaagccgacgtccacgctccatttctcccattccacgcggttgccgccggtgacggtaaagctggggccttccggctgggtgatgctgatgggcttctgggtggtccgcagcggtccggtcagttccgggtccgtgtagttgccatgctctgcgggcaccggcatggcgccgaggtcgatgacctgggtgacttccttgttgaccacgtccacgtacgccaccagcccgtccaccgggtgcgcccaggcgctgtcctccgggaactcctggacgaacgccaggccccgaaggatgcgccggcccttctcctcggtgtactcgaagactccagccgagagcggcgccacgcggactttgtggacgtcaaggtcccttgcggcaagggccgccagccagcgcttatcggtggccaacagggactccaccacctcaaactcctcctccagcaccgggagctcaccggtcaccgcggtgtcgagttcgacgtcggacaccacctttccgtgggtggcggagacgatcacatcgcggggcgcaccgccggagacgtcgtggatgaagacccggaagcgccggtcaacctgcccttccgtccgggcttcagccgcccgcggcggctccaggagaccgaggtaggcgatgcggtgctgcggacccaggtggcccccggaggataggacggaccggacctcgaggatctcgtcgccggtggccagtcggaagggggacgcgatgtcagttggagcgagtgtcatggtgaacctttgtccggaccatttcgggtcggtgggtttattttctatagttgtagagaataaacctccgtaacatggctcacaagagtctgagcaaaatatttcctgggagtggcccgcggtgccgaagatagttgaccatgacgagcgccgcctggaactggtggatgccacctggcgcatcatcgcccggcagggcctggaaggggccaccatgcgcgagatcgcgatggaggcgggcttcgccaacggagcactcaaaccctacttccccaccaaggacaccctcctggaattcgccttcggccacgtgttcaaccgcaccaaccagcggatcgccgaggtcacccgcggcaagtccggcctggctgccctgcgcgccttctgccgtgaggtcctcccgctggacgaagagcgcgtcaatgaagcgcggatcgttatcccgttctggcagaaggcggtcaacgacccacagaaggccgcgatccaccagcagtccatgaacgagtgggcaaccaccatccggcacttcctggccgaggcgcgggacagcggcgacatccacgccgccgtcgacgattccatcctggccggccaactcctgaacatgctgctcggcgcgcagatcgaggcggccctggcaccggagggcggcagggacttcggacatgccgcacagctcgaaggctacctggccctgttgtgaccagacctcctgacatccccgccgggattgacacgccggacatcctgatcgacctcgacatcctcgagcggaacgtcgcccggatggcggaaaccgtccaggcaaaaggcctcacccttcgcccgcatgccaagacacacaaaatccccgagatcgctgcgctccagctggaggccggggccgcgggactgacggttgcaacgatcggcgaggcggaagtcttcgcagccgccggagtgaaggacctcttcatcgcctaccccttgtggacttcagcccggaaggccgaacggctgcggcgcctggcagacacggcaacggtgtccgtaggggtggactcccctgaaggcgcggcgaggctcggggcaggcctgggtccggcggcgtcaagagtcggcgtgctggtcgagatcgacagcggccaccaccgcagcggcgtccacccgggcgcagctgcggacgtggcacaagcagcgtccgacgccggcctgaaggtggcagggatcttcacctttcccggccacagctacgccccgggaatgccggcggaagcagcagcgcaggagcaggaagccctgcgggcggccgcggaatcgcttgccgcagccggattcgaggccaccgtccggagcggaggctccacgccaacagcgctcttgaccgacggcccggtggctaccgaggtgcgcccgggcgtctacgtgttcggtgacgcccagcagcttgagctcggcaggtgtgaaccggaggagatagcgctgaccgtggcggcaacggtggtaagccaccatgaggccaggtccggcatgccggaccgcttcattgtcgacgccggcagcaagatcctgggcagtgaccggccagcctgggccagcggctttggccgcctgatggattaccccggagcccgcatcaccgccctctcggagcaccatgccacggtcgaatggcatggccccggaagaatgcccgcactgggcgcccgcctgcgcgtcgtcccgaaccacgtctgcctggccatcaacctcgtagacagcgccgccgtcatcagcgccggaaaaattaagggccgctggacagtggcggcccgggggaagaacgcctagccctcggcggggagagtcttttttcgccgactgttgaaaaaagaaacggacggccctaacctgaagggactgtgttgcaggacacagctcccgggggaacgtcagatggccatccgtcgtcaggaacatccatgccagcaacagcaaatactgcggcccgccccgcacaccaaaacctcacgtccagcgtcgccacctcctttgaccactggaagcacctggtggccgagtccttcgtgccgctcgccgcgcagacagcggacgtggacggtttccgtgggcggatgcgctcgcgggtgctggaccggatgtccatcgttgaagtcaccgccacgtcccacgaggtgcaccgcacgccggccctgattgcccggacccatgagcgctatttcaagctcaacctgcaactggagggcaccggcttactcgtccaggacaaccgcgaggccgtgctccggcccggcgacctggccatctacgacaccaaccgcccctacacgctgacgttcgaggagcaggcgcggatgatggtggtgatgttcccctgcgacgcactgtccctgcccgccgattatgtgggccagctggcagccgtgcggatggcgggcagcaccggcctcagcggaatcgtggggcagttcatccgccagctctcagagaacctggacgtcctcagcgggcccagcggttcgaggctggcagccaacgccctggacctggtgtccaccatgctccacgccgagatggacatcgcgccggaccggatgaagccgcaggcactcctggcagtttcaatccgggagtacatcgacgccaacctgtccgatcccctactgtcgcccgccaccatcgccgcggcacacttcatctccacccggcacctgcacaacgtcttccatgaatccgggacaactgtggccagctggatccggagccagcgcctggaaggtgccaggcgcgatctccgcgacccgctgcatgccgggaagtccgtgggcgccgtcgcggcgcgctggggattcctggatgccgcgcacttcagccgcaccttccgggacgcttttggcgtcccgccgagcgactggcggcggggcgggtagcgccccacactgagtcccgggccatcccacgcctggaggaacgacgacggcgggtggcgctagatgagcccctgggcgagcatcgcgtcggccaccttcacgaaaccgccgatgttggcgcccaggacgtagttgcccgggtccccgtactcgtcagcagttgacgcgcaccggtggtggatgcccaccatgatctcggtcagccgctcttccgtgtgctcgaaggtccaggaatcgcggctggcattctgctgcatctcaagcgcggacgtggcaacaccgccggcattggcggccttgcccgggccgaacaggacgccggcttcctggaaaacggcgacggcctcgcgggtggacggcatgttggcgccctcgccgacggcaaggagtccgccgcgcaccaacccggcggcagcagcgccgtcgagctcgttctgcgtggcgcacggcagcgccacagaggcgtccacgtcccagacggagccgccctccacgtaggagacgccggaacggcgctcggcgtagtccttgaggcggccgcgttccacttccttgacttcgcgaagaagcgcgacgtcgatgcccgcctcatccaccacgtagccggaggagtcggagcaggccaccacggtggcgccgaggtcctgggctttggcgatggcattgatggcgacatttccggagccggaaaccaccacgcgctggccgtcaaaggatgcccctcgggtcttcagcatttcctgggtgaagatcacagttccgaagccggtagcctcgggccggaccagggagccgccccacgagatgcccttgcccgtgaggacgcctgattcgtagcggttggtgatgcgcttgtactggccgaagaggtagccgatctcccgcccgcccacgccgatgtcgccggccgggacgtcggtgtattcgccgatgtgccggtacagctcggtcatgaaggactggcagaagcgcatgacttctccgtcgctgcggccgcggggatcgaagtcggagccgcctttgccgccgccgatgggcatgccggtgagggcgttcttgaagatctgttcgaagcccaggaacttgacgatgcccaggtagacagaggggtggaaccgcaggccgcccttgtaggggcccagcgccgagttgaattccacccggaagccgcggttgatctgtacacgtccggcatcatcggtccagggcacgcggaagatgatttgccgctcgggctcgcagagccgctccaggatggcggcttcgaggaattcggggtgcctgtcatggacgggaccgaggctctcgaagacttccaccaccgcctggtggaactccgcttcgcccggattcctcgccaggacagtatccctgatggcttccagccgtgaatccatgtgtctccctcacctctgcgtgaacgtggaacggccgaaagcgatcccggacgcgcctatagttgagatttcaactttatccgattatgaccgggcgcccccaagcagcctgccagacatcctttattatccgtattatgacagatttattccacagaacgaaaacatggtgcagttcggcctgcatccgcgagaccgcctgatggcgcacatctgcctgctgctgtccggggcggccctgctcctcaacgggctggtcatgctcggattcctgccccgccgggacgcagccgtattcagcctggtggtgggatccgtccagctggcgctcggcgtgggctacgttgcgacggctggagcgggcgcaacgccgctgctgactgctgcgggaatgttcctgttcggcctgacgtacctctatgtggggctggacgtcctgctgcgcctcggttcggggggactgggatggttctgcggcatggtgggaggttttggcctgctgcttgccacggcctggctgggaacagatcccctgctggcggtcctatggttgtgctggtcggccctgtggggactgttctttgcgtccatggcagcgggcctgggacgcctggaccccttcatcggctgggcgcttgtgctgacgagccaggtgacagccaccctccccgctttcctcggcctggcgggaatgtggccgcgtgagcctgtcgtggcagggctggcagcagctttcctggccgcgctttttgtcctggcaggcatcctggcacgcgtgccggcccggcgcagagttgctcctcgccgggccggtacagggcacgttgccgtttctgctggctccaaagcgcccgttagttgactgtatggccgaggctctccgccttgtgccggcgctgcacccgggcctccaccagcaccccggccgcaaacacaacgggtacagccaccaggagtgccgctgccgtcccggcgctgccgccgatcaatgccgtgaagttgctgaccaccaggaacaggacgcctcccagcaacagggccgcgagcgccggtgcgatcagcgtctgccacagctgcgcgtcatcgcgctcccggcggaagtagccgacgacggcgatggagcagagtatgtacagcaccaggagtgccgctacagccagtccgctgaaccaggagaagagggtcagcacgggatccagggcgaggacggcgaacggaaccatgaggacgacggcggcagccgtctggatccaggcggccacagccggagcacggtggcggttggtccgggccaggatggcgggcatggaaccgcgcagggccagggagtgcaggtagcggttgatgccgttatggaaggcgatgatgcctgccagcagtgacgtcaccagcaggacgccggtcaccacgcccgcccagggaccgaacaactccaccatcggccccaggacgaatgaggtggagtcgcctgattcaagggccgctcctgccacatccatgacccgggacggaccatagtagctgaccagcatccaggagatgaaggagaagaagacggcgatgacgccaacggacagataggttgcccgcgccacggtgcgggcagggtccttggcctccgccgaatagatggccgtcgactcgaagccgaacatggatgcgaccgcgaacatgatggccaccccgggggcaccggcggcgatggcctccggagagaaggatgctgccagactgatgccctccgggccgccgccgctgaacagcacggcgaagccgaacagcagcagcacggccacctccaggcccaccagcactgccagaacgcgggcgccgagttcgatgttcagggagccgagcacctggacaccggccacggttgccagcgccaggagccaccaggacacctggaggcccatcgaacccagaaggccggagaatgcagcgccgtacaggccgtacatcgcagcctggatggtgttgtaggccagcagcgccagccaggcggcgcctgttccagtcttcctgccgaatgcggcagtgatgtaggcgtagaaggcgccgtttgcctggatcctgcggctcatggccacgaagcccaccgcaaagatggcaatgacgatgccgacgatcaggtaggccccgggtgcgccggcaccgttgccaagggctgcggcgagtggtgaagctcccacgatgccggtcaggggcgcctgggcggagaggacaaagaagaggatgcccaggacgccgatgctcccggcgcgaagggctgtggaatgctccttggccggagcgtcggtggtccgggactcggaattcgaaatactcattgggtccttcttaatggtcatgagcgtggggacgagctgtggaatccagcgtggcagcgggcggctgcagcgctttgtccgtcagcgatcagttcttgtccatcagcgcagggccgtccgcgaagtcccatcggcgcagtgccgtccgggcaacgccggaagcggcgccggagtcccggcggcagggtgcgtacacagacacacgccgtccggggctgagctcaggaagccgcaccccgccgccggacgctcccccgggcgtgtgacatgggatactgccgtaacaactttcctgccggaaatgccggcggaagccggaaggggttgtgggcatgcaggaatccgtcagggtggacgaaacggcgctggagcgcgtgctggacgcgctgtcacgcgaacgcagcattggactccgccctgatccggcgttcgaccggcgcctggagcaacacttcccggacctgtaccgcctgttccggtccctgtacggatcccggcaggactggctggaccagctcattgccctggtggtggagagcgcccgctcgtggcaggagcgccccgccgacctgaaggccctggacgcccggcgggaagcagacagcggctggttcctgtccaacaccatgctgggcggcgtctgctacgtggatcggtacgcggacagcctggacgggctccgcaagcacatcccgtacttcaaggaactgggcctgacctacctgcacctcatgccgctgttccttgcgccggagccacactccgacggcggctacgcagtatcgagttaccgccaggtcaacccgaagctgggcaccatggaacagctccgcgaccttgcggctgagttccgcggccacggcatcagcctggtggtggacttcatcttcaaccacacctccgacgagcacgagtgggcccggagggcagctgccggcgacccgaagtacagcgactactactggatttacccggaccgggccatgccggacgccttcgagcagaacgtgcgcgagatctttccggagaaccacgcgggatccttcatccagatggaggacggccggtgggtgtgggccaccttccacacgtaccagtgggacctgaactactccaacccggacgtgttccgggcgatggccggggagatgctgtttctggccaaccagggcgtggacatcctgcgcatggatgcggtggcgttcatctggaagcagctgggcaccccgtgcgagaacctgcccgaggcccacatcctcctgcaggctttcaacgccgtgtgccggctggccgccccctcgctgctgttcaagtccgaggcaatcgtgcacccggacgaggtggcgctctacatcgaccccgccgaatgccagctctcctacaacccgctgcagatggcgctcatctgggaatccctggccacccgggacgtctcgctcctggcccaggcactggagcggcggcacaacatcccggacggcacctcctgggtgaactacgtccgcagccacgacgacatcggctggacgttcgccgacgaggacgcagcagagctcggaatcaacggcttcgaccaccgccgctttctgaactccttctatgtcaaccgcttccccggcagcttcgcccgcggcgtgccgttccaggacaaccccaagaccggtgactgccgcatttcgggcacgacggcgtcgctgtgcggcatggaggtggacccggctgaggcggtggagcggatcctcctggcccactcggtggccttcagcaccggcggcatccccctgctgtacctcggcgacgaagtggggcagcttaacgactacggctacgcgaaggaggaagggcacgacgccgacagccgctgggtgcaccggccccactatccggaggaacagtacgcccggcggcacgatgtttccatgccggaaggcgcggtctacgcgggcctgaagcggatgatcgaggtccgcggcgctgctcctgaacttgcgggaacaacgctcctcgatttcgacacccacaacaggggcgtcctggcctaccagcggccggcaagtgcggccgacggcggggagacgagaatcctggtcctcgcgaatttcagcgacgaaccccagtccctgcccgccgaaaccttctccggtttctcaggcgccgccgtcgacctcctctccgaagccgcactgcagctgggcgagggcgtcacgctcctcccccgccagtacgcctggctgcgcgtcactccgcggcactgattcggtccgtggggccggggcgtgaaaccatacggatcatggcccagaagattgcgtaccagggtgagcccggcgccaactccaatatcgcgtgcaagcagatgttcccggacatggaaagcgtgccctgcgcgagcttcgaggacgccttcgaactggtgtctagcggcgaggcggagctggccatgattcccatcgagaactccattgccggccgggtggcggacatccacatcctgctgccgcagtccaacctgcagatcgtgggtgagttcttcctgcccatccacttcgacctgctgggcatcccgggcagcaccattgaggacgcaaccgaggtgcacagccacatccacgccctgggccagtgccggaagctcatccgcgagcacggcctcaagccagtcatcgccggtgacactgcaggctccgcccgggaggtaagcgagtggaacgatccgcgcaaactgtccctggcaccgccgatggccgcgcagatctacggcctggacgtcctggcctcaagggttgaggatgacccttccaacaccacccgcttcgtggtcctggcccgggaaaaggagctgccggcccgggatgagctttccggaccggcagtgaccagctttgtgttccgcgtccgcaacgtcccctcagcgctgtacaaggcactgggcggctttgcgacgaacggggtgaacatgacacggctggaaagctacatggtgggcaacgagtttgccgccaccatgttcatggccgacgtcgagggccaccccgaggacctgccgctgaagctggccctcgaggagctggactttttcaccacggaggtgcggatcctgggcgtttacgctgccgcggaataccggacgggtcagacagtcagcggctgaccggcgttgtgccggcccggcagcagcggagcaaagaatgcgcccagctctgccgttgccgtgagcggcaggacgttcgccacgtactggtccggccgcaccaccaccacaacgccgccgcggtccaggccgcggagctcgaaaatgtccgctttggggtctgtgccgtagaccttctcgtagtcggtcagcctgaacgggcccacctgcggcttgaagaccgccggcaccgcgttgatgtcaaggtccgtgtggggctgctggtagatgaccttgacgtcgaaccaggcatcgggatcagcgtccgacggcgttgccgccagcggtgactcggccccctccgccagccactgggccagcttgtccgtggcagagccggtgcccggaagcgcggcatcggcgaacacgtagatccgccagcgtccgtctgctgtggcgtggtggcccagatgcatgggattggtgtcgcctacccgcaccacgggcgctgacttgaaccgcttgcccaccgggaagccggcggcaagggcctggtggcctgccggtgccaccagcatggacggcgcgtactcggtcatgaaaccggccgggaactcggcagtgcggacatagaagtcctcaaggtccgaggggttctcgaactcctcgggcttcttggccatcatggtggaccattccttgtcgaagtcgatcaggttcttggccaccacctggcgctcctccgagtaggtggagagcaagctttccgggctgcggccttccagcacgtgccccagcttccaagccaggttgaaaccgtcctgcatggacacattcatgccctggcccgctttggcactgtgcgtgtggcacgcgtcgccggtgatgaacacccgtggggtccgtgcgccgcggtcctccggcaggacgtcgtcgaacctgtccgtgagccggtgccccacttcgtagacgctgtgccacgccacgttgcgcacgtcgagggtgtagggatggaggatctcgttggccttggcgatgatctgctcgatggttgtactgcgcacggcgtgatgggtagccggatccacctcacccaggtccacatacatgcggaacaagtacccgccctcgcgcgggatcagcaggatgctgcctttttcgccctggatggcgcacttggtgcggatgtcggggaagtcggtcacggcgagggtgtccatcacgccccaggcatggttggcctggtccccggcgagggtgcagccaatcgctgcgcgcactttgctccgggcaccgtcggcaccaataacgtacttcgcccggacaatgcgctcctggccctcgttcgggccgtcggtatgcagcagcgttacgctgacgggatattcgtccccgtccgtgatgctaagggactggaaatcgtagccgtagtcgggcgtcatgcgggtgggtgcgttggccatgtactcggcgaagtagtccagcacacgggcctggttgacgatgaggtgcgggaactcgctgatgcccatctcgtcgtcgacggcgcgggcggcccggacgatgttggcgcggttcgcggggtccggcttccagaacgccatctcggtgatgcggtatgcctcggcaatgatgcgctcggcgaagccgaaggcctggaaggtctcgacgctgcgcgcctggatgccgtcagcctggccgatggcgaggcggcccggacggcgctcaatgatccgggtggtgatgttcgggaagcgggacagctgcgctgccgcgagcattccagcaggcccggtgccaacgatcagcacgtcgacttcctccggaagctcctggggccggttcaggccaacgccggcggcgggcaggactcgcgggtcaccggatacgtaaccgtggtggtggaattgcacgggatttcctcacttcgttgtggtggattatcgctacttcgcagcagttgcctgcccctgaagctggtgttctatataagaacacccaattcgataatcgaaaacttgaactttggcttccactgtacgccggttgtgatccaggcgacaagtgccatattccccgaaagcacaacgccagaattggggggttgacgatccgctctcgagggacgatagtgatcgtatacgatttcgtacctgatgaggagacagtcttggagcacgtcaacggcgacaccctggcagcagcacggaaggtggtcgcggtgcacatcaactaccccagccgggcagcccagcgcggccggactcccgcccagccgtcgtacttcctcaagccctccagctccctggccctgagcggcagcacggtggagcggcctgcaggctgtgagctgctcggctatgaaggcgagatcgccttggttatcggcaaggctgcccgccgggtgggcatcgatgacgcctggagccacgttgctgccgttaccgccagcaacgacctcggcgtttacgacctccgctacgcggacaagggctccaacctccggtccaagggcggcgacggtttcacaccggtaggcccgggacttatcccggcagacgccgtcgaccccgccaacctgcgcatccgcacctggcacaacggcgagctggtccaggacgacaccaccggagacctgctcttcccgttcgcccggctggtggccgatctgtcccagctgctcaccctcgaagagggggacatcatcctcaccggcaccccggccggcgcctccgtcgccaagcctggggacgtcctggaagttgaagtttccgccggtggcctcaccaccggccggctggtcaccaaggtggaagcgggcacgacgccgttcgcggattttggtgccggacccaaggttgatgacctgcagcgggaggaagcgtacggttcgcgcgcagcggcggggctgccggcgggggcaggcgtcctcactccggagctgaaagcgaagctggaaagcgtggccacggccaccctgtcctcgcagctgcgaaagcgcggcctcaacaatgtgagcatcgacggcctgcaggcaacccggccggaccgccgcgtggtgggactggcccggaccctgcgttacgttcccaaccgtgaggacctcttcaagacccacggcggcggcttcaacgcccagaaacgcgccatcgattccgtgaacgagggcgagatcctggtcatggaagcgcgcggcgagaagggcaccggaaccgttggtgacatcctggccctgcgcgcccaagtgcgcggcgccgcggcaatcattaccgacggcggcgtccgcgactacaccgccgtggccggcctggagatgcccacgtatttcgccaacccgcatcctgccgtgctgggccgccgccacatcccgtgggacacggatatcaccatcgcctgcggcggcgccacagtgcagcccggcgacatcatcgtggccgattccgacggcatcctggtgatcccgccggccatcgccgaagaactcgtggatgattgcatcgcgcaggagcaggaggaaaccttcatcttcgagatggtcaagcagggcaacagcgtggacggcctctacccgatgaacgccgcctggcaggcacggtacaaggaatggaaggccggcaatatggcaccggttggcagcgccgatgactgaaacaaccttcaccgacctccccgtcgcagcccctgccggcagcaagtccgaacaggcgtaccgggcagtcaaggcccgcatcgtagagggcacctacacccccggataccgcctggtcctcggctctatcgccaaggaccttggattcagcgtggttccggtcagggaagcgatccgccggctcgaggcagagggcctggtgacgttcgaacgcaacgtgggcgccaccgtggccggaatcgaccccaccgagtacctctacaccatgcagaccctgagcatcgtggaaggtgccgccaccgcgctgtccgccccgctggttgattccgtggcaattgcccgggcccgtgcggtgaacgaggacatgcgcaaatgcctggaccacttcgaccccgtccggttcacgcagcttaaccaggacttccacagcatcctgttcgagcactgccccaacccccacatcctggacctggtgcaccgcggctggaaccggctggcgtcgctgcggtcctccaccttccgcttcgtccccggccgcgcccgcaattccgtggacgaacacgaggcactcctgaagctcatcgagtccggcgccgacgccgacgacatcgagaaagccgcccggctccaccgctccgccaccctggacgcctacctcgcccaggcgaaaaccatctgaactcctccgatcccttcagaagcagtaaggaaacaacaatgacgttcactgcaccggaaaccagcacccattacgtgccgcaggaccttcccacccatatccagcactacatcaacggccagttcgttgactccgtgggcggggcgaccttcgacgtcctggacccggtatccaaccggaactacgccaccgccgcagcaggccagaaagaggacatcgacctcgccgtcgccgccgcccgcgaagcgttcgccaacggcccgtggccgaagatgaagccgcgcgaacgcgcccgcgttctcaacaagatcgccgacgccgtcgaagcccaggaatcccggctcgccgaactcgagacctttgataccggcctgcccatcacccaggccaaaggccaggccctccgcgcggcggagaacttccgcttcttcgccgatctgatcgtggcccagttcgacgacgccatgaaggtccccggctcgcagatcaactacgtcaaccgcaagccgatcggcgtcgccggactcatcacgccgtggaacaccccgttcatgctcgagtcctggaagctcgccccggccctggccaccggcaataccgtggtgctcaaaccagccgagttcacgccgctctcggcctcgctgtgggccaccatcttcaaggacgccggcctgcccgacggcgtcttcaacctggtcaacggcctcggcgaagaagcaggcgatgcgctggtcaagcatccggacgtcccgctgatctccttcacgggcgagaccaccaccggccagacgatcttccgcaacgccgccgcgaacctgaagggcctgtccatggaactcggcggcaagtccccctgtgtggtgttcgccgacgccgacctggacgccgcgatcgactccgccctgttcggcgtcttctccctcaacggtgaacgctgcaccgccggctcccgcatcctcgttgagcgcgccatctacgatgagttctgcgagaagtacgcggcccgcgcgaagaacatcgtggtgggcgatccgcatgaccccaagacccaggtgggcgccctggtccacccggagcactacgaaaaggtggcctcctacgtggagatcggcaagtccgaaggccggctgctggccggtggcggcaggcccgggcacctgcccgaaggcaactacatcgcacccacggtgttcgccgacgtcgccccggatgcgcggattttccaggaggagatcttcggacccgtcgtggccatcaccccgttcgaaaacgacgacgaagccctcgccctggcgaacaacaccaagtacggcctggccgcctacatctggacccagaacctgacccgggcgcacaacttctcgcagaacgtggaggccggcatggtgtggctgaatagccacaacgtccgcgacctgcgcaccccgttcggaggcgtcaaggcctcgggcctcggacacgagggcggctaccgctccatcgatttctacaccgaccagcaggccgtgcacatcacgctcggcacagtccacacccccaaattcggcgcctgaaccgccacccgcccctcctcaaagaagagagaacaccatgaccaacttcgttcccacccccaccgtcccggcaccggacatcgtccgctgcgcctacatggagatcgtggtcaccgacctcgccaggtcccgcgagttctacgtggacgtcctgggcctgcacgtcaccgaggaagacgggaacgccatctacctgcgctccctggaggaattcatccaccacaacctggtactgcgcaagggacccatcgccgccgtcgcagcattcgcctaccgggtgaagtcccccgccgaggtggatgccgccgaagcctactacaaggaactgggctgccgcaccgaacggcgcaaggacggcttcaccaagggcatcggcgactccgtccgcgtggaggacccgctgggcttcccgtacgagttcttctacgaggtggagcacgtggagcgcctcacccagcgctacgacctctactccgccggcgaactggtccgcctggaccacttcaaccaggtcaccccggacgtcccccgcggccgcgcctaccttgaggacctgggcttccgcgtctccgaggacatcaaggattccgacggcgtcacgtacgccgcgtggatgcaccgcaagcagacggtccacgacaccgcactgaccggaggtaacggcccgcgcatgcaccacgtcgcgttcgccacgcacgagaagcacaacatcatccagatctgcgacaagatgggtgccctgcggatcagcgaccggatcgaacgcgggcccggccggcacggagtgtccaacgcgttctacctctacatcctggacccggacggccaccgtgtggagatctacacccaggactactacaccggcgatccggacaaccccaccatcacctgggacgtccacgacaaccagcgccgcgactggtggggcaaccccgtggtcccgtcctggtacaccgacgcctccctggtcctggacctggacggcaacccccagcccgtcatcgaacgcgaggaaaagagcgaaatggccgtcaccgtgggcgccgacggcttctcctacacccgcaaggacggatcccccgaagatgaccggaccgggttcaagctgggagcgcagctgtagccatgctggatgacaggacgattgaggccatcgcgaacgaactcgtggaagccggccgaacccgcacccctgttccccgcctgacggcccggtacccggagatgacggtggaggactcctacgcggtgcagcagttgtggcgtcgccgcagcgaggaggccggccggaccctggtgggccgcaagatcggcctcacgtccaaagccatgcaggcggccacgggcatcaccgagccggactacggcgccatcttcgatgacatggtgctcgagaccagctgctcggtggagtgggacagatacacccacccgcgggtggaagtggagctggcgttcgtcctgaaggacgggctcaagggacccggcgtgaccatcttcgacgtcctgaaagccaccgactacgtggttccggccctcgagatcctcgattccaggatcgaaatggagggccggaccatcgtggacaccatttcggacaacgccgccatgggcgccatggtgatcggcggcaacccggtgaagccggacgcggtggacctgcgctgggtctccgccatcctctacaagaaccagaccgtggaggaaaccggcgtggccgccggggtcctggaccatcccgccaacggggtgcactggctggcgaacaagatcgccgcccacggcgattccctgaaagcaggggacatcatcctcgccggctccttcacccgcccgctctgggtctacaagggcgacactgtccacgcagactacggacccctggggagtgtcacgtgccgcttcgaatagaagagaccttccgcgacgccctcgccgggcaaacgggcgaaaccggccgcccgctggcagggatgtgggtctgttccggcagcccgctggttgccgagctttgtgctggatccggactcgactggctgctggtggacgcagagcacagccccaacgggctcgaatccatcctcgcccagctccaggccatccacggctacccggtgcacaccgtggtgcggccgccggtcaacgacaccgtgctgattaagcagtacctggacctgggtgtgcagaacctgctcgtccccatggtcaactccgctgctgaggcggaagccgcggtgacggccacccggtacccgccgcagggcgtccgcggggtcggctcggccctggcccgtgcggcacgctggaaccgggtcccggactacctggcccgcgccagcgagaccatcagcgtcaccgtgcagatcgaatccgccgccgcggtcgccgtcgtggaaaacatcctggcggtcgacggcgtcgacgcgatcttcgtgggcccgtccgacctcgcggcctcaatgggcctgctgggacagcaggaacacccggaggtgcgtgccgccgtcgaacactgcctgtccgcggcacaggcagccgggaaaccggccggagtcaatgcgttcaacccggacacagcccggcactacctggccaacggcgccaatttcatcctggtgggggccgacgtcgcgctcctggcgaggggttccgaagccctcgctgcgcaatacatcaagcccagcgacatccagaaggctgacgacgacaccccctccagctactgatccctcccttcttaaggactatttcaatgacagttactcctgcgctgccccctgccgtttcgtcggagcgtgaggctgagctcctcgcctccgttcccactggcctgctgattggcgggcagtggcgggatgcgtccgacggcggcacgttcgacgtgcacgaccccgccaccggggaggtgctcgccaccctcgcttcggccacgagcgaggatgcggtcgcggccttggatgccgctgacgccgcgcaggcctcctgggcgcggaccgcaccccgggaccgcgcggagatcctccgccgcgcctttgacctggtgaccgaacgggccgaggacttcgccctgctgatgaccctggaaatgggcaagcccctggccgaagcccgcggcgaagtcacctacggggccgagttcctgcgctggttctccgaggaaaccgtccgcgactacggccgctacctcacctcgcccgaggggaagaacaagatcctggtccagcacaaaccggtgggcccctgcctgctgatcacgccctggaacttcccgctggcgatggccactcgcaaggtcgcacccgccgtcgccgccggctgcaccatggtcctcaaacccgccaaactcaccccgctcaccgcgcaactgttcgcccggaccatgctcgacgccggtctccccgccggcgtcctgaacgtcgtctcctccgccagcgcctccgggatctccggaccgctgctgaaggactcccgcctgcggaaaatctccttcaccggctccacctccgtgggcaagcgcctcatggccgacgccgcgcagaacgtcctccgcacctccatggaactcggtggcaacgcacccttcatcgtgttcgaagacgcggacctcgatgccgccgttgaaggggcaatggcagcgaaaatgcggaatatgggagaggcctgcaccgccgccaaccggttcctcgtccaggaatccgttgccgccgagttcacacagaagttcgccgcggccatgggcgccctggccaccggccgcggcaccgaccccgccacccaggtcgggccgctcatcgacgccggggcacgtgatgacgtgcacgccctggtggcggccgccgtcgacgccggggccaccgccatcaccggcggtgcacctgtggacggtcccggctacttctaccagcccacagtgctgggcaacgttccgaacggtgcagcgatcctgggccaggaaatcttcggccccgtagccccggtcaccacattcagcaccgaggaagacgccatccgcctggccaacgccagcgaatacggcctagcgtcctacctctacagccgcgacttcaaccggctgctgcgggtagcggagcaagttgaattcggcatggtcggcttcaacgcgggtgtcatctccaacgccgccgcgccctttggcggagtcaagcaatcagggctcggccgagaaggcggcactgaaggcatcgctgaatacaccaccacccagtacatcggcatcgccgacccctacgcgcgctgataccagccgcccggcgtgacatcccgcataaacctgtcacgcgtgacgctccctgcagtgaagaacaaaagaacgttcagcatattagccaccagccagtatagtgaacgaatgacttccacaatcacccttgcgatcgctgtaccgctcgaagcagagctggtggaacagatccgcgccgtcgatccgtcagttactgtcctctacgagcccgaactcctgccgcccgagcgttaccctgccgaccactccggcgacccggcgttcaagcgcactccagcccaggaagagcgctactgggccatgctcaacagcgcacaggtgctgtatggattccccaacgaaagccccgccggcctggcccgcatagcccgcgagaatccgcggctgcagtggatccatgccatggctgccggggcgggcggagccgccaaggcctccggcctggaccaggacatcctgcaaaagttcaagatcaccacatcggccggcgtccacgccctgcccctcgccgagttcgcggcgctcggaatacttaacggattcaaacggagcgccgaactggcgcaggaccaggccgccaaaacatggcccgaactgcggattcccacccgcctggtcaacggctccacgctggtggtcacgggcttaggcgaaatcgggctggagaccgcaaggattgccagggcgctggggatgaaggtcagcgggaccaagcggtccgtggaacacatcgacggcatcgagcaggtggtggacaacaccggccttccggccctgctggccacggctgatgcggtggtgaacacgttgcccggcaccgccttcacggagaagcttttcaaccatgaagccttcgccgccatgaagcccgggacggtgttcatcaacgtgggacgcggcaccgttgttgacgaagaagccctgctggaagccctcaacaacgggcaggtcagctacgcctgcctggacgtcttcgccgtggaacccctcccgcaggacagccctctgtgggaccaccccagggtcacggtctccccgcacacatcggccctcagcgcagccgagaaccgcctcattaccgagcgcttctgcagcaacctccggaccttcctcgacggcggcgaccttccccacctcgtggataccgtccacttctactaagccccaggggcacgatcaggagacccatgcgcatcgcaagaatcaagacagcagagggcgcccggcacgcggtggaacggagcgggacatggcaccacattgctgaccccttcgaggaacccctgacctacaccgggcgcactaccccggccgccggtgcggtcttccttgccccggtccggcccgccgtggtcctcggcatcggacacaacaggacgctgaacgaccacccgctccccatccaggcatggcataaatccgtgcacaccctcgccaatcccggcgatccggtagtggccgcccgggaccgtggcacggtcaacgtggagggcgaactcgcggtggtgatcgggaaacaggcgaaggaactgacggcggagaacgccctggagcatatcctcgggtacacctgcgtcaacgacgtgaccaacgtggaccagggcctggtggatgaacggaatttccagggcaaggccggcgtcaactacaccccccttggcccctggatagaaaccgacctgccggatccggaccttgtgggaatcgacgtcatcgtcaacggagtggcccaggcgaactccgggacgtccaacctcccttcctcagtggtggagtgcctcgtctacgtcacttcctggctgacgctggaacccggcgacgtgctgatgaccggggcgcccggcacggcagtggcagtcctgccgggcgaccaggtggacatcgtgatcgagggaatcggcacccttaccaatacagtcgcctgagttccccgccttcaggagcacgcatggcatgggggcgcaatgacgcgcgccccctatgatggatggtgttcagtcaaatgaacaccagctcgtcatgccgcggcaacccgaaggagaatcatggccgattcccgcaactccggtcctcaaccagacaaccagggcaacgcctctcccgcccccgcggtcacgcgggcggctgctgtcctggatgccctggcttcctccgccaccggccgcctcaccctcagcgacctctcgcgtgaagtaggcatcccaaaatcatccacgtcgaacctgctgctggcgctggaggaagcacggctcatcaaccggcagggcagtgaattcaccctcggccgcaaactggtggagctgggcgccgcctaccttggccggctggatgaagtgcaggagttctaccgctactgcgagcaggctcccgtcctgtccggcgagacggttcgcatcgccatgctcgacggcctgaacgtcatctacctcgcccgctacgagggccatcctgctgtgcgcctgacatcgaacatcggcgacaaaatgccggtttcactctgcgcggtgggcaaagcgctgatagcaaggcttcacgaccatgacatcgaggagcttttccctgatgatgccgaactgccggtgctgacgccgaagtcgctgcgcacaggcgccgaattcaaggcgcagctacagaccatccgcgaacagggctacgcctttgaggatgaggaatccaccacgggcgtggtctgcctggccgttgccgtaccaacccgcggagcccacggccccagcctgggactttccgtgacagccctcaaggccacctacacccccgagcagggcgcccagatggtcaaggaactccaggaactcgcccattcactgggcaaccccatgggttagacggcggcgcttccttcacaaacgcatcccctcttgccgtctgttcaacttgctgtattgtgttcagcatagtgatcgacgcaacaggtgtcattgctatcccaccaggccaacgagggtctggagtgcgtttaagggagttactgtgacaactcgtactaaatcaccgcagactgacaggaacggcgacgtcgtcgaaccggagcagctgcgaagggcaacgcttgccagctctgtagggtcagccctcgagtactacgacttttacatttatggcctcgcgtcagcactgatctttggtccgctgttcttttcccccttgggtgaaagcggcgcagtcatcgcctcgtttgccacatacggcgtcggctttgccgcaaggccctttggcggggtggtctttggctacatcggagaccgcttcggccggaagatggtgctgatcctcaccatcggcctgatgggtatggctagcttcgccattggcctcctgcccacctttgaacaggcaggaatgctcggggccgttctgctggtggccctccgcatcctccagggcctcggcgccggcgccgagcaggccggggcaaccacgctgatttccgaggttgctccgcgaagccgccgcgggttcttcgcctccttgcccttcgtgggcatccagctgggcacactgctcggagcgggcactttcgccctaatggcactcgcggacagggatgtgctgctgggctggctgtggcgggtacccttcctggccagcgtcatccttattgtcattgccgtctttatccggctccggctgaaggaaactccggtcttccaggagcttgagaagcacaaggccgtggtcaagaatccggtgggccaaatctggaagcactccaagaagaatgtgctcgtcgggatcggcctgcgcatgggcgagaacggtaactcgtcggtttactccgcgcttctggtctcattcatcagccttccggccggcgtatttccgggcgacaagttcattggcccaacaggcctgctgatcgccgcaggctgcgcagcagtcatggtggtcgtcttcggcgccctgtccgaccggttcggccgggttcccgtgtaccgctacggggcattattccaggccctcattgcactgcccgcgttctacctggtcacgctgggcaacgtcacgctggtctgggcagtgatggcggtgggcatcgccctgggcgtgcagtccatgctcggtccgcaatgcgccatgctgcccgaactcttcggctcgcagcaccggttcaccggcgtggccctcagccgtgaactctcggcagtcctcgccggcgggttcgcacccatgatcggcgttgcgctgctcgctgcgaccaaccactcctggctggttcccgcactgtactcactggtcctggccgcaatctcctttgtcaccacgttctttactcccgaaaccaatggtcgcgacctggcgctcgtggaggacgccaaatagaagtccctgaaccctgggggcggcccctgcggtggccgaccccagggttcgtcagcagccaagcacccccagcccgtccggtcaccaaaggttgaacatgaacaacgccaccgcctccaccgctccccctgccccagccgggcaaacccgtccgcgtgccgggtttgtcgggctggggctgatgggcgcacccatggccgctaacctgctgcgggcgggatggtccgtcacgggatggaaccgctcccccgccgctgttgaagacctgctgcggctgggcgggagcggcgccgccacggtggcagacctgagggacgagcctgtcatcatctttatgctccccgatctttcctttattgaagatgccgcggcagggctcctcgaagcctggcggtcctcgccgcctgaaccgggaacgctcgttgtggtcatgagcagcgtttcacccgtgggcgtccaagacttcggccgcgcggtcatcgaggcaagcggcgggaacgccaccgtgctggatgcgcccgtcagcggcggcacacacggcgcacagcaaggaaacctggccatcatggcaggcggcccggaagaggacttcgcgcggatcctgccggcactgcaggccatgggcgcaacagtccggcggctcggcgggctcggggcgggctcgctggccaaagcgtgcaaccagttggttgtcggctccacgacggcggccctcgccgaagcagccgagcttgcggaacgctccggcctggatgtcacggccctcttcgacgtgctctccggcgggctcgcggcaagccgcgtgctggaaatcgtaggcccccgcttggcaacaaaggactacacgcccacaggaccggccaagttcatgcacaaggacctgtcttttgttgtggagagcgcacgaaacgtcggtgccgctgcgccgatggcgtccgccgggactgaactctatgcgcagttgctcgcgcaaggcctgggggacctcgacctggctgtggtgcgtcagaccattgcgaacctcagcaccacagacgcttcccacagcgggaccgaaacggccaaggagactgcacgatgacttcacttttcgacctgaccgggcgtacggccctcattaccggctccagccggggaatcggcaacgctcttgcccgggccctggcggatgccggtgcaacggtggtgttgaacgggatggatgcggaccgcctcaaggttgcagaaacctccatgtccgccgatttcccacccggccgtatccacagctgcgccttcgacgtcaccaaggacgcagaagtgggccgtgcggtggcgtgggtagaggagaacgtcggtccgctggagatcctggtcaacaatgccggaatccagcaccgggtggccatgcttgacttggacgtcgaggactgggaaagggtaatcaccactgacctcaccagtgctttcctcgtgggccgggcggccgcccgcttcatgatcccccgcggccgcggcaagatcatcaacatctgctccgtccaggccgaccttgcgcggcccaccatcgccccctacatcgctgccaagggcggcctgcgaaacctcacccgcgccatgacggcggaatgggcggcttcgggcctgcaggtcaatgccatcgcacctggttacatccacaccgaaatgacccagaacctggtggacgatgaacagttcaactcctggatcctggggagaacccccgcgcaccgctggggcaccgtccaggacctcgccggaccggcagtctggctggcctccagcggttcggacttcgtgaacggacagacaatcttcattgatggcggaatgacggtggtggtctgatgcacgccgttcctgatgctcctgcagacagccggcgctacccgtccggacttcccgcggccagtcccgccgtcgtcgcccacgcggcagccgaccttcgcattgacaacattccgctcccttcacccactccggaccaggccgtcgtcgagatagcctacggcggcatctgcggctccgacctgcactactggctgcacggcgccgccggagaatccgtcctgaaggcaccgatggtgctgggacacgagattgttggcgtggtggtacgcgcggcggcggacggatcaggtccacctgagggggcagctgtcgccgtgcatccggcaacgcctggcccgggaaccggcccggaccctgccaggtatccccacgacaggccgaatctgtcccccggctgcacctatctgggcagcgccgcaagatacccgcatacggatggtgccttcagccgctacgccaccttgccatcgcggatgctgcgggtcctgccccccggcctggatctgaggaccgcggcgctgattgaaccggccagcgttgcctggcacgccgtttcacgcgctggtgacgttaggggcaagaccgccatggtggtgggcagcggtcccatcggggcgctggccgtcgccgtgcttaagcgcgctggtgcaacccgcatcgtggccacagacctgcaccgcaaacccctggagatagcacaggcagtcggcgctgacgaggtgttggaagcaacagacagccaagcactggcagaggtccaggccgatgtggtgatcgagtcctccggctcccaccatggactggctacggccatcaagggaacggttcgtgggggcaaagtggtgatggtggggttgttgccgtccggaccccagcctgtacttatttctctggccatcacacgggaactcgaacttctgggatcattcaggttcaacgacgagatcgatgacgtcatttccgcactgggcgacgggtcacttttcgtggaccccgtcatcacgcacgtgttcccgctggaatgcgggctggaggcctttgagatcgccaggaactcggcagagtccggcaaggtcctgctggacttcgctccaggccgccgctcctgacgggcaggggcgaggagctgacgctggctccaggccgttccctccacgtcaaggtccctgcgcccaaagacaagaggcccggaccgggcgtacagcacactggaaagcaacccgccaggccaaccggccggcgtccttgcctactcgaagtggagtacaccatggaaacctacgatgcgcttctggcgtccgtttctgccgaacccggtaccggccggaccatcctggaccccgccacgggagagcccgtaggcgaagcccccgtccacggcctcgagtacctcgaggcggcagtctccgccgcacaggaagcgcagccggcttgggcggcgctgggccacagcgcgaggtcggccgcgctcctcaaagcagccgacgccgtcgaacgttccgccgaggaactcgcccagctgctctcccgcgagcagggcaaacccctgaacggccccaacgcccggttcgaagtgggtgcctgcgtggcctggctgcgcgccacagccaacctgccgcttgagcctgaaacgatcgtggacgacggccagacccgcgccgaactccactacaagcccatcggggtcgtagccgcgatcggcccgtggaactggcccatgatgatcgccatctggcagatcgcccccgccctgcgcatgggcaacgccgtggtggtcaagccgtccggcaacaccccgctctccgtcctggcgctggccacggtcctgaacgaggaactcccggaaggcatcctctcagtggtctcctgcggccgggaagtaggagcccggctcacggaccaccccgccatcggaaagatcatgttcaccggctccaccgcggccggccgcgccatcatcaaatcctccgcggacaccgtcaagcggctcaccctggaacttggcgggaacgacgccggtatcgtcctgcccgacgccgaccccaaggccatcgccgaagatgttttctggggtgccttcctgaacaccggccagacctgcgcggccctcaagcgcctttacgtccacgatgacatctacgatgccgtctgcgaagaactcaccgccgtcgccgccgcgatgcccatgggcaacggcctcgacgaggacaacgtcctgggtcccctgcagaacaaggcacagtacgacgtcgttgcaggcctcgtggaggcagcaaaggcttccggcgcacgcgtcctgctgggcggaaatccggagccggaccagcccggctacttctaccccaccaccctggtcgcggacatcgacaacgacaatccgctcgtggcggaggaacagttcggccctgccctgcccatcatccgctacagcaccatcgatgaagcggtggaaaaagccaacgccctggaggtcggactcggcgcctccgtctggtcttcggatgtttcagcagcccgcggggtcgcaagccggatccaggccggcaccgtctggatcaacaggcacggcgccgtggacccgcgtatcccctttggcggcgcgaagcagtcaggctacggactggagttcggcgtcgagggcctcaaagccctcggtgtaccgcaggtcattaacggctgaaacctgacacggcaagaggggcactgcacgccgacgcgtgcagtgctcctcttgcgtttgcccccggtggcgggtatccgccagcctaaaggaccgtgccgggggcagtgtggttacgcgagggaaaggaagagcttctccagctctttcctgtccatggtgctgtcttcgcggacaatgcactgctccaggccgctggcgatgatcgcgaagcctgccctgtccagcgccttcgatacggcggcgagctgcgtgacgatgtccttgcagtccctgccctcctccagcatccgcgtcacagcggcgagctggccctgggcgcgcttaaggcggttgaccactggggccagttcagtcgagtcgagttccatgaggtctccgtaggtggggttcttgcctccaactatatacccctcggggtgttttgactaccccggggggtatctgcaatactcggtggggtattcatctttcccctatcgagaggccagcaatgacttccccttccacggcacccactgttaccgcactcgctcctgaaaccctccagtcctggttcaaagagcaccaggacctcgtggtgctcgatgtccgctccgctgcggagttcgagtccatgcatatccgcggctcctacaacgtgccgctgccgttgctgtccgagcacacggatgagctcgccgcccggctgggttcccgcgtggtcctggtctgccagtccggtgtgcgcgccgagcaggcgcgccagcgccttgccaaagccggaatcgacaccgcctacgtcctgaccggcggggcgcccggtttcgccgctgccggcggtgacgtggtcaagggcaaggaccgctgggatcttgagcgccaggtccgcctcgtggccggatccctggtggtcctgggcctggccggcggcaagttcgtctccccgaagatccggacgcttgccggggtcatcggcacgggcctgaccttctccgcagccaccaacacctgcgccatgggccaggcgatctcggcgatgccgtggaacaaggccgccaaggagcccacccgcgaaagcgccatccttgccctgcccgtcaacaccgaggtgaacgccgaggccaaagcatcatgaccctcaccctcatcctggtcctggccctctcggtggtcatcggactctcgctcggtgtcctgggcggcggcggatcgatcctgaccgtcccgatcctggtctacgttgccgggttcgaggccaaggaagcgatcgcagcctcgctgttcgtcgtcggcgtcacctccgcggtcagcgtgttcagccacgcccgcggcggcagggtgatgtggcggaccggcctgatcttcggcgcggccggcatggccggggcgttcgttggcggcctcctgggcgggcacatccccggccagatcctgctcatcgccttcgcggtcatgatggtggccacctccgtggccatgcttcgcggccggaagaaaaagaacgacgacggcgcgccgccggtcaagcatgaacttccccttggcagggtgctgcttgacggtgccgtggtcgggctcgtcaccggcctggtgggcgcgggcggcggattcctcgtggtcccggcccttgcactgctgggcgggctgccgatgtccgttgccgtgggcacctccctggtggtcatcgccatgaagtccttcgcagggctcgcgggctacctcaccaccgtccagctcgactggggcatcaccctcggcgtgaccgccgccgccatcgtaggcacccttgccggctccaaactcgccggccgcatcccggaagctgccctgcgcaaggcgttcggctggttcgtcctggccatgggaaccttcgtcctcatccagcaggcccccgccgacctgcggtggttcatcgcagcaggcgtcgcagccctcgccgcggccaccgcgggtatctgctggttcttcatcagctcctgccccctgcgcagccgcaccggccgccgcagcaaaatcccctcacccgcctgaacccgccaccaccagccaaggagaacaccatgggcctcatcagctccctgaaaaaagccttcagcaagccctacacaacggtctcggtagctgaagccaaggacctcctgtcctcaggtgccgcactgatcgacgtccgctccgcccaggaatggcgctccggacgggcaccccaggcgaaacacgttcccctggaccggctgcaggccggcaccaccggaatcaacaagaacaagcccgtgatcgccgtctgcgcctccggggtccgctccgcgtcagcggcccggctcctcgcctctcaggggtaccaggcgcactccctgcgcggcggcatgggtgcctggcgctcggccggcgagcccgtccgctaacaccagcccacaatctttcgaaggagaatcccatggctgaaatcaccatcaccgaaaccgaacagcgccgcaccagcgcccgcatcctcgatgtccgcgaggacttcgaagtcgaggacggcatgatccccggcgccctgcacatccccatgggccagctccaggcacgcctgtccgaactggaccccgccgtccccgtcattgcggtctgccgcagcggcaaccgttcagcccgcgtcgccgacgccctcaacggggccggcttcaccgcggacaccatggccggcggcatgatcgcctggacccaggccgggctccccaccacctgagccccgctgcaccgccaccaaccacccaagccaacgcccgaaaggacacgaaagacgatggcaaccatcgacctcaccgaacagagcttcgcccagaccctggagaacaacgagatcgtcttcgttgacttctgggcagcctggtgcggcccgtgccgcatgttcgcccccacctatggcgctgccgctgaacgccacccggacatcaccttcgccaaggtagacaccgaagccgaacaggccctcgccgcagcagcgagcatcacctccatccccaccctcatggccttcaaggacaaaaccctggtcttctcccagcccggagccctcaacgccaccggcctcgaagaagtcatccaggccgtcaagaacctggacatagacaaactccgcgccgaggccggacaccagcacgccggacgcacgcacggattgcccggcgcatatccctcgttgcggtataccccccggggtattacacttaaaccaagacctcccccaaacacctactccacgaaggagagcaccagatgcttatcgagcgcatttacgatgaagacctcgcccaggccagctacctgatcggctgccaggccaacggcaccgccgttgttgtggacggccgccgtgacattgcggtctaccaggatctggctgagaagaacggcatgaagatcatcgccgttaccgaaacccacatccacgccgactacctctccggcacccgcgaactggccgctgccaccggtgcgaagatctacgtctccggcgagggcgggccggactggcagtacgaattcgacggcgaacggctctatgacggcgacaagatcaccatcggcaacatcagcatccaggccctccacaccccgggccacacccccgagcacctgtccttcctggtcacggacggtgcgttcagcgaccagcccggctatctgctctcgggtgacttcgtcttctccggcgacctgggccggccggacctgctggacgaggcagccggcggcatcgacacccgcttcgagggcgccaagcagctcttcgccagcctgcgggacaagttcctcaccctgccggactacgtccaggtccaccccgcccacggtgctggcagcgcctgcggcaaggccctcggcgccatcccgtcctccaccgtgggctacgagcgcctctacgcctggtggggcccctacctcgccgccaacgacgaacagggcttcatcaacgaactcctcgacggccagcccgacgcccacgcctacttcggccgaatgaagcgcgagaaccgtgaaggccccgtcgtcatgggcgaacgcaccccgctgcccgagctcgcacccggcatcgttgctgcaggcctagcggaggacaccctgaccttcatcgacacccgccccaacagcgaggtccacgaaggcacggtcgcccggtccctgaacgtgccggcaggcaagtccgtggccagctacggcgcctgggtcgtgaaccccgagacggacaagaacccgctggtactgctggcaccggaccaggaagccgccatggacatgtgggaccacctggtccgcgtcggcatcgacaacgtcgccggctacctcaccagcatcgacgggctccccacggcaaccccgaagctcatccagccggaggaactcgacgaatttgacgccgccatgatcctggacgtccgcaataaaaccgagcacaccgccgggaacatccccggctcccaccagctcagcggcggccgcctcatgtggcacctggacgaactccccgccaacggcaccatcgtcacctactgccagtcaggcgtccggaactccgtggcagccagcgcccttcgccgggccgggtacgacgtcgtcgaactcgacggcagctacgccggctggaacacctggcagcaggcacagaactccgttcccgcagcctaaccaggtacccccacagaccgcccgggctggtcccccctccggcccgggcagcccgggcgcgcccccgcgcgtccgggcatccttatatccccgggacttatgtccccacgacgaacggagcactccacatgcagggcagaacactcccgcgccacggccggggatcagccggcatcgtgctggggcttcggcaaaacctggcacagttcatgctgctggtggccgtcaacgccctggtgggcggcacgctgggccaggagcgcaccgtgttgccgctgcttgcggaccaggtttttggcctggaccagtacaccaccgccctgacgtacatcgtggcgttcgggctggccaaagctgccaccaactacttcgccggaacactttcggaccgctacggccgaaaaccggtgcttgtggcaggctggctcattgccctcccggtcccgttcctgctgatcttcggcgactcctgggggctgatcgtcgcggccaacgtggtgctgggcatgagccagggcctcacctggtccaccaccgtgatgatgaagatggacctcgtgcgccccgaacgccggggcctggccatgggactcaacgaagctgccggctacctcggcgttgccggcacagcgctggccaccggctacatcgcttcaacctacgggctgcggccctggcccttcctgcttggggcggccttcatcgccatcggcctggggctgtccgtgctggcagtgcgcgagacacaccaccacgccaaaatcgaggccgcgggccatgtctccgtccatgcgggagcaggggccggcctgagcagccgcgaggtctttacgctcaccagcttccgggacaggtcgctgtcctccgtcacccaggccggactggtgaacaacctcaacgacggcctggcatggggactgttccctgtcctgttcgccgccgcgggactgggcattgaacacatcggcatcctcgccgcggtctacccggccgtatggggtgcggggcaaatggtcacgggtcccctctcagaccgcatcggccgcaaaccgctcatcgttggaggcatgctggtccaggccgcggcgctggccatggtcgccgtcggaaatgagttcggaacctggctcgccgcgctggtcctgctcggcgcaggcacggccatggtctaccccacgctcctcgcggcgatcggcgacgtagcccatccgctctggcgggcacgttcagtgggaatctaccggctgtggcgggacggcggcttcgctgtgggagccctgctgtccggcgtgcttgccgatgcttacgggatacccgctgcagtgggcgttgtcgctgccatcaccgcagcgtccggcgtgctggcggccgtacggatgcgccggaccgaccaccaccggcgcggctgagttcagtgcagttcatccggaggcgccgtcacagcgccgaaaggattccggcgatatcgtccatgacgccgggcaccagcgagtagtaggcccaggtgccgcgcttttcccggtgcaggatcccggcctccaccaggatcttcaggtggtgggaaacggtgggctgccccaggtccaagggctccgtcagatcgcagacgcaggactcccccgatgcctccgccttaacgatggacagcaaacgcaggcggttgggatcggccagggccttgaagaccagggctttccgctgggcctcttcgatgcccagcaccggcttgtccgagggaacgcagcacgaagcgtcgacggcgggaccagcagtctgcaggaggttcatgacatccattatgcacatagattgacattcatcgatatagctggcaatacttcctatatcgactttcatcaatctattaccgagcagcgcaggagacccgtgagcacccggaccgagataccgcccacccaaggggacgaggccgtcgtcggcaaactctccacccttgaccgtttcctccccgtgtggatcatcgccgcaatggccctcggcctcctgctcggcaacctgatccccggcctcaacacatcactggaagcggtcaaggtgggcgaagtgtcgctgcccattgccgtcggcctgctggtcatgatgtacccggtcctggcgaaggtccgctacgaccagacccgccgcgtgatcggtgaccggaagctcatgatctcctcactggtgatcaactggctcctggcccccgcgttcatgttcgtcctggcctgggtgttcctcgcggaccttcccgaataccggaccggcctgatcatcgtgggcctggcccgctgcattgccatggtgatgatctggaacgaccttgcctgcggggacagggaatccgccgcggtcctggtggccatcaactccgttttccaggtggtggccttcggtgcactgggttggttctacctgcagctcctgccatcctggcttggcctgcccaccaccagcgcggacttctccttctgggcaatcaccctctcggtgctgatcttcctgggcatcccgctgctcgccgggttcctcacccgcaccctcggcgaaaaagccaagggccgcgactggtacgagggcaccttccttcccaagctcggccagtgggcgctctacggcctgctgttcaccatcaccctcctcttcgcactgcagggcgaaaccatcaccgcccgcccgctggacgttgcccggatcgctcttccgctgcttgtctacttcgtagtggtgttcggtgccggcatgctgatcggcaaatggctggaccttggctacgccaaaaccaccacgctcgcgttcactgccgcgggaaacaacttcgaactggccatcgctgtggcgattggcaccttcggtgtgacgtccggccaagcccttgccggcgtcgtcggccccttgattgaagtgccggcacttgttgcacttgtatacgccgcactgtgggcgcgaaagcgtttcttcagccccgccaccgcttcactctgaccaccgccacaccccgggagaacaccatgaccaccgaatctgccaagaagccctccgtcctgttcgtctgcgtccacaacgccggccgctcccagatggccgccgccttcctcaccagcctctccaagggcgccatcgaggtgcgctccgcaggctcccagcccgcggacaagatcaacccctccgccgttgaggcgatggccgaggtgggcatcgacatgtccgcggaggtccccaaggtcctgaccacggaggctgtgaaggaatccgacgtcgtcatcaccatgggctgcggcgacgaatgcccgtacttcccgggcaagcgctacgaggactgggtcctggaggacccggccggcaagggtgtggagtccgtccgccccatccgcgacgagatcaggggccggattgaggacctgatcgcctccctggcccccgccgccaagtaacttcccacgaccccgaggagattcccgtgagcgagaccgcgaacgcagagagcgtcaagacagagaccgtgaacacagaacagttgatcatcatcggttccggccctgccggctacaccgcggccatctacgccgcccgcgccgggctggagcccctggtcctggccggctcggtcaccgccggcggggcactgatgaacaccacggaagtggagaacttccccggcttcccgggcggcatccagggccctgaactgatggacgggctgcagcagcaggcggaaaagttcggtgccaaggtagtgttcgacgacgtcacggaggttgcgctgccaggccacctcaagcgtgtggtcaccggcggcggcgacgtgcacgaggcgcccgccgtcgttctcgccacgggttccgcctacaaagagctcggactgcccgaggagaagaagctcagcggccacggcgtgtcctggtgcgccacctgcgacgggttcttcttccgcgagcaggacatcattgtggtgggcggcggcgattcggccatggaggaggccatgttcctgacccggttcggcaagtccgttaccgtcgtcgtccgcaagggtgaactgcgcgcctcccgcatcatggcgcagagggcaaaggacaaccccaagatcagctttgcgtggaactcggccatcaccgccatccacggcgacagcaaggtcaccggcgtcacgctcaccgacacccgcaccggcgaaacccgggaacaggccgccaccggcattttcgtcgcgatcggccacgtcccccgcaccgaactggtggccgggcaggtggacctggacgacgagggctacatcaaggtggactcccccaccaccgtcaccaacctctcaggcgtcttcgcgtgcggggacgccgtggaccaccgctaccggcaggccatcaccgccgccggcaccggctgcgccgcagccctcgacgccgaacgctacctcgcggccctcgaggacgcggacagcatcgccaccgcactcgtggaagaaccaacccacgcctaaaggcacagtcaggggagggggtgagctgaatgactacaggatgctgcggcgactccggttgctgcgacgacgattcctgcactgaccaggactgctgctaaacccagccccctcccccgcccacgcgcaaacctacggatgaaacagaggacaccatggatgcagcacagaaccttcccgttgccgttatcggcgccggccccgtggggctggctgccgcagcgcacctgctggagcgtggcctggagccggtgatcttcgaggcgggcgcgacggcgggtgcggccgttgagcaatggcggcacatccggctgttctcgccgtggcggttcaacctcgacgccgccgcggcgcgcctgctggaatccgccgggtgggaagccccccggcccaccgcgctgccgtacggcggggaactcgtggacaactacctggcaccgctggctgcgctgccagagattgcatcccggctacagaccggcgcacgcgtggtcgccgtgacccgggcagggctggacaagacccacacccgcaaccgggacaccacgccctttaccgtccgcgttgagcacgcggacggcgaaacacgtgaccacaccgttgccgccgtcattgacgcatccggcacctggtcccgccgcaaccccctgggcacctcaggccttcccgccatcggcgaggacaccgcagcggaccggatctccgcaccgctgccggacgtttcgggccgtgaccgggcagccttcgcaggacgccgggtcctggtggtgggtgccggccactccgctgccaacacgctgacaggcctcgccgacctcgccaaggacgagcccaacacccggatcctttggaccgtccgcggcgcctcggcgtcgaaagtttacggcggcggcgacgccgacggccttcctgcccgtggccagctcggcggccgcgtccggcgcctggtggaggccggaaaaattgagctccacaccggcttcggcatcagctcactgaagaccctcgactcccatgtcacagtcgaagccgcagacggccggacccttgatgccgacgtcgtggtcccctgcaccggtttccgccctgacctggacatcctccgcgaaatccggctggaacttgatcccgccgttgaggctccccgtgagctcggcccgctgatcgacccggaattccactcctgcggcactgtcccgccgcacggtgccaagctcctggcccacccggacaaggacttctatatcgtgggcatgaagtcctacggccgcgcacccaccttcctcctggccaccgggtacgagcaggtccgttcggtagtggctgccctggcaggcgaccgcgaggccgctgacaccgtccagctggaacttcccgagaccggcgtctgctccacggacgcgggcaccagctgcgacgtcccggcagcagcaaccgcagcccagcccgattccagctgctgcgcagcccccgagcccgtcctggtgggctttcccaccgggctttcccacggccgctccggcggcaactagatccctgaacatcgacctccggagcagcgccatgtccaacccgagccaccagtcacccgtccccaagaaaccagccgtcctttttgtctgcagcaagaacggcggcaaatcccagctcgccgccggcctgatgaaccaggtggccaacgggagcgtcaccgtgtactcggccgggaccaaacccggaaagtccttgaacctccaggctgtggagtcgctcaccgagctgggcatcgacctcagcggcgaacaccccaagccggtcacggaggacgtcctggacgctgtggacgcggtgatcgtgctgggtacggaagcgaaactggagccccgcgagggaacccgtttcgaggtgtgggaaaccgacgagccgtccgagcgcggcatcgaggggatggagcgcatgcggctggtgcgcgacgacatcaggtcccgcgtccggaacctctatgaaaagctgactgccggctagcagcagacacctggctccgacgggccagccgccgctaccccatcgcgggggccgcggcggtccgtccggcaagctggcggcgagcccaccgggccagtttcttgcccttgcccttccaccagttgtcctcgtccttgtcgtggtgcaggcggaagatgatggccatcagcacgaacatgcccatgaccacatcgatccaggaccacagcaccagggcgatgagcaccgtcaggccgttcacgatgatggacggaatggcgagggtgcggaacaccgtgctggccaggtagcgccggtgggacctcggaacggacagtgcgcgcaccatgtcgaagcagacacacaccaccaccaccgtctgtccgatcgccagcagcatctggccgggaatcgagccgctgaacgctgccaccgactccatccccgggctcatcggtgaccctcaacggcagggcggcaggatacgaaaccacacatggaaaaacccccagaaactttggaaccactgctgctgatccagcaatggttccattgaagtttccaagggctccgggggtcacgagtagtaggtactctatttcctgcccgtacccgtggggttgtacttacctcccgatggcgcgcggccgccacagcaccacagcctgcgaccgcgggcgcggacgctggccgcgtgccaggctcactacgtcgcctgcagcgcccgccgcgaagatccgggcatccagcggctgccggcgccggccaagttcctcggtcaattccgaaaccctgctctgcagggcggccacctggttctccagttccaggatccgtttgatcccttccagcgagacgccttcctgcgacaaccgctgcacctcacggagcatgttgatgtcccgctgcgagtagcggcgggacttgccgggagcgcggctgggcgagacgatgcccaggcggtcgtactgccggagcgtctgggggtgcatgtccgcgagttcagccgcgaccgaaatcacgaagatgggctggtcagcactgacgtccacagcacacctcccctgctacaaccgggccttggcggccaggccctcacggacatcggctccggccgtggcctcggcaaacgccttgaccgcggcttcggcttccttgttcaggttcttggggacggcgacgtcgatggtcaccagcaggtcgccggttcccttggacgtcttcacgcctttgcccttgacccgcagggtgcggcccgacggcgtaccggccggcacacggacccgcaccttttcgccgtcgatggtgggcacctcgatgtccgctcccaaagcagcctcagggaaggtgacggggacgtggatgcggaggttgtcgccgtcgcgcgtgtagaacgcatgcggctggacggcgacggacaccaccaggtctccgtaaccggcggcgccaggctggcccttcccccgcacacgtaccttctggccgtccttgatgccggcgggcacccggacgtcgatcacttcgccgctgggttcccgcaggccgatggtggtgccgcggatggccccggcgaaggaaatgctcgtggatgccgtgcggtccgcacccttctgcggagtccgctggaatccggtctggccgaagccgccgccgaacaggtcagcgaactccggcgggattccgcccgcggaggggttgaacccgcctgcgtgccgcccggtgttgcccgtgaacaggccgccgaacatgtcctcaaacccggcattgccgccaccggcaccgccgggcgcgaacctggcaccgccacccatcgcgcggatggcgtcatactgctggcgctcgtcggggtccgagagcacggaataggcctcggagatgtccttgaacttcttctccgaagcagcgttacccgcattggtgtccgggtggtgctgcctggccagcttccggtacgccttcttgatgtcggcgtcggaagcgtccttggcgacaccaaggatcgcgtaaaaatccttgtccacccaatcctggctagccaatggcgtttcctttcaaagttatgggtcggtggtcgggctcatcgaaaccgcgtttcgacgagcccaaccaccggagtatagctacgcaggtaccgcgacgatgacctgtgctgcgcggaggacgcgttctcctgatttgtagccggagcggagtacctggctgacggtgtcaacctcgatgtcctcgccgggctgctggatcagggcctcgtgaatcgtgggatcgaactccacgcccgtctcatcgatccggaccaggccgtacgtcttcagcgcgttctccagcttggtggcgatcgcggcaaacggtccgtcagccaggtcgccgtgctggcgggccgcgtcgacgtcgtccaagaccggaagcagggagttcagaacgccgatgacggccatttcccctgccacggcgcggtcgcgttcaacgcgcttgcggtagttgacatactcggcctgcagccggaggaggtcgttccgcagttcggccgcctcagcgttggccgaacccgttccagccgtaccctgggccacggattcttccgccggcacctcgacgccgttgaggatctcctcagcctgggccagggcgtcgccgtcggaatcctgggcactgtgaccactttcagggtgccgtgcctgcccggtcaccgggtcaaccttgcggttgtcccggatgaccggctcatggctgtcgccctgctggcctgcgcgatcgtggtcggtggaagggttgtgctcttcctcgttaccgtgatggggcatggctacttcttcgcttcgtcttcgtcgatgatctcggcgtcaacgatgtcttcatcgcccgaggcagaacccgtcttgtcaccggcagcggagcccgcagcgccttcagcccctgcagcgccggtggcaccgtccggcgaaccggcctgggcgtagatggcttcgcccagcttgccctgggaagcctgcagcttctcgaaggcggacttcacggcggcgtcgtcggtgccttcgagcgccttcttgaggtcgtcgacgtcggcctggacctcggtcttgacctcttcgggcagcttgtcggcgttgtccgcgatcagcttgtccacggagtaggcgagctgctcggcggtgttgcgggtgtcggttgcctcgcggcgggccttgtcctcggctgcgtgctcctcggcatccttgaccatgcggtcgatgtcttccttggagaggctggaaccgcccgtgatggtcatggactgttccttgcccgtgcccttgtccttcgcggacacgtggacaatgccgttggcgtcgatgtcgaaggtgacctcaacctgcgggacgccgcgcggagccggagcaataccggtcagctcgaaagtgcccagcggcttgttgtcgcgggtgaattcgcgctcaccctggaagacctggatggccacggaaggctggttgtcatcagccgtggtgaaggtctcggaccgcttggtggggatggccgtgttgcgctcgatcaggtgcgtcatcacgccacccttggtttcgatgccgagggacagcggggtgacgtcaatcaggaggacgtccttgcgctcacccttgaggacaccggcctgcagggctgcgccaacagccacaacctcgtccgggttaacgcccttgttcggctccttgccgcctgccagttccttgaccagctcggagacagcgggcatacgggtggaaccgcccaccagcacgatgtggtcgatgtcggaaagcttgatgccggcttccttgatgacgtcgtggaacggcttcttagtgcgctccagcagatccttggtgaggtcctggaacttggcgcgggtcagctgctcgtccaggtggaccgggccgtcgggggtgacggacaggtactggagggagacgttggtgctggtggaggaagagagttccttcttggcctgctcagcggcttcgcggaggcgctggagtgcgatcttgtccttggagaggtcgatgcccttaaccttgagctggttgagcaggtagtcaacgacgcgctggtcccagtcgtcgccgcccaggcggttgtcaccagcggtggcgcggacctggatggtggagaagttgtcttcgtccttgccgacttccagcagggagacgtcgaaggtaccgccgccgaggtcgaagaccaggatgagttcgtcttccttgcccttgtccaggccataggcgagtgctgcagcggtgggctcgttgacgatgcgcaggacgttcaggcctgcaatctcgccggcttccttggttgcctggcgctcggcgtcgttgaagtacgccggaacggtgatcacagcgtcggtgaccttttcacccaggtaggactcggcgtcgttcttcagcttcatgaggatacgcgcggagatttcctgcggggtgtacttcttctcgtcaacgttgacggtccagtcagtgcccatgtggcgcttgaccgaggcgatggtgcggtcaatgttgttgacggcctggcgcttggcgatctcgcccaccaggacttcgccggacttggagaatgcaacgacggacggcgtggtgcggccaccctcggcgttggcaataacggtgggctcgccaccttcgagaacggagacgacggagttggtggttccgaggtcgatacctactgcacgtgacatgtgttgcttccttctttccttggaaacttgttggcgcccgcgtattgagcgttctgcactcaactttactcagggcgtccttgatgtcaacccgaagttgagcggggtacgctcaacttcgtcgtttgggctggcgcggggagccgcgcagcgccagcactggcgcggattttcgcgcttaaacgcggacgacggcgggcccccgttttcgctgttggagaacccgccgccgtactgctttttgttgcggtgctgcttttgttgccgcgctacctctcgctgtcccggcgaccgtgcaggggaccgccctcttccgaggttgtgttcacctggccggcttcacgggctgtgccggaggtgccggcgtcgccatagtccccgtccggatattcgccgtcctcagggtttgcggcgggctcccccacactcccggcatcgccgtagtcgccgtccacgtactgcccgccctcgccttccagtccgggggcagtgcttcccttgcggggctgctcggccggggattcctggttctcggtcatggtgcatctctcctttgagttccgcgtccatgcgggcgcatgtgcagtctatccagcaggcgttttggccaacagggtttcgtcccggtccggccgttcctcaacctcctgccgccccagcttgctgggccaccagatgcgggggccgatgtcgtaggccagggcgggcaccagcagggacctcaccagcacggtgtccagcagcacaccgaaggccacaatgaacgccagctgcaccaggaacatgatggggatgacacccagggcggcaaaggtggcggccaggaccacgccggcggaggtgatgacgccgccggtgacgcccaggccgcgaaggatgccgggacgggtgccgtgcttcagcgattcctcacggacccggctcatcaggaagatgttgtagtccaccccgagtgccaccaggaacacgaagccgaataaaggaacggtggcatcagcgccggggaaacccaggatgttgttgaagacgaacgccgaaacccccatggctgccgcgtaggacagcaccaccgagagcacaaggagcaccggtgccaggacggagcggagcagcagcatcaggatgaagaggatgaccaccaggaccacggggatgatgatcaccaggtcacgctgggcggtggtgttggtatccaacgccgtcgcggtcacgccgcccaccagggcgtccgggtccacggccttgacgtcctctcgcagggccttgaccgcttcctcggcctccagggagtccgcggcagagttcagggtggcgttgatgagcaccttgccgtcgcggacgtcgggcgcgctgggagcgccaggggccccggtgatgggcacgctcccctgcgcaagcaggtaagcctcccccacgccgtcggcctctttcaccgtctccagcacctcctgcgccttgccctggtccgcaaccacgacggcggggctgccgctgccggcgtcaaagtggcgggcaagggcgtcctggccgtcgacggcgttggaggcggtgaggatgacgtctgtctgcgggacgccgttggccttgagctgcaggacgcctgcggatgccaccagcaacagcaggaccgaggcgatccacacggcacgcggacgccgggagaccagcgatccggtagcccgccacaagcccttctggccctccagcccggtcaccagttcgggttcacgctcgtccgcagggaccagcttggggcggaagggccagaaggcggcccggcccaggagcgccatcagggccggcagcagcgtgagggccgcgaacagggagcaaagaatgccggcagcagccacgggacccagggccttgttggagttcaggtcggagaagagcaggcacagcagggcaatgatcacggtggcgccggaggccaggatcggctcgaaggatgctttccatgcggtgagcacggctgcggtgcggttggtggtgtgggtcagggcctcgcggaaccgtgccacgtagaggagtgcatagtccgttgcggcgccaatgaccaggatggacaggatgccctggctttggccgttcagctggatccacccggccttggccatgccgaagaccagcaggatggccgcgcacaaggcaaagacggaggtcaggagcaccatgatgggcagcaggagggaacggtaaacgatcaggaggatcacgaacacggcagccaatgccaccaggaggaggattccgtcaatcccggcgaaggccgccgtgaggtccgccgcgagtccggccggcccggtcacaaaggtctgcatttcttccggggcggcctcggccacggtgtcccgcagctcctggaccgcctccttgacctccaccgaggagtcaatgggcgcaatgaactggactgccttgccgtcctcggaggggatcgggccgatgaccgcgctgccaagctgcagcccctccagctctgccttcaggccggccacttcacccagctgcgcgggagtgaaggcttcgttgctctcgatcacgatcacgccgggcacctcgtccgagtcccggaacttcgcctgccactcctgcgcggccgtggcctcggcgctggcaggcaggaaggaggcctggtcgttggatgacacctcctcgagacggccgaaagtggggcctcccacgccggcgagcgccagccacgtgaggaccaggatgacggggaccagccagcgcagccagaacggaacgcgttccgttcctgcggatttgtgtttcatgatgccttccggacgacgggcggggagtaacatttgttccatattagagtatctccatgatagagataagcgtctgcctagctttttctcaatttttgcggatactcaggggcccaggccgctgaagtaatatccgtcagtacgcaacgcgcaattgcactccaagcggccaagcatccgaaggatcaggaggtggacatggcagacggcaccggcccggcaccgcatggcggccctcccgagactgccggcggtccccatcccctggtccgcctcctgcaggaattcacgctcgaggccaaccgctatgtggacacagcaggcggccgcaaggacatgcaccggacagacctcaacgcactggccgtgattatgcgccacaccgccaaggggaatgtggtcacgccggggctcctgcgcaaggaactgcacctcagctcgcccgccaccaccgccctgatagaccggttggaccattccggacacgtgacccgcgagcggcacggcacggaccgccggcaggtccaactcaggatgacgcccaaggccttccaggagggcggcgccatcttcgctccgctggcccgccagatgggcagcgccatggccgggttctcggctgatgagctggatactgtcacccggttcatgaccgccatggtggaggccacggttgctgcgcgcgaagagtcttccgccagccggccggacacacccgcccccacctcgcccgacattcccccccacccaactaagtagcgccaagtgtcgttttgacccctcaaaacgacacttgctgctacctagttgggggtagcgtttggttatgagtgcgcagcagcctgaagacgacgtttacacgcacggccaccacgaatccgtggtccgcgcccatgccgccaggaccgccgagaattcggcagcattcgtcctgccgcacctcacgcccggagccagcgtgctcgacgtcggctgcggcccgggcaccatcacgtgcgactttgccgtcctggtggcgccggggaaggtgacaggtttggaccgctcaccggacatcatcgcccaggcaaaggcgctcgccatggaacgcgaggtttccaatgtggagttcgtggccggcaatatctatgacctggacttcgaggacgagacgttcgacgtcgtccacgcccaccaggtgctccagcaccttacggacccggtggaggcgctgcgtgagatgcggcgggtcgccaagcccggcggcatcgttgccgtgcgcgacgccgatttccacggcatgagctggtaccccgccattccggaactggacgagtggatggagctctaccagcgcatcgcgcgacggaacggggcggaacccgacgccggccgccggctggtcagctgggcgcaggcggctggatttaccgacgtggcgccctccagcagcaactggctttatgccacaagccagcagcgccggtggcaggcgcgcgtgtggggggaacgcgtgcttcattccgccttcgcggagcaggcgctggaatacggcttcgccaatcccgcggacctggcccggatctcggccgggtggcaccgctggggttccaccgacgacgggtggttcctgatccccaacggtgaggtcatcgcccgggcctgaccttatggcgctttgatacgtggtttgtccacatgtcccactgggtgcactcacagtacggcagttgcggcccgtcagcagggcaaacaggtgattaggtggcgtcaacgggcactaaacttggatggtgcaattctccctttggctcgccctggtgggcgccggaaccctgatcagcttcacgcccggcgccggagccatcaacaccatgagcaattccctgaacgccgggttccgccggtccatctggggcatcctgggacaacaggcagcactggtgatccacgtggtgatcgtggcgctcggcgtgggagtgctggtggcaagctcacccgtcgccttcaacgtcatccgcttcgccggcgccgcctacctcgtgtacctgggcatcaggcaattcctgagcaaaccgaatctcgaagagcaacaaaccgcatcccttcggaacgaacctgcctggtccatcttccgccggggactgtgggtaaacctgctcaaccccaaggccatcatcttcttcctggcgttcatgccccaattcatcaggcctgaacagccgctcctcgcccagtacgccgtgctgacggccacgattattgccatcgacatcctggtgatgtggttcttctttgcggcagccgcccggtccttccagcggtttacgcattcagcacgtggacagaaggtcctcagcaaagtctttggcgtgctcttcgtcggcgtcggcatcctcctggcagtcatgcactaggttgcccacgcacccagcatccgtgacggaacgggaaaacttctttacaagcctgtcacgcaatatgaatcacatctctggccaatcgggccgatagcgcgcatgcttagtttcatgaactcagcgtcgagcccataccgcgtcatcgccgtctgcaccggaaacatctgccggtcacccatggctgagctcatgctcgctgcggcccttgaacgcgaggggctggacgacctggtagcggtggactcggcaggaaccacgggctacgaggccggacgccccattgatccccgggccgcccgcaggctcgccgccacccagcttttatcggagcagcacatcgcccgcgaatgggagctggactggttccattccagggacctgatccttgcactggacatcgaccactacgcctggctcagcgaagccgccccggaccaggagtcgctggaaaagatccgtatgctccgcagcttcgatcccgcagtggctggcctggacctcctggaccagggcatcgaggacccctggtacggcggccactcggacttcgacgccgtctggcaccagatccacgctgcactcccgggaatcgtggagcacatcaagtcggccgtactccggggcgcggaactgcagcggcaggtccgttagccccctgccgttgtgcaaggccggcggccctgaaggtacgctctactccatgagcccagcccccgtcattatcgccattgacggacgctccggcgctgggaagacgacgctcgccgtcgaactggccgccagactgcgcgctcaccacaaggtgtcgctgttccaccttgaggacatataccccggatggaatggactggcagcgggcatcgagaggtatgtttccacggtgctcgcgcccttgagccgcggggaggccgcctcctgggtctgctgggactgggagaaacattacgacggcgaaccccgggtgacgcttccggcagagatcgtcatcgtggagggcgtgggggcggcagcagcagcggcccgctctctgctgagcgcggtgatctgggccgaagcgccggatgacgtgcgccgaacccgggcgctggaccgggacggcgaaacctacgagccgttctgggaccagtgggcagcgcaggaagaggagtggctcgcggcggacaacgtccccctcgatgcagacatccgcgtgcgtaaccccgccgacggctcggcaccggccgacgtgctgcaggtcctcccctaccttcctgcgctggcaccggccttggcaccggagttgtcagcacgccggggactgcgcctccgcgcggaacggctggacgtccgtccggacgctgcgggactcttcggctccctctacggccgctcgcccaacgccgtctggctggactcctcgaacgcaggcgctgccccggacacggataccggggaggctgcggagcgcagccgcttcagcatcatggcggacgacggcggcacgttcggccagtcggtaacgcaccgttccggccacagcctgctcagcgcggggtgcgccaccgccaccgtgcagggcccctttttccgttggctggacaccgtgtgggggctctccgccgtggagattcccgaagcgtaccccggcggcttcgcgctcggctggctaggatgcctgggctacgaactcaagcgcgagaccggcgggaccgaccttccctcccccacccccgatgccgcactcatcttcgccggaagggccgtggtcctggaccatgcggaaggaaccgcctggctcctggcactcgacgcccccgacgccgatgactggctggtccaggcgcgcgccgccgtggaaactgccgtgccggcaacgcaacccggcggcagcaccggcgtcgtcctcccggcagcgccggccttccgcagccgggacacccgcgcggagtacctggccaaaatctctgcggcacagcaccagatcggcgaggggaactcctacgaggtctgcctgaccaccgccctgtctgcggacatcccggccgatgccctggatccatggaccacctacctggcgctgcggcgcaggaatcccgcgccctttgccagttacctgcgcctgggcagcctcacggtggccagcacctcgcccgagcggttcctgaagatcgcggccgacggcgggatgcgggcagagcccatcaagggaacccgccgccgggctgcagaccccgccgaggacgcccggctgcgcacggaccttgccacggcactgaaggaccgggccgaaaacatcatgatcgtggacctgctccgcaatgacctcagccatttcgcagtccctggatccgtaaccgtcagcaggctctgcgccatcgaaagctacgccaccgtccaccagatggtgagcaccattgacgcgcagctgaagcccggttcctcccgggccgaagccgtggccgcctgcttccccgccggatccatgaccggcgcacccaagatcagcaccatggccatcctggacggcctggaagacggcgcccgcgggatctactcgggagcgatcggctacttttcgttgaacggggccacggacctcgctgtcgccatccggaccctggtgatcgaagcccggggtgacggaacggcggaactgacgctcggcgtcggcggtgccatcaccgcggattcagatccggaggacgagtacgaggaaatccgcaccaaggcgttcggcgtcctctccacactgggagcggacttcccgaacgcctgaaccccgagtttttgtccagatatgcaggcttcaggacccccaaaccctgcacaagtggacaaaaactccaaggttttactggacggtggcggtcagcctcgccacgttgtccacgtagcgggccgccaggggccggttgatccagtctgtcagcttgagctcgtgggagatgtcccggtaggtgtcctccaccgcccgcatcttggtgacgatgtcctcgcccagcaacatcacggacacctccaggttcagggagaaggagcgcatgtccatgttgctggagccgaggaccgccacctcgtcgtcgatggtgaagtgcttggcgtggagcacaaacggggccttgtagaggtagatccggacgccggcctccagcagggcctcgtagtaggaccgctgggcgtggtgcaccaggaactggtcgcccttctcggacacgaacagctccacctccacgccgcgctgggcagctgtggtgatggcatagagcagggagtcgtccggcacaaagtaggggctgcagatggaaatccggtgctgggccgagtagatcagggtgttgaacaggcgcaggttgttctcggtgatgaaccccgggccgctgggaaccacctgggcggtgacgttccccggctccgggttggccgggagctgcagctggtgctccagcgattcgtccgtttcgctgagccagtcggtggcgaaaacaacgttcagcgtggtgacgatgggcccgcgcaggcaggccatcagctccacccattcccggcctgccttgcggtgccgggggttgttgtaggagggctcgatcaggttctgtgaccccgtgaaggcgatttcgccgtcaatcaccatgatcttccggtggttgcggaggtccggccggcgccactggccgtggatgggcagcagcggcagcatccgcttccactggatcttgccggcgcgcagccgcttcagcagtttcctgtagccctgtacccggagcgtgccgatgtggtcgaacagcacgcggacttccacgccccgttctgccgcttcctccatggctgtcaggaggtcatcggtgatgtggtccgtgctcatgatgtagaactcggcgttgacgaacttcttcgccttgcggacggcgttcgtcatttccaggagggaatccgggtagccggggatgaggtccaccgagttgccgtccaccatgggcagggaccccagcctgcggttcaattccccggcggacttgacccattcaggtcctgggtagtcgctttcgacgtcggcaagggacgaaagcccggcccgcaccctttcgttgacctgctgctgctgctcccggcggcggctggacagcttgaagttgccgaacaggaggaacaggatgatgcccacgaacgggacgaagaagatgcccagcagccaggccatggccgtggtgggccgcctgttgccgggaatgatgcctacagccagcaccctgatcaccaggtcggcgatacccagcaccacaaccacccaccctggagcggtgccggcaagcgaaaatggccacaacacgtgcgataacccccggagaaatgagctccggcggacggtttccagccggggcactccgcccagcttatcggtggggtgccgcactaagctggacccatgacctctcccgcgcccgtggttctcgttttcctcgaccccaccttccctgacggccggctggccgacgcctcgcagccccaggtgatggtcacagaccaaggggccacccggggtgacggcgtcttcgagaccatgctggcggtgggcggaaacgtccggaaaatccaggcccacctggaccgtcttgccggatccgcagacgcgcttgacctcgcgattccgagccaggacgagtggtgccgcgccattgccaccgcactgtcagagcaccgggcccagcaccctcccgcggccggggacggggacgaactggtggtgaaactcgtggtgacccgcggcgtggagggcgcaactgcccccaactgctgggtccaggtctcgcccgtgggtgcaggcgcccggcgccagcgagaaaccggtatcgacgtcatcctcctggaccgcggctatgacagcgacgccgccgaacgcgcaccctggctgctgctcggcgccaaaacactctcctacgccgtcaacatggccgccctgcgccacgcccacaaacagggcgcggacgacgtcatcttcatctcctcggacggcagggtcctggagggtcccacgtccaccgtgctgctggcacacgtagaaaaggccgacgacggcacgtccgtgaagcgcctgatcacaccccagctggacagcggcatcctgcccggaacctcacagggggcgctgttcaccgcagccaaggcagccggctgggaactgggctacggcccgttggagccccaggacctgctggacgccgacgctgtatggctgatctccagcgtccgcctgctggccccggtcaaccatatcgacggcaagcaggtggggacgccgtcggtgcagaaggaactcacggcggaactgaacgggctgttcgcgggcatccagtaggccagcctgtgattcgggccgttgcactctaggttccgcagggacagtggccgtaaggtgtggttcatggactcgcagacgcagccggatggcaccctgacctttgacgaatgctgggaactcctggccaacgacacagtcggccgccttgccgtggtggttgatggccacccggagatcttcccgatcaactacgtggtgcaccgccggagcatcgccttccggacggccggcgtcaccaaactgtggagcgcactgtccgagcggcccgcagccctggaaatcgacggctacgatccgcacaccgaagaggcgtggagcgtggtgctgcgcggggacacccaggtcatcgaggaccaggcggacaaggatgccgtggacagcctgggtcttgagccctggcagccgggcgaaaaggcgaactacatccggctctcagcccacgcgctgacgggccgccgcttcaaggtgaaccgcccggacgtctgggccacccgggcgcaggacaagcgccgcgcatccttcgaatagcagtttcgtcccaggtcctcagcatcaacggtttcgtgggccttggccggcacgggttccctgctcagcgggctgcttttgggctggcccggtggcggcggagacttgcgcgggggccatggtttccgtcctgggtggcagcacgtcctgtacctgaggggtaatccatacgcttgcttgattagttacctacgggtaaagtctacattgtagatgcggcagtgacaccttcatccacactccattgccccgtgcacggcattgaggttagctgctgtagccgaacggcagtaccaccgcacttagcgaagggaagccgtcatggcacattcgcagttcgacctctttctcaaagaagccacctacgccgaccaggccgccgaatccacgctggaccgcgaccgcctgtacggcctatacaccagctggtgctttatcaaccagcagaagcccggaccggaatccgagttttgggcagctatgaaccaccgcaggattgcttccggccacaacgggctgcgcatgaagggccccgctgccgccgattacatcctggcgagctacccggggctcgtctaacaagccgcagtagacggataacggcgtggaccacgtgccttcgggcgtggggtccgcgccgttcctgttactgcgggactctgcggatctcctacttgccgccggcggccgggtaggctgcgtccacagcgccccatctgaaaggctcctgtagatgattgacagcagcgctgatttgcgagcaggactccgcatccggctgctcacggacgcggacgcccccgcgctggccgaggcgtacacgcgcaatcggggccacctcgctccgtgggagccggaacgggctgacagcttcttcaccagcgggcaccaagcggacatcatccgcgccaagctcgcccagcatgcgttgggcaccgaagtcccttgggtattggtcaaagaaaaggacgacggcggaggcccagtgtgcgcgggccagcgagccgggcgcgtggttggggcgcttacgctgacggggatcgtccgcggccccttcctcagcgccaatctgggctactgggtggaccacgaactcaccgggcaagggatcggcacagccgctgttctccacgcagccaactacgcccggacggcgcttcggctgcatcgtatccaggcagcaaccctgctgcacaacaccgcgtctcggcggatcctgcagcgcgcagggtttcgcgagatcggggttgcgcctgagtacctgaagatcgcaggccattggcaggaccacctgctccaccagctgatcctgccggacccctaagtcccgcccgtcgtccaccccctgcaggagcacgggcttcgtgggccggggcgcatcctcaggtggggatgattttgaagaggaaccgcgtccgcaccatcacccagaggagccccagcaccaccgcgtaggccagggtgttgatgaggatgttctcttgctggagggccgggatgttggcaatgacggcgatgagaacaacatgcatgatgaacacgtagagggtggcacggcccaacgggaccaggaaccagcccagggcgcgctgtaccggtttccagtacgcggtgaggaaggcataggccgccaccaccaggaccaggacgttcaacagccggccgggggcaaggtaggtgcgcccgaagaacaggtcgtacattgcccggtacgcggtgtccgggatgatcgccaggcggacgtcaaacccgttggcgaggtacgggttgccccaggacaggaacgcgaacgcaaacgccagggcagtgcaggctgccaccacccaggtgtgcgatgaaagccatgccacgatgctccgccggtggaacccggccgccaggccgatgacgaacagcacctgccacaccagcaaggggaatgaatcctcgaactgcgacggcaggatccggaagcgcgtcaccgtacccgccgcgtacacggccagtgatgccgccagcacccagacagctttgccgcggttgagggcggccaggatcagcgggctggccagcagcagcaccacgtagaggcccatgacgttgaactgccatgggccgaactggagcagcaggatggcgggaagcacctgcgccggcacagggaactggaacagcgtttccatgcccgcgtaaagatcgtaggtgcgtccggctccttcatgccctgccccgccagtgccctggtccacgaaggttgtaagcgcctcggaccggaagaaaggcagcagcgacaggaggaagacgcccaccagcaccacgagcgccgtgacgtagagcttgcctgcccggcgcgaagtaaggtccaccaccgttccaaagtcgtccttcgccctgggcccgtagaccatgcccaccaccaggccggagaacagaacgaacagctcggcgcccgaaacaaagcccaccgcctcctgggtcaggagctggaagagcgacaccatgcccaggtggttcaccaccacgaagacgatggccaggccgcggagcaggtccacgcgtgagtccctgctggacgggtcgctgtagccccacgccgtgaccgcactcagcctggcggggatttgccacagggccaccaggaggatgaggagcgccgcgccaacggtccaggcggcagccccggacagggtgttggacctgacgactgatggacctgcggtgacctcggtgaccggccccgtcaccacgggcgattcctcaagccgggtgtgggcagcgtccgcagttccggcgcttccggtgaggcgccagtcgatgctggccacgcccgtgtcccgcgtgctggtgcgttcgtcccagaccactgccccagtgagtgcgaagtcggctgacccggcaacgcccaggacctggtcccaccagccgttcttgatctccgcttccgcggcgcccccggaggacgggctgtagaaggccgaggtctgcagcatgaagggcttgtcccgccccgcggcatatgtcccgtagaaattttccccgccggaggccgtcagcatctcctgcagctcaccggcacggggcacggtattgacggcggcgccccctgcggtgtcatcgtggtaggccgtcaggcccacccagtccacggcgtcgtctcccggataatagggttcgtaggctttgtcggagccatcccaggtgccgtcgccattggtgtccaacagcgcgaagccttcgctgccgggcctgggcgcattacggttccggtcaaaggggtagtccttacccaggtacggctcccacaccatgacataactgctgctggcatcggcatcccgaaaagccgcggtcaccgcctggaatgcctgccgataggcggccggctgctggccccactccacccagctggcattcatgtcgggcgcaaagcggatgagcagccggcctttgaaatccccctgcatccggcgcacttccccagcgaacgctgcggctgcgccaggggtgacctggtccagcgggacatcgggcctcaccgtgagcatcgcatgcgccccctgcccggcggattgctccaggaagccccggatgtcgctctcttccgaggcgcggaacgggaaggcgatgtcgtgcccgaagatcgcgggcgatgccccaagccgttcggagaagccgccggcagtgtcctctccccactcgaggactgcgcccagcagcggcttgccttcctccgggaagcttcgggctgcctgcgcggacccggcgggcaccaccacggccaggacggccatcagcacggcggcgaggagggcagccatccggtgcaggggccgcgggcggcggctccgggcgggacgtgtgggagcggcggcggatggcgtgctgatgaagaccccccagggacttattcctcaagtgacggggcggcgcccctggagaaactttatccgggctgacgcaggtggcaggcacctggcacccgcacgcccaagatggcgccgccgtcgtacgttaaagagggctggcggacgcatctttggcgccgcccctccgccctgcatccttcagttacgcaacatgacgacgacggcggtgcagcgccgggcggcaagtgttacgtttttggggagtaatgagtaccggcgccaagccctgactggccggtcggcaaccctccttccacggcggggtgcctcaggtgaatactcggcatatcgaccattcgagctgcaagcgtgagagaaggagatccgtcgtgtctgacgcacctgcccctgaagaaaaactgtcctatcgcctcatcagcggcccggacaaccgtgaattctgcgagcgcatctcggccgcgctggcggagggctatgtgctgcatggcagcccggcggcgaccttcaacggcagcagcatcatcgtggcccaggcggtggtccttccggcggcgatcgcttctgcggatgccgcagtggcggacgccgtggatagcctcgagtccgcgggcgatgaccttgagttcgacggcgagggccacgcatgagctatgcaggggacctgacgccgcaggaggcctgggacaagctggaacagggcgccatcctggtggatgtgcgcaccgagggcgagtgggcccacattggtattcccgacaccaaggcaaccgagaacgatccgctgttcatccagtggaccttccccggcggcattccaaaccctgacttcatcaacgacctcaaccagcaggcgcccgaggaccgtgcaaccgaactggtgttcctgtgccgttccgggcagcggtccatcgcggcggccatcgcggccacccgggccggcttcacctcctacaacgtactggagggctttgagggcgacccggaccgcttcggcggacgcaccgtcaacggctggaagaaccgcggcctgccaaccaacctgggaaagatctaagtgacctttaacgaagacgccgccggctggagccccgacacccaggccgtgcgcggcgggcttgaccgcaccaacttccaggaaaccagcgaagccattttcctgaactcgggctttgtctacgaatccgccgctgccgccgagcgcgccttcacaggcgaggacgagcgcttcgtctactcccgttacggcaacccctccgtggccaccttccaggagcggctccgcctgctggaaggaaccgaggcgtgctttgcgacggcgtccgggatgtcagccgtgttcaccgccctgggtgccctgctggcagccggcgaccgcgtggttgccgcccgctcgctgttcggatcctgctttgtgatcctcaacgagatcctcccgcggtggggcgtggaaaccgtctttgtcgacgggccggacctggagcagtggcgtgacgccctgtccaagcccaccaccgccgtcttctttgaatcgccgtccaacccgatgcaggagatcgtggacatcgccgcggtcagcgaactggcgcacgcggccggggcgaccgtcgtcgtcgacaatgtctttgccactcccctgctgcagcgctgcggacagttcggcgcggacgtcattgtctactccggaaccaagcacatcgacggccagggcagggtgctcggcggcgccatcctgggcaccaaggagttcatcgagggccccgtgaagcagctgatgcgccacaccggcccggcgttgtccgccttcaacgcgtgggtcctcaccaagggcctcgagaccatggcgctgcgcgtcaaccattcctcagccaccgcgctgcggctcgcggaatggctggaggaacagcctgcagtcagttgggtgaagtacccgctgctgaagtcccacccgcaatacgaactggccgcgaagcagatgagcgctggcggcactgtccttacccttgagcttgccccttccgggggccgctcggggaaggaagcagcgttcgcgctgctggacgggctgcggatcatcgacatctccaacaacctgggcgacgccaagtccctcatcacacacccggccaccaccacgcaccgtgccatgggaccggaggggcgggctgccattggcctgagcgacggtgtggtgcggctttccgttggcctggaggatgtggacgacctgatcggcgacctggagcaggcgctcaagcagatctagcactccggacggtggtggtgggcatgcctggaaaggtcgctactcccggcttgcggctgctgctgtccaacatccccctgccggagcagaacctgctgggcatcgccgccggcgcggcccttcagcgcctggttcctatccggctttcgcgggtaaccggccgccggcaaaggcttctgcggacaacgggcggcgcatcgctcgccgccggtggcgtcctcgtcacctggtcatggtgggcagcccaccgcactctcctcacccgaccggctgggctggtgacgtccggcccatactcattctcgcgcaaccctatgtatgtgggctggacgctgctgcatctgggcattgggctggtgtggcacaacgcgtggaccctggccgcacttccggtggcggccgctgccgtccatcgccgggtcttgcgggaggaggccagcctcgccgcgtccttcggcggggcgttcgcggagtaccggcgggcggtgccgcgctatgtgggaaggcgctgtgtgggaaggcgctgtgtgggaaggcgctgtgtgggaaggcgctgtgtgggaaggcgctgtgtgggcatgcattctgtgggcttcaggcgcttatgacggagaggcggacttccacggcgtcgccttcactgatccgggacttggccctgacggccttcttgaccggcaggaggtacgtccccttgtgcgcatccgggaacagcgaagtctgccaggtgtggccggaaatttccgctgccacccggattgagccgaacgccttgttgtgccctgcgtttcgtgctcggatatcgtccgccacgtccggcggcaggggaaggaaatgccagccggcctcgcccgggtacagccacagttcggctgtgaaggagtacgacgacgtcacgcgccgagtatggcacgcctgcggtggtgccgccaggggtgtggatatttagcagtccactagttatccacagcccctgctgcacggctctttttgtcagacccccgcaggatgatgtctgtatggaaagcacgacggcggtagtggaggcggaggcggcggttgacgcttcggtggctgcttttagggccgtgctcgcgggcggcggtgcggctgtttccggtcctggtgccgctggatctggcgttggcggggttgatgatgatccgttgcagcgggttgctgatggggcgttggatgtccttgccgggctggctcggtcggaggcgaagctggcggcggtgaaggcgcaggcggttcaggtgctcgccgccgccacgagtgtgctgaacggtccgccgtcctcgccgcaggaggccacggcccaggaccggagcatggtggccgaggtggggtgcgcactggccatcggtgaccgtgccgccggcgccctgttggccgagtcccacgccctggccacggccctgccccggacccttgccgcgttggggtccgggacgatttcctgggcccatgcccgggaaatggtgaaccaggccgtcggccttgaccgggccggagccgccgccctggagaagtacttcctcgaccctgacattcccaggcctgccggtgcggcgacgatcggggagatgcccgcgtaccggttcaaggccaaggcccgcacttggcgcgaacgccaccaccccgaatcgatcgagaagcgccacgccaagggcgtagccgaccgccgggtcgagtacaggccggaccaggacggcatggcctggctctctgcctacctcccagccgatcaggcaatggcgggctggaaccggctcaacgtcctcgcccggggactgcagggacccgacgagtcccgcaccctcacccagatccgggccgaccagttcgcccaagccatcctcaccagcggcaccagccgcggtaacagtggcggtcatggcaacggttccagcctccatgccggcaacagcgactgggttggcaacggcgacggtgatgggttgggtaccagcgacagtgcaggcgcaggaacagatctcgccgggccgtcgtccatccgggcgcaggtgctcgtcaccgtgccggtattcgcgctgatgggagtaacggacgagccggccgtgctggacggcttcgggccgatcccgccgtccatggcgagggacctggtcgcgaacggtgctgattcgttccaccgggtccttgtcgatccgcgggacggggcaccgctggagatcgggcggaccagctaccgggttaccaaggcgatgcggaactggctgcggatgcgggacggcaaatgccccttccccggctgcaacaacaactccctggataacgaggcagaccacctcctggcctggcagcacggcggaaccaccgggatcagcaacctcggacagccctgcccgaagcaccacaaactcagacacagcagcgggtgggaaccaacgccggccaccaaaaacgaaccaccctgctggacctcaccgtccgggcgacactacaaaagcgaacaccaggactgggaaccaccacactggccagactgggttactgagatgtggagtacggcaacgaaattggaaggacaaccgagtttgtctgcgctcggaggcctgaccctccagggctttgttgagcgctttgggatgccccagaatctggacctgcccgatgacttcgatccgccagacgtggacgtgccggaagaccccggacccaccgacgatgaactccccaaggacccgttcccggagtggcacctatggctggaagcgtcactttcggctctttaggtcaggcacgggctgcaggacagaccaggatcggctgagcgctgtctaggactgccggacgcgcagcaggtccggagccgcttccacttctgagaggtccgtggcgccccgcatggtgatattcactgcgtggttgaccacggctcccaggccgaggtcctcgggcggggcacccgccatggccttgtcccggacccggcgctgctcagccgccccggtgccgcgggcgatgatgtcctccacaccctggcgaacgatggcgagctctccctgttcgtccaggacgggcgccaggtaatccaccagcgagcgcaccacatccgcggcccgggccggccggaacgtgccgaaatccagaagctccccgctaagcccgctgctgctcgcctgccatgcagccatgcgcaacagcacagtgggcactggcgcggggtccaccccgtcccgccactcccggctggccgactccaccagtgcacgcaccaggagtgcgatgagcgcggcatcctcggcccggaggcagacatcggccacgcgcacttccacagtagggtggttccgcgaaagcctggcgtcgaaatagagcatcccctcgtccagcattactccgctgtccagcaaccgcgtgacaacccgacggtacgcggggtaggtcccatagatccccgcgggccctgaggtgggccagcggttccaggcctgggtccggtaactctcaaagccggtgggcataccgttccaaaagggggagttcgcgctcaacgcggtcagcacggcaagcttgtcccggatccggtccaggaccgccacgccctcctccggcgattcaatatacgtgtgcacgtggaagccacacgtgagctgctcctgtgccgtgaggccgaagcgctccagcatccgggcataccgggggtccggcgtcgtatggctggtggaggccaacggcgaggtggcaagcgcagccaccctggcaccgttcttttgggcagcccggtcagcaagcgtccggccggcacggatctggtccagcaggacgccgtactccaggcagggccgcgtctgggtctcgatctgctcaagcttaagctcggcactcaagcccatctcgtcgtcgtcgtaaacggtcttgtcttcggtttccagcgcgcgggcatccggggcatcatcggcggccatcctgtgcccggacagcagggcatcggccagtgcaagcggctcccctgttgccgggtcaacaatcaggagctcttcctcgacgccgaatgtacgcatactgtcattctgcggcaggcaggaggattttgaagggactccgcctttcatgacgaaccgtgaaaggtcagtcctggaagtactccaccttcgcgccgatggcgttcagccgctccgccaggtcctcgtagccacgctcaatgacgtagatgttccgcagctctgacactccccgcgcggcaagcattgccagcagcaggcaggctgccggacgaagtgcaggcgggcagccaacctcggccgcacgccattttgtgggcccgttgacatagatccggtgcgggtccaagagctgcacctgggcgcccagccggttgagttccgtgaggtagatggcccggttttcgtagacccagtcgtggatcatggtctggccctgggcgttggctgcaatgacggcgaagaaaggcaagttgtcgatattgagcccggggaacggcatgggatggatcttgtcctccggagcatgcagctccgaaggctttgttgtgacgtccaccaggcgcgtccggccgttccgggccatgtattcgcccgagatctccagctgctggcccatctgccccagcgttgcaagctcaatttccatgaactcgatgggcacgcgccggatggtcacctcggaattggtgacaattcccgcggtgatcaggctcatcgcctcgatggggtcctccgacgggaagtactcaatgtcgtcgtcgatggacaggcgccccgtgatcttcaaggtggtggtgcctacgccctcgatctccacacccagcatctgcaggtagaagcaaagatcctgcaccatgtagttggggctggcgttccggatcacggttgtgccctcgcggtgggcggctgccatgatggcgttttcggtgacagtatcgccgcgctcggtcaggacgaacgagcggtcccgggtgtctgcgggcggggcctggacactgtagaagcccgcggtggcctccaccgagaggccgaactgccggagcgcctgcatgtgcggttcaaccgtccgggtgccaaggtcgcagccgcccgcatacgggagccggtattttgccgattcgtccagcagcgggcccaaaagcatgatgacgctccgcgtgcggcgcgcggcgtcaacatccatggcttccaggtccagcacggccggccgccggagctgcaggtcggtgtcgttaagccaggtgcactccacgcctatgctggtcaggacctcaacaatacggttcacttcttcgatgcgcgccaggcggcgaaggatggtggttccccggttgatcaggctggcacaaagcagtgccaccccggcgttcttgctgctgttgacatccacggaaccggaaagggtgtgtccgccctcaacccgcaggtgggtcatctgcggcttgcccacgttcacgatgctcctgccaaagatcgtttcgaggcgctggatcattttgaggctcaggttttgcttaccctgctccatccgggcgacggcgctctggctcgtgcccagctcggaagccaactggccctgggtccagcccttctcactgcgggcgtccctcaacatggcggcaacgtgttcggcggtttcctgcgtcatagtcaattttatatcataaatgagctaacctgcaggactcgcggccaatctttccaagcactagcacgatccgtacccgattcatgcgatagaaacacgtgcccagtcagcttgacctccctctgccgacgacggacactggaggaggatcccttcgtccagcggcaacggaggcaacatgcgccgcacaccagccagcaaggcgtcgccaatcaaaagactgcggggcagggcgcagacacactggggattactcgccgcgaacacgcgggccgtgccaggaatgcttggcctgcttcttgccgcgcttctcttggtcaccggcgtccccgcccacgctgtgccctcacccggggaggggcagcagtcatttctgggtaacgacatctcctggccgcagtgcaaaggagattttcccgcggaacaggcttttgccattgtgggcgtcaacaatggcctggccaacaccacgaacccctgcctgtccgagcagctcaggtgggcagaagattcggtgggccaccccggccagcccaccgtgtccctgtacgtcaacaccgccaatcccggcgccgccggctcctggtggccggaaaatgacgagtacccggccggccaggcagtccacaacccttacggcccctgcaaggccggggactacggcaaggcctgcgcctatatgtacggcttcgccaaggcctacgacgacgcccacttccgcggggtcagcagcccctccacatacttctggtggctggacgtcgaaaccgaaaacacctggtcccgcaccgacagggacgccaaccggacagtcctcgaaggcatgacggacttcttccacagcatcggagccgaggtggggatctactcaaccggccagcagtgggaccggattgtcggaacagtcagcagctcgagcaacctctattcgcttcccagctggctggcggggtccctcaacgcctccggcgcggccagcgcctgctcacaggagcccctgaccgccggcggcagggtggtgctggcccagttcgtgtccagaggtttcgactacaactattcctgccactaggcccgcgcaggtgtcagcttcccagccacaccatgttccacgtcccgagggacactgctgcaaccaccgctgttcccgccatcactacgcccccggcaataacccaggcatccagtgcgctgaaggtggattcgcgcgcccacgtccggcgtccgcccccgaaaccgcgcgcctccatggtcactgccagccgcgacgcccggcggattgcctgcaccaggagcccgaagctctgccccaacgtcgccttcaaccgctgcacggcgttgccgcgcgaacccacgccccgggcccggcgcgccatcccgatggtctgccactcttccgccatcaggcccaccagcctcatggcggcaagggtccccagcacgaagcggtgcggcaggcgggccttctgcgccaaggcatcggccaggtccgtggggtcggtgcagctcatgagcaacaccgccggaagggcgatggccagcccgcgcagcatgaagccgacccccagttccagcgagccttcgctcatgctccagatgccgacgtcgatcagcgtccttccgctgtccggagccaggattgaggtactccagccccccacggccgccgcgaggatcagcggccatccgcgctgccacagcagcgtcagcgtcaggccagcgagcgggaacagcaggaattcgaaagccagcgccacggacgcggaaacccagtcgatggacagcgccagcactgccgtgatgaggaagacggcggcaaacttgctcaggggattggcacgggtcagcagagcctggttgccgcgcaggttcagctcctgcctcatggtgccaccggctccgccgcagccatccgcagctcagttccacccagcgcggcagtgaactccgcgtcgtgagtcaccgacaccacagcggtgccggcatccaggagctcggacaggaacgaggccagctccgcccaggtgttcgcgtcctggccgaacgtcggctcgtccagcaccagcacctggggatgggccgccagtactgtggccacggacagccgccgcttctcgccgccggagagcgtataggggtttgcgtcaacaaggtgggtcagccgcaaacgctccagcagctcgtcaacgcgttcctccccgtgcccaaggtgccgcggaccgaacagcagttcatccagcaccttcccggtgacgaactggtgctcgggctcctggaacacggtgccgatccgctcaatgagctcctcggctttccacttaaaggggtctatcccggccccacggctgaggtccagggtcgcggaaaccttgcctgcaacgggctccaggagtcccgcaacggtcagcgcaaacgttgacttgcccgcgccgttggggccggtgatggccagcgcctgtcctgcccggacctgcgcagaaacatcgcgctggacgggcaccgggggtatcttccggaagccgctgcggcgcggacgttcccgggaaaccgcaaggtgttcggccgccagcagcaggccgccggagccggcggccgggttggccgaccttgcacgcgtctcaggaacatacccgggcacccacacgccggccgccgccagcatggtccgtgcgtccgcgagcacctggtccggagggccgtcaagcagcacggcatcatcagtggcactgcccggctgcagcaccacgatccggtccaccaggtccttccacacggatacccggtgctccaccacaaccagcgtggcaccggtcttgtccacgcagcggcccacggcgtcgcggacttccagcacgccggctgggtccaggttcgccgtgggttcgtcgagcaggatcaggccgggccgcatggcgaggatccctgccagcgccaggcgctgtttttgcccgccggacagggccgacgtcgggtggtccagcggcaggtgggaaagtccgacgtcgtccagcgcctcgtgcacgcgggcccagatggcgtcgcggggcacggcgaggttctcggcgccgaaggcgacgtcgtcgccaacgcgggagaggaccacctgcgtctcagggtcctgctgcatcagcccggcccggccgcgctgctcgcggggcacggcgccgtcaaccagcagcgaacccgtctcgtcggactcgctggcgtcgccgccgtcgtcgtttatgtcccccagcacccctgccagggcatgcaggagcgtggacttgccggcaccggagggccccaggaggagcacccgctcccccgggcggatctccaggttgaggccacggacggccggcttggcgcgccctgcatggcgccagccccagccacgggcggtgacggcggccgggcgcacggcgactgatgcctcgtgccgcgaaggggcgcccatcaggagaagacgggctccgttgccgccctgcgtgatgcaaaggagctcaggaccccggtcctggccaggccgcgggtggcgatccaggacagtgctccggcgatgatggcgccggagatggcggtgaagatgatgtaggccagcttgtcgccggcggcgtaggcaatattccagccccacggtgcgaaagagtcgttcaggccgcagaaaaggccggcgccggcgccggcgagcagcgctacgggcaagttgaacttccggtacacgaagatggcgaagatgatctcggcaccgaggccctggacgaatccggagaacagtacggatgccccgtactgggagcccatgagcagttcgccggtggcggccaccgtctcgcagaagagcgcggcgcctggcttgcggatgatgagcatgcccaggacggccgggatcatccagccgccggcgatcaggccggtcaggggcgggtagacggcgttcatgggtgcggagactgcggccgccccctgggaccaggcccagaaaatgacgccaccggcgacggcgatgagggccgccaccacgatgtccacgacgcgccaggacttgccggcgggcttcttcactgctgttgttgccatgtggtcctcctgaggaacaggaggggaaagtgaacgcggttgccggcactgctgccgctgcgcgcacttcgagaactcgactcccttgcgccggtactaaccggatcaggttcgagggtctgcggctgtccgcactctcagcgcccacctgcggtccctggcattgccagtgatgccgacggcggcgctcccctgtcgttgaatgattctgtttggtgaaatatccgccctgttgggcgtggttcagtttaccgcagggaggggtagattgtgggccatgactgcgaatccaccagatgtgaccgggtatgatccggattcccgcgatgcccagccggaaggatccctggaagcactgatcgcccggattgaggcggagatccgggaactgcaatttcccggcttctccctggacgactccctgaacctggggctgctcctggtggagctgggcaaggagcgcgggcttcccatcgccatcgacatcaccaagggcgagcaggtcctcttccacgtggccctgccgggggcgaccccggacaacgggcactggatccgggccaagaagcgcaccgccgcccggtacgaggttccttccctgttggtggggctgcgcgcccggctccgcggcgggcgtattgaggataatgcctggttcgaccaggccctctacgccgcgcacggcggctccttccccttgtacgtcaccggggtgggtgccgtagcaaccgtcaccgtgtccggattgccgcaggtgcaggaccatgacctggtggtcgaggcgctccgcgacatcctccggcaggccggcgcggagtagcgcctggcagcatgcgcggagtgacgccctgagggcccgagatgacttttattggcccggaccacccctgctattccctgctggcggaactgctgtccgccgtcgggaagtcctggcagcaaggctacgaacaaggccgccgcggcggtccgcacacaaaccccgcacgcgtggagcggggcgcgaggctagcagcctgcgtgcagtgcgccggcgcccagctccagcagaatacaaaggctgcttagcatttattagtaatcatgcttactatgttgtctccagcgtttgaggagtacagcacatggcagccagcatccgcatgaaaggtgcccgaacaggcctgcagaaggctgccctaggaacgggtgccgttttttgcctggccggcattctgggattcattcccggtatcacctccaattatgactcgcttcgcctggccggccacgcatcggaggcgctactgctcggggtcttccaggtgtccgtcctgcacaacaccgtccacctggtctttggggctgccggcatcctgatgtcgcgctcgcacccgcaggcacggaacttcctcatctacggcggcgtcatctacctggtcctctggctgtacggcctcctggtcggtgaccccacccccgcgaacttcatccccgccaacgatgcggacaactggctccatctggtccttggtctggccatgatcgccctggccgtcatgctcgcccgtggacccgcccccgccgcaggcggcgccgtcaccggcaacaccgtcaagtcgtcagcgcccggcacccgcggacgctgaccaccatctcccggccgggcctccagcgcagggggcaagcaaccggcacacgacagacctcaaggagcaccatgaaaatcccaacggcacggggtccggtcagcaccgcattgttcagcgccctcgcggagctgccgggcaccaatgagggcgccctggagacgctgcaccggacggtggccagccaccttccggcaacccttgacatcattggcgacgacgacctccagctgacgctcttctgcctctacgagctccactactcggggcttgagggcgtgagcgacgactgggagtgggcgccggaactggtccgggtgcgccagctccttgaaaagccgttcgaagccgcgctccgggaggctgccgccgaggcagccggtgatctggaacttcccggcgcacccgatgtcaccagcgacgcagtggccgatatccttttcggcctggccgcacgtgacggtggtcccagcctctcccggtatgtggccaagcaggccagcctgggccagctcaaggaattcctgatccacaagtccatctaccagctgaaggaagcggacccgcacaccttcgccatcccacggctctcagggcggcccaaggcggcactggtggaaatccaggcggacgagtacggcggcggacggcccgagcggatgcacagcgccctttttgcccgcaccatgcggggcctgggaatggacgacgagtacggggcatacgtcgacgccgtccccgcggtctccctcggtgcggtgaacctgatgtccctgttcggcctgaaccgccggctgcggggtgccatcacggggcacctggccatctacgagatgacgtcctcccagcccaaccgtctgtacggcaggggcttccgccggcatggattcgatacggacgtcacccattacttcgatgagcacgtggaggccgacgccgtccacgagcagatcgccggccgggaccttgcgggcgggctggttgaggccgaaccccacctgctggcggacgtcctgttcggagccacggcggtcatggccgtggacggcaggctgtccgcgcacatcctggagtcctgggagaagggccagacctccctgaggacggcactgccggcggccgcatgaacaccccggccccaggcaagacggccgaatacatcctgcccctgcgctggccggatgattcggacctgccggacctggccacctacctccgccgcctcactggctggatcgccgtcacggtggtggatggttccgccccgaacgtgttcgagcaccaccgcagagtgtttccgcctaacgtcaggcatctccggccggtgcccgaaagcggcagtgccggccctggtagagccggcgccggcaacggcaaggtggccggggtgatgaccggagtaagggtctcgacggcggacctgctggtcattgccgacgacgacgtccgctatacgcgcgagtccctcgccgccgtcgtccagcacctcagttcagcagacgtggtgaggccgcagaactactacgatcccctgccttggcaggcgcggtgggatacggcgaggaccctcatcaaccgcgcctggtccgcagaccttcccggtaccctggccctgcgacgcagcacccttgtggcggcgcagggatacgacggggtcctgttcgaaaacctcgagctgatccggaccatcaaggcggcaggaggctgcgagaaggtcgtccctgacctgttcgtggcacggaggccgccaaaggcgcgccacttcctgaaacaacgcgtccgccaggcctatgacgatttcgcccagccgcgaaggctcggcgtagaactcgcgctgctgccggcaatcctcgccgcagcgcgcctgcccgcgcggctccgcgtggccgcctttctaacgctggcagccgcgtccgccgttgccgccgaggtcggacggaggcggaacaggggcacatcggtcttccccttcaccacggtgtggtttgccccgctgtggaccttggagcgcgcggtctgcgtgtggatcgcgctcggcttccggctggccgggggcatgccctatgcaggaacccgccttaaaacagccgcgcattcggaggccgaacttcggctgcggcacagcagacttgccggcacccggcaacaggattgtatggaattccacagcaacccagagcaggagcagaaatgaaccaggaaccagccgagagctctattgtggtgtgccccgacgggccgctgattgtgcgcggcgactttgagctcgtcacgccgtccggcgaaccggttccccgtgaccgcaaaaccgtggcgctgtgccggtgcggcgcctcagccatcaagccctattgcgacggcacccacaagatgatcaagttccgcacggaacccccgtcagactgatcacgcgacgcggcacgctgggcaggggacccggcaaacgccagataggctaatgacagcccgttttccgcccgcaaggagtactaaggaatgaaccttttcatcaagctgctcggcaccggcgtgagcctcggcgccggcttcgtcggcaccaagctggtcaacaccatctgggaaaagtccaccgggcgtaagccgcctaccggcaaggacgaggacgtccccacaagcctgcagtccgcgctgacgttcgcgctgatctcggcctcagtcagcaccatcatccaggtcctggccaaccgcggcacccaacgggccatcacccggttcgccaagagccaggacatcgtctagccgcgtccccaccagcactcagccgtcgccggaaccgtcctcacgggcggctttggcggcggctttttgcaccacggcctccagctcatccgaggtgaggagttcacggtgcaggtgcttggtgcggtaacccgcgcgtcccaccatatgcgcggagaccggcacggtgagcagctggaagatccaggtcaccagcagcacgggccacacccaccaggtgcgcatctgcagtccgatggacgccaggaggaggaacagccccagtacctggggtttggtggcggcatgcatgcggctcaggaggtcggggaaccgcagcaggccgatggccgcccccagggacatggtggccccaacaatcatgaacaccgcggacagcacgtccacccaggcatccaggccagtggaatcaggactcattgggctgctccctccggtctgccacaaaccttgccaccgtcacggacccgatgaagccgatgatggagatggccaccaccagcatcaggttgttgaggtgccggttcacggccatgtccacgcacagggcaccgcccaggatggccagcaggacgtccgttgccagaacccggtccagcagcgacgggccgcgggagatcctgatgattgcgccgacggccgcgagcgagaagataacagcggtaactgccaggacgatctgcatcatgcggccgcctccgctcgcacaatctcgagttcttccctggtacccatgatcctgatcagccccgcttcgatggacagtacctcgttcttcaggttttcgacgccctgctgggagctgatgttcagcgcgtgcaggtacagggtggatgttgaccggtccacctcaaccaccagcgacccgggaatcagtgagatcacgtgcccggtggctgtgaccaggaggtcctggtggctgcgcagggtcaccgccacaacggcgttcttcaccctgggaccgcgggccacggcaaggtacaacagctgcatgctggcggccaccaccttggccaggaacaccagcgcgaacggaatggcatagaggatgttgaagcgtccgctgagctccaccggcggaaggtagaacaggcgtgccaccgctactgacagcagggctccgaacaggaggtttcccgggctgaagtcctgccacagggcaccccagacaatgaccagccacaccaggagcggaagctcctggcgcagtgagatgcgccggcggctcatttccctccccctgcggtaaggaccattggaacgaccgtgtcctcgcccaggacggcctggatgtaggaggaccggtccagcatgtcgtgcgcggcctggtccgagaccatgaacagcggccccgcgaacaccgtcagcccgatgcccaggaccaccagcccgatagtggagcccaccatggtgcgcggcagcagggtgacggtgttcgctttggctcccggcccggtagcgcgggcggcaggcgtggccagcagcacgggatccggatgttcggcgtcggaaggcctgcgccagaacgcacggttccacaccctggccacggcaagcagggtcagcaggctggtcagcaccccgccgatcaccaggacgtatgccagcggtgtccccagttcaacgccggcctgcatgagccctaccttccccaggaatccggagaatggcgggatcccggccaggttcattgcaggcacgaagaagagcagtgccagcagcggcgacagcttggcgaggccgcccagccggtccacggaggaactgccgccccggcgttcgatcagcccggtcaccaggaagagggaggtctggatggtgatgtggtgcaccacgtagaagacggccgcgccgagccccgccacggaggacatggccaggccgaacaccatgtagccgatgtggctcaccagggtgaacgaaagcagacgtttgatgtcgctctgcgccagggcgcccaggattcccaccaccatggtcagtaacgcggcaaccatcagcggggtgttcagtgagtccccggggaacagcagtgtttcggtgcgcaccatggcgtagacacccactttggtgagcaggcccgcgaacacggcagtgaccggcgccggcgccgtggggtaggagtccggcagccagaaggacagcgggaaaacggcggccttgatgccgaacgccaccagcagcatcacgtgcagcagcgtcctggtgccctggtccagctcgccgagcttgatggccaggtccgccatggtgattgttccggtggcgccgtagaccatggcaatcgagatgaggaacagcaccgaggacaccacggacaccaccacgtaggtgacgcctgcccggatgcggggtccggtgccgcccagcgtcatcagcacgtagcttgccgtcagcaggatctcgaaccccacgtaaaggttgaagaggtccccggaaaggaacgcattggagacgcccgccaccaggatcaggtatgtggggtggaagatcgagacgggcgcatcctggtcgccgtcggccatgccctgcccggtggcgtacaccagcacggcaaggctcaccgccgaggagaccaccagcatcagggacgagaactggtccaccaccagcacgatgccccacggcggaagccagccgcccagcgttacggcaaacgtgccgccgtcccagacggaggccagcaggaggcactccagcaggagcgtgagggacagcagggcgatgctcaccgcgcgctgggcccgtgaatggcggatcagcatgaaggtcagggcggcgcccaggatgggaagtacgacggcgagcggggcaaggcttgcgaggttcactttccgtctccttccgggccgggggccacattggtggagccgggtttttcttcagaggctgcctgctcggccgctatctcgcggccgccggccaacagcgttgtcccggcagcgccgtcgttggaggtggcgtgcccggcagcgccgtcgtgcgtgccgccgtcgctggagacgcggtggttggaaacgctgtggccgtcggcgcccagcatggtgagcgggaactctgaggtctcggcagggacctcggcatcgtcctcggcgtcgaagctcggcgtttcggccacgcggaggtcttccacgtcgtcctggatctcgtcacggcgcgccagcacccacgtgcggtagatgatgccgagcataaaagcggtgacggcaaaggaaatgacgatggacgtcaggatcagggcctgcggaaggggatcgctgtaatccccggccgcagtgtccttcgagtacaggggcgcgagccctgcgtacccgccggtggccaggatcagcaggttggtggaattggccaggagcatcagccccagcaggacacgcgtgaggctgcgttccagcaccaggtagatgccgcaggcgtacagggcccccatcacgatcaggagggtcaggtttatgctcatgcttggccctttgcggtggtttcggaggcgacgccttcaggctcctgatcccgtgcggaaagtgtggcggagtcatcgcccgcgaactcctgctcctcgccgggagtgcggccacccactgcggaacgctgttcgaagtgctcgtcgatttcggcacccaggctccgcaggacgtccagcaccaggcccaccaccacgatgtacacgccaatatcgaaaatggtggaggtgacgaacttgatgtcgccgaacaccgggagccacagctcgatgattgcggtctggaacacctggccgcccagcagcagcggcacggcgccggaggctgcggccacagccagcccgattcccagcagggcaccggcgctgaccggggtggcctcgcggagctcaaaccgtcccccggccaggtagcggatggtcagggccaggccggctgtcaggccgccggcgaagccgccgccgggaaggttgtggccggccagcaggaggtacagcgagaacatgatcatggagtggaagatcagccgggtgaccacctcgaaaatgatggaccggcgttcgggggccaaagtccggccggccacgatccacgcatcccgggcaggcgccgcgaacttccggctcacggccagcgccgccgcgtcccggctgccgggatcgacgccccggtggcggcccacggttccttccgcaaccgtggcggagttcaggatccggtcgccgcgtccgcggacgaagatgaggctcgccacgccggtagctgccagcgcgaggacggtgatttcaccgaaggtgtcccaggcgcggatgtccacgagcgtcacattgacgatgttgagtcccccgccgccctcatacgcgagccgcgggaattccagggacacgggcgttgctatccgtgctcccatggcgtaaatcgcggcgaacaccatggtgacgccgaagcccagtccgatgatcacgcgcaccacccggtatttgccgccggtccggtcgcggagctcgggcggcaggctgcgcatcgccagcacgaaagccaccaggatgatggtttccaccagcatctgcgtcagtgccaggtccggggcaccctggagcgcgaacatcagggcaatgccgtaaccggtgacggaaaccatcaggacagcgaggaaccgcttgttggctttgacggccgccagggcgccgatcacgatgcccgcacccaccacgatctggagcggggaaccggggtcaaccaggtagatcccgtccggaagcggcttgccggtcaccaggatcacggacaggggcaggataaacgcgacgctgaggatgacagccaggtagtagtacagcgaaccgcgctgcgtgcgtccggtgatccacaccgctgcgtcgtccagcccgccgatggtgtattggtacgccttgtccccgtccacccacggcgggaccagggactgtgcccgcgaaaccgcgtcgcggccaaagtacatcgccaggcccagcgcgaacgtgagggccgtcaggcccagcgccggcgtgaagccgtgccacagcgcaaggtaacctgcctgctcagcggccgtcccggcgtcgggagcggtggaggcgaacagggcggcgtacggctggatccaggcgtcgacgggtgccggccacagcccgtagacgatggtcaaaaagctgaggattgcgggcgcggcaaggaaagagggactgatggctttgaagggcgtgggctccacgccgggcttgacggcaaaggcgccccacatgaagcgcgcactgtaggcgaaggtgaggatggatcccaggaccagcccggccaggaccaccatgccccacgggctggctgcgtcgtctcctgcgtggtggacgaaggactccagcaccgattccttggccacgaacccggccagcgggggaattccggccatggacgcggcgccgatggcggcaaccactccgagcgcgcgggaggagcggaacacgccggaaagcttgcggacgtcgcgcgttcctgactggtggtcgatgatgcccaccaccaggaacagggtggccttgaacagtccatgggccaggagcatcgcgagccctgcgagcgccgcgtccggcgtgcccaggcccaccaccatggtgaggaagcccagctggctgacggtgccgtaggcgaggatgagcttgatgtcgctctggcgcagcgcccggtagccgcccacaagcatggtggccaggccaaggcccagcaccaccggctgccaatacgccgtttcggagaacccgggcgccagcctggcaaccaggtagataccggctttgaccatcgcagcggcgtgcaggtaggcgctgaccggcgtgggtgcggccatggcgccggggagccagaagtggaacgggaccagggcggacttggtaatggcgcccaccaggataagtacgacggcggcgctcaccatggagccggaggctccacttgccagtgcgggcgcctgctccaggatgctggagatacggtaggtgccggctatatggcccagcatgatgagtcccaccagcatggccagcccgcccgcagtggtgaccatgagcgcctgcaaagcggaccgtcgcgcagccagcctggtgcgggcgaatccgatcaggaggtaggacaggatggtggtgagttcccagaaaatgaacagcagcagcaggtcgtccgccgccaccagtccgaacatggcgcccgcaaaggccagcagctgcgcaccgaaggcaccgaggtcctggtcttttttcttgaagtacctggcgcaatagaccaacaccagcgagccgacgcccagtaccagcagggacatgacccaggccagcgcgtccatgcggaaggcaagttcgagttggagcccgggaatccaggcgacagtttcgctgatggaccccgttccggcgtagaccggaccatgctgcagcaggagccaaacgaaggatgcggcaggaacagctgccagtgcgtagaacgcgttgcggccccaggccctgaagaggaacggcgccaggacagccaccgaaaagtgcacggcaaggactgttatcactggtatctccgcaacgtcagggattcgattgtcaaagttggagcaggcggttcattcgttaggtccgggagggcccagtttatcaaggcccaggcgcccgccccgccccttagggcgccgcgcccggcgtggggcccggtatcgacgggggttcgctccgcctcctgttcgccacgggcggatacgatgcatcctatgaacagcgccagcgctccaggggcaacgcagccgtcctcggaacttgagtccgggaaccagcgcaccagcaaaggccgcatcctggcgtgggcttcatgggactgggggtccgcagccttcaacgccgtcatgaccacattcgtcttcaccgtctacctcacctccaacgccttcggcggcgaggaccaggcctcggcggtcctgggcggtgcgctggcagttgccggcctggcgattgccctgctggctcctgtcaccggccagcgctccgacgcaggcggccggcgcaagctgtggctgggagtcaacacagccgccgtcgccatcctcactgcactgtgcttcttcgtcttcccgcggccggaattcctgctgctcggagtgtccctgatagccctcggcaacgtgttcttcgagttcgcgggcgtcaattacaacgccatgctcgcccagatctccacgccgcggaacatcggcaaggtcagcggattcggctggggggcgggctaccttggcggcatcgttgccctgctgatcgtcctccagctgttcgtccagcccagcttcgactggttcggcgcgtccaccgaggacagcctgaacatccggctggtggctgttttctcggccctctggttctttgttttcgcccttcccgtgctgtttgccgtgcccgagcttccccgcgcctcccacgcgaagcggttgggcctgctggccagctacgggctgctggcccgccggatcaaggccatctacgccaccagcccgcacaccatctatttcctgctggccagcgcagtcttccgggacggactggccgccgtctttaccttcggcgggatcatcgctgccggaacctttggctttgagctgtccgaagtcattttcttcgccatcttcggcaacgtcgtggccgcagtgggcgcagtgcttggcggcctgctggatgaccggatcggccccaagcgggtgatcatcggctcgctggtgggcctcctggttgcgggcagcgtcatcctggtgctcggcaacggcgactacaccttcctgggcgtggcctgggccggcagcaccactttctgggtgttcgggcttttcctgtgcctgttcgtggggcccgcccaggcgtcatcgcgcgcctacctggccaggctggccccgcacggcgagtccggcgaactcttcggcctctacgccaccaccggccgcgccgtcagtttcctggcgccaacgctcttcaccctcagcatcacccttgcggcgccgctggtggcgcccggcgaggcgcagcgatggggcattctgggcatcatggtggtgctgctggccggactgctggtcctgctgcccgtcaagtcgccggaccaggcgtccatcgccgtcgtgcctgccgcctgactagccgcagatttccgtgaggcttcgccgccaacctcttgacgcttcatgttatcgatcacataattgtgatcgataacatgaatcctttcaatgacgaggagcaccatgacccaggcccaacatcgcccccgcgcaggaattatcggcaccggcggcatcgcccatgcgcatgcggaagccctgaagctggcgggcgcagagctcgtggtggcggtggatatcgatcccggcagggcaacagaattcgcgcaaaaggtgggtgtcgcccggaccgcccccaccctggccgccgcagcggaagccggactcgacctggtcgccgtctgcacgccgccgtcgtcacacgcccccctggccctggaagccatggcgctgggcatggacgtggtcttggagaagccgcccgccctgtcgctccggcagctgcgggagctgcaggaagcggaacgcgccacgggcaggcgggtgagctgcatcttccagcaccgcttcggtaccggcgcccgcaagctggcgaacctgcaggagtccggagccctgggcagcccgctcaccggattctgcaacaccctctggttccgggaccaggcatactttgacgttccgtggcgcggccagtgggacattgagggcggcgggcccaccatgggacacggcatccaccagttcgacctccttctccacctgtggggcccctggcaggaagtgactgcgttcgccggaaagcttgcccgccggaccgaaacagaggacgtctccaccgcaatcgtccggttcgagtccggcgccttgagcaccgtcatcaactccgtgatctcgccccgggaaacctcccagctgcggttcgactacgagcacgccaccgcggaactggaccacctctacggctacgacgactcaaactggcgcttcaccccggcacccggccacgagcaccttgccgctgcgtggactgacggcccggccggcacccccagcggccataccgcacaatatgcccggatcatcgaggccgtcagcgccgggaccgttccgcccgtcacgcttgctgacgcctaccccaccatggagctcgccgcagccatctacgcctccgccatcaccggcaagaccgtccgccgcggcggcatcaccgaaggaaacccgttctttgaccgtgccgatggccggctggaaccctggacactggaaaagagccccgcatgagccacgccgccacaacaagtgctgccccagcccccgcacgccagctcagctggacggacgacggcgccgccgtcgaaatctcactggacggcgtgtccgtccttacctacacctacgccgccgacgattcccaggcggaatcaccccggccctacttccatccggtccgcacccctggaggcgacctggtgagcgcctaccgcccgcacgaccatgtgtggcacaagggcatcgcctggtccctgccgcaccttggcccggacaacttctggggcggccccagctaccggcgcggcaaggactaccagtggctgcccaacaacggcgccatgcggcacctggaaaccgccaaggcagcggacgacgacggcacgttcaggttcgcgcataggctgcagtggatcacccagcagggatcgctcgtggtggaggaggataggtccttccgtgtggtgcctgggacggacgccagctacatccttgtgttcgacaccgccatgaccaacgtgtccggcgaggacatccacatcggctcccccaccacggagggccgtgagaacgcagggtacggcggactgttctggcgcggcccccgctccttcgcaggcggaaccatcatgggacccggcggcgccactggcgagcagctccgcggccagcgggccccctggctttccttcgtagggcagcatgacgaaacatgccgctattcaacgctggtgatggtggacgatcccggcagcgtacatccggagccggagtggttcgcccggtcggaaccgtttgcctgcatgggccccgcccccttcttcagcaaggaaaccctgttccaggcaggagccaccctccgtttccggtacggcgtggttgttgcggacggcgcatcggaccagggcagggcggaagcactggcaacggccgcacgtggcgtactggctgcgctggcgtccccggcagggaaatgaacggccagccggtgaacagcctgatgccgccccctccggtgccgggatttcccggcggcactgcagtcagcaggctccgggtgtatgactgggaatccgccgacggtctgtgcggcggctccccgcacctccacacggtgtcctccgaggcgtacgtggtcacggccggcgcgggagaggtacacaccatttcgatggcaggcgtccagcaacaccggctggcagccggatccctggtgtggttcagtcccggcaccgtccaccggctggtgaacgcgggcggcctcgcgctcaatgtgatcatgtccaacgctgggctgcccgaggccggagacgccgtcctgacgtttccccgccgcatcctccaggacccggcactgtacgcggcgaacgccgtcctgccccgggatgcggacgaaagtgacgttgcaggggcagcgcggagacggcgcgacctcgccctggaaggatacgccgaactgcatacatccgtgttgcgggacggcactccggcgctccaggagttccaccgcgcggccgcccgcctggtccgcccgcgcatcgggcactggaaggatctctggtcagccaacgtccagagccaggtaaaggaaaccgagcgagcactccgcgatctggcagacggctcagccacgacattggcgggcgcagcagtagccagtgccgaagagcgcgcgggcgaggggtttggcatgtgcgggcgcctcaccacgtgggaggatgcccggctgtgacacaatcccccgccgaggcccggccgcctgcccgcgcagccacgatctacgaggtggcgcggctggccggcgtctcgcaccagactgtctcccggtacatggctgaccgcaccaagctcagggcctccacatcggagaaagtggaacaggccatggcggaactgaactactcgcccaacctcaccgcccgttcgctgcggaccaaggctgcataccggctcctggcgctggtgcccggatcctcgccgtactttccatcccggatgctcaacggcgcggccgcaacagcccgggaagccggataccacctggacgtcgtcgccctggaaggggccggtccggagcggacggagcggctccgccggatcctggacggcgggccttttgcgggggccctgtccttcgtgcccatttccgggacggacctcctccaggcgcaggaacggatccccgtggtggtggccggagagtatgacgacaagatgcgtggccagggccgtatttcggacggctctgcggcgcaggccatcgtggagcaccttgctggcctgggccaccggcggatcgcccacatcgcgggcccgcaggaatggcccgcggcccgcaaccgccttgccgtttaccgcaaggccgtgcacgacgccgggctggaggacggcggggtggccgaagcggagtggagcgcagcctccggatacgccgccgcgaaggcactcctggcccatccctccttcactgccatctttgccgcgaacgaccacctggccatcggggccatccgggccctccacgaccagggcctccaggttcccgccgatatcagcgtcgtcggatgggacgaccatccagaatccgcgttcctggtcccgtccctgaccaccgtccacatggacctggaggcccagggcagccgcaccatggagcaactgctggccgcgctgaacccgggaagcacgccccctcctgagcccggccccgcgggcatgcggctggtcctgcgggaatcctcggggcccgcccccaaccaaggccaggcagactagtctggaaccatgaacgtggacgaaaccaaccttcccggcctgggccggcgcaaggatttcatgaccgcctcaggccgccggatcggcgtagtggagcggcgcgagggccagaccgaactcatcgtctcggcctgggatgatccggacacctgccaggcatccatacccctcaccaccgaggaagcagccaccctcggcaatctcctgggcgggcagcacctggccatgaaactcacagaggagcacaaggacgtcccgggaatcgtcacccggcagttctcaatcgctcccggttcccctttccagaaccagcccatgggcaaggcctgcatccgtacccggtgcggtgtctccattgtggcgatcatgcgcgagggcgaggtgctcccgtcgccgggacccgacgtcgtgcttcactccggtgacctgctggtggcagtcggtacccaggaaggcctcgacgcggcggccgatatcctgcgtcgcggataagtcggcatggaccccctggccctgaccctcattgaactgggggccgttgtgttctgccttggcctgttggccaggctggccggacgggtcggaatgtcccccatcccgctctaccttctgggcggactcgctttcggcgccggcggcatcgtcaagctcgacggcatgaaggaatttgcgcacgtctccggtgaaatcggagtgatcctgctgctgcttatgctcggcctggaatatacggccacggagcttttcacaggactgcgacgctcctggcagggcggcgtgctggacctggtcctgaacttcctgcccggtgctgcgctggcctacctgctgggctggggcggggtgggagccatggtgctgggcggcgtcacctatatctcatcctcgggaattgcggccaaagtcatcaccgacctgggccggataggcaaccgggaaacaccggtagtgctgtccatcctggtgttcgaggacctggccatggccgtctatcttcccgtgctgaccaccatcctggccggagtcagtttcctcggcgggctcaccagtgtgggcatcgcgctggccgtcgtgagtgtagtgctgatggtggcgctgcggcacggccaccacgtgtccaaggccgttcacagcgagaactcggaagtgttcctcctgaacgtgctgggcgccgcgctgctggtggcggggatagcctcggccatgcaggtttccgccgcggtgggagcgttcctgctcggcatcgcaatttcaggcgcgacggcgcacaacgcgacccgcatcctcgagcccctgcgggacctgtttgccgcgatcttctttgtcgcgttcggactcaatactgatcccacatccatcccgccggtccttggctgggccctggtgctggccgtcatcacggccgccaccaaaatggcgacgggcatctgggcggccaaacgcgccggcattgcgctgcccggccgcctgcgcgccggagccacgctgatcgcacgcggtgaattctccatcgtgattgcggggctggcagttgcttccggggcggtccccggcgaactggccgcccttgcaaccgcgtacgtcctgctgatggcggtcgtgggtccgctggcggcccggtttgtggggcccgtaagggctgcccggccacccgcaggcgtggccgccacagcctgaggcctcggctgccctgcgtgggctcgggcagggcgccgcccagcctgctagatctccgtgcggtggaagttcaggtggctgcggcttgctgtaggaccacgctggccctggtagcggttgccgtactcgcccgagccgtagggatgttccgcagaggacgtcagccggaagaagcacagctggccgatcttcatgcccggccacagcttgatgggcagggtggccatgttggacagttccagggtcacgtggcccgagaagcccggatcgataaagccggccgtggagtgggtcaagaggcccagccggcccagggaggacttgccttccaggcgcgccgcgatgtcgtccggcagcgtgacagtctcgtacgtggaccccaggacgaactcgcccgggtgcaggatgaacgattcattcggctctacttccacgagccgcgtaagctccggctgttcctcggccgggtcgatgtgggcgtacttgtggttatcgaacaggcggaagaacttgtcgatccggacgtccacggacgacggctggaccatcgccggatcgtacggctcgagcacgatccgctgggagtctatttcggcacgaatatcgcggtcagagatcagcaccgtcccaaattaccgtatggcccctcctgagcagttatccacagcaacattttttcgttgttgctgagcgttcgtggggctactgttacagcagtgattcaggcgccggatggtctcccggatggcccaacagagctggggatgttgtgaatagattggccgcgccctcttttattggcgtgctcgtagctttagcgctgctctcctcatcgacgggcgcgcccccggtcccggctgcagggccgccagtgggcacgacagggcccagcagcgtcgccctgggtgcttcggccataaccgaccgcgccgggtccccttccggcgcgggctccggcgggtccctgctcgcccccgccgtcgaaccggacattcggccggcatcacccacggaacccctggcgacggagccagtggcgacggaaccagtgagcacggaacccctggcacccgcccccgcaaccagcccgtccgccggcaccgttgaggatgcccccgagcccgcggcaccggcacccgttccggcctccgaagagcctgcagccgacgttccttccatacctcccctctgggcaccggacgaggaacttgcctcccccccggcgtcccgccaggcggctccggaatccctggtggccgctcccgcaccggaagccctcatcccggacagcaacgcagccgccatcctcacggtgttcaaccggattaacgagtaccgggcatccaagggcctgaaccccgtgaagtacaacgcaacagtggcgggactggcacaggaatggtcggacagcatcgcatcccgcgaggtcatcgagcaccgcgccagtttctggacggaccagcgcgccctgagtcccaacaacggtgccggtgaggtcatcgccatccgcacggaccgggacgcggcgctgctggtggaatggtggaaaggctcgcccggccacaacgccatgctgctcgatccgcgcttcaacgtcatgggggccgggatcagctatacggaccgcacgtacaagatctggggcgtggtgaacttcttcggctacaccaccctccccgccggcaccaccgattcccccggcggaaccggctcgagcacacccttcccggcgccgccgcccaccatgtgcgacgccccggtacggcacatgccgcccactcttgacctctccgccgcggctatcaaggggcccggagatttggtgaccgtcgattcttccggccagctcctggcacgcgcagccaccggcgcgcgcacgtttgaggcgtccaaggcaatcggctcaggttttgccggcgccaaggaagtgttcaccaccgactgggaccgggacggcgcctacgacctcgtcacgcagtggagcagcggcaccctgaccctccaccgcggcattgccgccggcggattccagccgcccgccaccctgggaagcggagggtgggaaacccttaccctcgccgtgggcggatggtgcgccaacaacaggctcccccagcttctggccctggacgggacggggaacctctacctgtatccgaacaagggcctgggcgacctctccgcacggacattcgtcggctcaatcggcgccgcccggaagctgtccatggtggattacgacgccgacggattccaggacatcctggcgctccggggcgacggatcagtccagctgcaccgcggctggggcaccaccgcactgcgcgcggaagccagggccacggtggctaccggctggggagacgtcacgggcatcaggccgctgcgggacgttaccggactgaactccaccgggctggccttgcgacgggcatccgacgttgtgcagtactgggacctgacctccggaagcctcgcgtcgccgtcgaacattcccggcccgtgggccgggcaacggctggcgcagtagccgcgcagccgcagtaggcgcgttaagcatgtccgccccggatggcggaggcgcactgttatatggccggctggagctccaggacatccttgagccgttcgagctgggccacctcggtgcagaggctccgttgaagcatgctgttcaggaatccgatccggttgaggaacctgagcctgtgcaggacgccggccgttccttccgcccgggcctcaagggcaaacctgacgcgcgttcctgccgcctccgtactgaggtagtacccgcccgaacggtgggccggcccggaaatggcctggaactggatttctgctcccggcctggcgtgggtgatttccagctccgccgggatgctcagcccggaccgtccggccaccatcttccggtacaccgcgcccttggaggccgatgcgccctgcagcagcttgacgctgcgcaccgagtcgcgccagagcggaaggttggtcgcatcaagcaggaacagatacacggccatggcatcccgccggatgaggacctcgtgttctgcgaatgccatggggatctttctgtggttgaggtcagctgccgcagtagctgcaatccccccggccccgcagctacccggttcaggttagccagcgctccgcaggcctacctagccacggcaggcggcgttattgaagagttactggatgacgcgcctgcaaccgggacacgggcggcgtgcagggtgtgtgggcagggcaggcaaagttctgcgctaagctatgttctgcccctccacggcggggcagcgcggctgtagctcaatggtagagcgctagcttcccaagcttgatacgcgggttcgattcccgtcagccgctccactgcttgcagcgggacagaagacaagccaccccggggccattaggtaccagcgtgtatggtcagaagtcaggaacctcttcggttccgctacaggagcaattcatggctgacaagtccccgcgtcaaacagcatccaaaaaatccggcaagtccatcaaggaaaagcgggccgacaagaaggccgcttccgcccccgccagctccctggacataacctccagcaaggccgccaaaaagaagtgacggggccgcagaatagactgaccctcggcgtcctggcctcaactaagaagcccgatgagcgccggctccccatccacccgctgcatttcgagcgcatcgcacccgaaatccgcgaacacatcatcctggaaactggctacggcgagcggctgggcgtctcggacgaacacctctcgcctttggtgggcaggatggccggcagggaggcgctgctggcggaggccgacgtcgtcctcctgcccaagccgcagccggaagacctcgccgacatgcgggacggccaggtcctctggggctggccgcactgcgtccaggaccgcgctatcacccagctggccatcgacaagaagctcacgctgatcgcctttgaggccatgaaccactgggccagcgatggcggctttggactgcacgtgttccacaagaacaacgaactcgcagggtactgctccgtgctgcacgccctcgcgctgacgggatccaccggcgactacggccggaggctcagcgccacggtcatcggcttcggcgcaacggcccggggcgccgtcaccgccttgaacgcccacgggatccatgacgtccaggtgctgaccaaccggggcgtggccgccgtcggggcgccgatccactcggtgaacatcgtccagtttgaccacgacgacgaagcccccttcctgagccaggtcatcagcgagcgtggccgggtaccgctggcgccgttcctggccgagagcgacatcgtggtcaactgcaccctgcaggatcccaacagcccgctgacgtacctgcggacggaggacctggcggccttcagccccgggagcctcattgtggatgtttcgtgcgacgagggcatgggtttcagctgggcacggtccaccaccttcgccgaccccatcttcacggtgggcgaccacatcaactactacgccgtggaccacagcccgtcctacctctggaactccgccagctgggaaatcagccaggctctgctgccgttcctggaaaccgtcgtcagcggccccggggcgtgggacggcaacgagaccatcgcccgtgccatcgagatccgcgacggcgtcatccgcaacaaggacgtcctggagttccagaagcgcgaagaggcgtacccgcacctcgccctgtagcccgggctacgcggcgacccgccggacaatccgcacgggctgccgccggtccttgaggtctaccctcagcaacaacgagcccttgcgcgccaggatcaccgcgaccgtcagggccgcgagggcgggcacgccgccggacaccagcagcgccacgtgcgggtcggcgtgctcggcgatccagcccagcatgggcccgccgattgcctggccgccgatcaggaccatgatgtacaggctcatgacgcggcccctgatgcccatgttggagctgacctggaccagctggttggacccggtgaggaacatcaggcaccagaatcccgagagcaccatgaccgcgccgaacaccggcatggacggcgccagcgccgcaaggcacagcatgaccccgtacattcccgcgcagaacaccacggagcgcagccggagccggcggcgccgcgtggacgccaccgccccggccagcgcgcctagcgccaccagggcgttcaggaggccatagccggcggcccccgcgttgaacacattgtccgcgaaggccgcgagcaccacgggcaggctcatggcgaacaccgcgatgaagcctgccatcagccagggccaatagatggtgggtttgcccagcgcgtagcgcagtccctcgcgcagcatccccttggtcttgggggtgggcgcgctcacgaacaactggtccttgcgcaaaagaagcagcatggccacggtggaacagcacgccaccgcattgccggcgaaagcccaccccgcacccacggcagtcagcatccacccggccagcgcgggaccaatcaggccgcccagctggaaggtggtggagttgacgctgatggcgttgcgcaggtacgtgggcccaacgagttcattgacgaacacctgccgggccggctggtcaaggaccgtcaccaggccaagcaccagcgcaatcacgtagacgtgccacacctcaacggccccgctcagggcgagggccgcgagcgcggccgccaggaccgccgccatgccctggcatagaatcaggattttccgtttggcgaaccggtcggcgaccatcccgccccacggtcccaggagcagggacggcaggaactgcagcgccacggtgatgcccacggccgtgacggatccggacagttccagcaccatccagtcctgggcgatccgctgcatccagatggcgacgacggcgatgaagtggcctatcgcgaagatgcggaagttggggacccgcagggagataaaggtgtgcttccagggcaggcgttcagtgacgacggcgagcggctgggtctggtggtccggcggcgcggagccggcagtatcgatgacgggttgggtgacggttgccgatgacggcggtgggggtgccacaggtgtgtcctcaaatgcgtgcggtccgggatgcccttaacgctaggctgggacacgggattatggagacgtatcgtccctataactcgtattgcaaaccgcaatgcccgcgttgtccgtaccgatgccccacggagtccattgtgtttgaaccggcccagctgcgctccttccttgccgtcgccgaaacgctgagcttcaccaaggcagcggagcggctgggcctggcccagcccaccgtcagccagcatgtccgcaagctggaggcggccgccaagcgggtcctggtcagccgggatacccgtgatgtcaggctgacggacaacggggacgccatggcgggcttcgcccggaatatcctggcagcccacgactccgcctcccgctacttctccggctctgccatgcgcggacggctgcggttcggcacggccgatgacctggccatcacgggcctgccgcggatcctgcgggaattccggcagatctatccgcagatcaacctggaactgacggtgggccaaagcgaccagctgtaccggaagctcaacgcggggcagctggacctggttttcgtaaagtgggtggcgggagccaaggacggaacagtggtccagcatgattccttttcctgggtggggctcgagcagaccacactggacccggcggctcccgtgccgctcatcgcctacccgtcacccagcctgagccggaaactggccatcgacgcccttgagtcccacggcaggacctggcggatcacctgcaccacgcggcaaatcagcggagtgctggcggccgtcagggcagggatcggcgtggcggtcatgccgtcgtcgctcgtcccggaagacctcaaaatcatcacccggcggttcgacctgccggcggtgggcgacgtggacttcaccctgatccgcaacccgctggccaacgcggaggtcatcgacgcgctgacgcagtccattgtgggccggacaatcaaccggcaagcataacgccggcgctgcctctttgggcgcagccattccgccgtttccattgattgcttaaggttgcatcccctatgctgactttctagggtcaagcagctggccggttctcaagcacggggggctcctgcatgccaggatttccacccgggacaggcagccaatgacgacagccaggaacacccacgccagctcggcccatgcgcgccccatcaacactgcgcggcagccggccacccgccgctccaccctcggcgccgggattgccacaaccgataccggctacgtaggcaaacccacctgcgacacctgccgcaccgacgaattcgtctatctggagtcctacatccctcctacgtaccggcgtgacgggacggtcgcctccctgggcgaggtcgcctacacctgcacccggtgcgaggatttctccgcccacagcgtcccggtgacctggtcgccgcccggatggtacctgggctgacaggcaggcacgcgccaaacacacacagaaggccgggcggccaccgcaagaggtggccgcccggccttctgttgtgctgctagatcagcgcatccgagaggtggttcggggtgccgaagcggtgggcggtgatgctgacggcctgttcgtgcaggaagggcagcaattcaatgcggcccgcttcggtgaccgggtgggcgtagattgccaggtcgggacgtcctcccgtggccttcgccagggccgttgcagtgccgccgatcaggcggacgcggccattggacagcttgcccgctgccgcgcgcctgcccgtggaagccagccagtcggcgtcagactccaccgtcacctcgatgtccagggcaatcagcaccgggcgcagctgggcgggaagctcgaaggctgtggacaccgtcagttccgatccggccagcacgccggccgccacggtccgcaccagctgcgccagcggtgcaccctcggacagccgcaccgtcaggggaaggctgcggtagcggaagatgttgcgttccgcgctgagtccggagacgtcctcggcggtaccgaattcatcggcccaggcctgcgcgtcggaggccagtgcgcgccggaccgacgcgaggtcttcaggttccagcgcggcttcggctgcatcgaggatgcggcgcacgcccgggtgggtgatgcttgcatccgctgtgcctgtggcaggggtccagttgcccaggcctgccaggtagttgggtccgcctgccttggtgcctgcgccaacggctgacttcttccagccgccgaacggctggcgctgcacgatggcgccggtgatgccgcggttcacgtagaggtttccggcttggatggtgtccagccaggtacggagttcctcggagttcagggagtgcaggccggcggtgaggccgtactcgatctggttctggatggcgatggcctcttccagggtctctgcggtcatcacgcccaggaccggcccgaagaattcagtgaggtggaagtaggagccgcgcttgacgccgtagcgtacgcccgggctccagagccggccggtgccgtccagcttcttcggctcaacggcccagttttccccgtcgcccagggtggtgagggcgttgaggagcttgccgttggcgggctcgatgatcgggcccatctggctggtggggtcctccgggtaccccaccttcagggaggtgacggcgtcgatcagctggttgtggaagcgcctggatttggccacggagcccaccaggatcactagtgaggcggccgagcacttctggccggcgtggccgaacgcggagtacgccacgtccttggctgccaggtccaggtccgcgctgggggtgacgatgatggcgttcttgccgctggtctcggccagcagcggcaggtcctggcggaaggaccggaacagctcggcggtctcgtagccgccggtgaggatcacccggtcgacggccgggtggctgatgagctgcttgcccagctccctttcgccgagctgcaccatggtgaggacatcgcgcggaacgccggcctcccacagtgcttcgaccatcacggcgccgctgcgggcggcctgcctggcaggcttgatcacgacggcggagccggcggcgagtgccgcgagcgtggaccctgccgggatggcgaccgggaagttccacggcggcgtgactacggtgagcttcgctgggacgaacgtggcgccgtcgaccttgtccagcttccgcgcggactcggcgtagtagtgggcaaagtccaccgcttcgctgacctcgggatcgccctggtcgatggtcttgccggtttcgctggccatgacctcgagcaggtcagcgcgtcgggcttccaggacgtcgcccgcgcggtgcaggatctcggcacgctcggcgcccgagagttcaccccaggccttgcccttttcgacggccgtggtgacggcgtcgttcagctttgcttcgtcgttgatgaaggcggcttccacggcggcgttgccgagcgtggaggacgggacgcgctccaggatggcgcggccccagtcgcggttggccggcaaggacgggtcagtatccggggtgtccttgaaagaatcatgcggcaggggctgcggcttgaggttccggttctgctgccggttggccggcgggacactgttgtccagcgcctcgagggaggagaggaaacgctgcttttcccgctcgaagaggacttcgttttcgctcagctcgaaaaccgctgacatgaagttgtcctggctggcgccctcttcgaggcggcggatcaggtaggcgatggcgacgtcgaactcggccgggtgcaccaccggggtgtagagcaggagcgagccgacgtccttcttgacggcctcggcctggccctgcgccatgccaagcagcatttcgaattcgatgttctgccgtgcggtatccgcgatgccgcgctttttggcaaggagccaggcgaaggcgatgtcgaacaggttgtggccggccacgccgatccggatgttcttgatccgctccgggtgcagggagtagttgatgacgctcttgtagctggtgtccgagtcctgcttggttccccaggtggcaagcggccagtcgtggagcgaggactccacctgctccatgggcaggttggcgcccttcaccacgcggaccttgatggcggcgccgccgttggcgcggcgctcagcggcccagtcctgcaggcggatcatggcggagagtgcgtccggaaggtaagcctggagcacgatgccggcctcgaggttcttgaactggggcttgtccaggatcctggtgaagaccgcgatggtcatgtccaggtccttgtactcctccatgtccaggttgatgaacttggccttgggaaatgaggctgcgcgctcgaacagcggggtgagcttctcgacgacgtgctcaacggcttcgtcgaaggcccacggcgagtgcggggccaccgtggaggagaccttgatggagacgtagtcgacgtcgggacgcgccagcagcgtgtgcgttccttcgagccggcgcgaggcctcgtgctcgcccaggacagcttcgccgaggaggttgacgttgagcttgatcccgtccttgcggatctttgcgatggcgagtcccagcttggcgtcggtggcgtcaacgatcaggtggcccaccatctcgcgcaggatcttgcgggcgacggggataacaacctgcggcaggaccggggccatggtgccgccgagtgcgacggcgctccgcatgtaccagggcaggaaggcagggactttgggggcgagcgcggcgaggttgcgtgcggcgacgttcaggtcctcggggcggaccacgccgtccacgaagccaacagtgaattccaggccgttggggtccttcaggacgccggcgagctgctgggcggaagcgtccacgggaaccttggacgcctcggtcagccaatggcggaccagtgccaccgcttcgttggccaatgccttggcctggggcacgtcaacgtcgacagtccggggcgcagttccggtggcgactgccggttccattgcaatgtgggtcatggcttttctcgttctttcctgggtttcaaggaggtcttatccaccagtatgagcttccactcacataagataaagcgatcttttctaagcaatacaggttagaaaagatgaagaattaagcgcccccacttccccccttcccccacccgacgcgcaccctcggcactctcccggcgccctctcacttgacgccgcaaccccccggacgctcgttacctttttcgtagcccgtttcctgttgcaggatgtgggtgtgctggcctgctggtccctgggcatgattgcgacgctctgttgatgatgatcctgagagtgttgtcacctggggctggtaggtgccggggagaccgctgataggggcaggacagtttgggaacgtcgtgcgtaacgtgggtgccgggccctgacaccgtggtgggccagtacgtgagttagggactacgactggaggtgccaggtgatcagaaaccacgacgacgttgaagtgttcatcggattggatgttggcaagggcgagcatcacgccgttgccctggaccggtccgggaaaagactgctggaccgggccctgcccaacgacgagacccggatccgggagatcctggccgagctggaacaccacggccggatcctcgtggtggttgatcagcccgcgacgatcggtgcgctcccggttgccgtggcccaggccgcggggaccctggtcgggtaccttccgggtttggcgatgcgccggatcgcggacctgcatccgggggaagcaaaaacggacgcacgcgatgcgttcatcatcgccgacgctgcccggacgatgccgcataccctgcgctcggtccagctggccgatgagcagatcgccgagctgaccatgctctgcggtttcgatgatgatctggccaaacaggccaccgcgacctcgaaccggatccggggactgctgacccagatccacccggccctcgaacgtgtcctgggaccccggctggagcaccccgcggtgttggatctgttgcggacctggcccacgcccgcagcgctccgccacgccggccggcgccggatcgggaaccggctgaccaagctcgcgccccggatgggtgaacgcctcgccgatgacatcatcgaggccctggcccaacagaacgtgaccgtgatcggcacgaacgccgcgaccatcgtcctgcctgaactgacgggcatgctcgccaggatccacgacggccgtgccaccgtttacgcccaggtcgaagccctcgtggaggcccaccctcttcaccaggtcctgatgtctttgccggcggtcggcatcaggaccgcagcacggatcctcaccgaagtcgccggcaaggacttcccgaccgccgggcacctggcctcctacgccggcctgaccccggtgacctggcgctccgggtcctcgatccgggccgaccgcgcctcccgaaaaggcaataaagtcctcaaacgcaccctctacctctccgcgttcgcagccctcaaagacccgctctcctgcgcctactacgaccgcaaacgagccgaaggcaaacaccacaaccaagccctcatcgccctcgcccgacgccgctgcgacaccctctacgccatgctccgcgacggcaccctctaccaggcaaaatcaccaaaagcagcttgacgaagaacatagggacactctcacttaatgcgggaaaagcggaaacgctctatcaccctccacaggaaggtgatagagcgtccgtattaaagcgacattaagtgagagagcgtcccgttgtagacggccgtaagcgggagagggtccccggggcggtcagctgacggggcggtgcatctccacgatctcgtcatgccgggggctgttgggattcatcagcgagtgcttctttccgtagaagaagtagatggccaggccaacaaggagccagacgccgaaccgagcccaggtttcccagtgcagctggaacatcaggaacgcggaggccagcacgccgaaggccgggatgaacggcatgaacggcaggcggaaggtccggggcgcgtccggcttcttgtagcggaacacgatcaccgagaagcagaccacgacgaacgcggcaaggatgccgatgttggtcaggtcggcaacagccttgatggggaagaccccggccagcagggcggaggcgacgccggcaatccaggtgacgcgctgcggggtgccgtggcggtccgtcttggagaaccacccggggagcaggccatcgcggctcatggagaaccagacgcgggtgacgcccaggaggaaggtcagcatcacggtaaggatggacaggacggcaaataccgagatgatggtggcgatcaccggcaaaccgacacccgtgaaggccgaggcaaagccggccgtggggtcaatgtccttgtagttctgcatgccggtcagcaccagcgtggctgccacgtagagcagcattgcaatgatcagcgacaggatgatggccttgggcatgtgcttcttgccgtccttggcctcttccgccgcggtgctcatggcgtcgtagccgaagacggcgaagaagaccgtggctgcgccggccaggaccgggccgaagccgctgggcataaacgggttgtagttgttggtgtcaatgtagaagacgcccagcccgatgatgaagaggatcaggatgaccttgatggcaacggccacgagttcaaaccggccgaaggccttggtgccgcgggacaggatccaagtcacgatcaggcagaccacgatggccggaatgttgacgacgccgccccggccctcgtcagcggtggaggtcatccagatgggcatgttgacgccgatgcccgagaggaaggcgtcgaagtagccggaaatgccgatggcgaccaccgccacgatggcgatgtactccaggaggaggtcccagccgatgaaccagccgataatctcgccgagcgccacgtatccgtaggtgtaggcggacccggcccggggaatcatccccgcgaattccgcataggacagagcagcggcggcggacgctaggcctgccaccaggaaggagatcagcaccgcgggccccaccccgggcgtgctctcgctgccggcggccaccagtcccgcaagtgaaaagatgccgacgccgatgatgccgcctacgccgatcgccgtaagctgccaaagcccgagtgacttaaagaggccactgtgtttgttctcttcttcaatgtcgtcaatgggcttgcgccgcatgatcgactgggtcatatctctagtgctcatcaggaactcctgcttggggtgcgaccccgacacggcgcgcgaagaatcgcttgtgacgggggtaactcggtcccaacagtatgcaagcgggcttgcgttagataaagtgactacttctaacctatattcgttagtttaggtaaggatttccctatgcttgacgtccgcaggcttcgcctgctccgcgaactcagcatccgggggacgcttgccgaggtggccgaggcactgcagtacagcccgtcgtcggtctcccagcagcttgccctgctggaaaaggaagtgggcgtcgagctgctccgcaagacggggcgccgggtgcagctgacaccccaggccgaagtcctcgtagcgcacaccgcaaacctgctggaaaccatggagcaggccgaggcggacctggccgcatccttgacaacggttaccggcaccgtccggatcgccgttttccagtcggcagcccttgccctcatgccggaaacgctcacgcgcatgtcccgctcctaccccgaggtccggatcgagatgatccagcgcgagcccgagaccgccctccacgaaacctgggcccgcgatttcgacctcgtcattgccgagcagtatccgggtcacgccgccccccgctatcccgagctggacagggtcaagctgaccaccgatgccatccggctcgccgttccgccggtgtccgacggcggccccgccatctcctcgatcgaggacaccgcagaactcgcctgggtgatggagccgcggggtgcggcgtcgaggcactgggccgagcaggcctgccggagcgcgggcttcgagcccgacgtgcgctatgaaaccgctgacctgcaggcacagatccggctgatcgagtcgggcaacgctgtggcgctgatgccggacctggtgtggaccggccggggcaccacggcccggctcctggacctgccggggaaaccgcggcgcaccgtcttcacctccgtccgccgctccagcgccaggcggccggccatccttgctgcccgggaaaccctggcggccacggcagaagcagtggcggggaacgtcgccgggtgaccagccgccgtcggacgtgtcctttcaaccagaggctccgacccgtcccgcgccatgacgcgggacgtcactgcgccggtaccgctcctgcgtaactgtttcctgcgtcactgcacggcagggcccccgccgctagactgaagccgttatgaatcgaacaatgttcaagtccaaaatccaccgggccaccgtcacgcacgctgacctgcactacgtaggttcggtcactgttgacctggacctgctcgaggccgccgacatcctgccgggtgagctggtgtccatcgtggacgtgaccaacggctcgcgcctggagacctacaccatcgccggcgagcgcggctccggcgtgatcggcatcaacggggccgcggcccacctgatgcaggaaaacgacattgtcatcctgattacctacgcgcagatgaccaccgaggaagcgaagagctacgagcccagggtggtccacgtggatgaaaacaaccgtgtgatccaactgggcaacgaccccgccgagggccttaccccgggcttgctgcgcccccctttcgcgcttaacaacgccgcgctgtaaccggagcgtgcgccccggtcccctgccctgccgcgccctgcgggccgtcccatgctaggcgtgctggcgggcttctttgtggtgtggtgcatcatccttgtgggctggttcgtgggccggcagagaatcctgggtgacaacgcccggcaggtgctgagctccctcacgtttttcgtggccagcccggccctgctctttgaaaccctcagcaaagcgcgcctcgctgaggtcttcgcggctcccctgctggtggccgcggtgtccgccgtcgccaccgccgccatttttttcgtcattgccaagttttggctcaagcgttcgcttccggaatcgctgatgtcctccatggcggcgtcgctggtcaactctgccaacctgggcattcccattgccgtctacgtcctgggcgatgccagttacgtggcgcccctgctgatcttccagctcgccttcttcacgccgctgttcctgatgctcctggattcgagcaccagcaaccaccgcaccacgccgctgaccttcctggtgatgatcgtgcggaaccccatgatcgtcggctcagcgctgggcctgctcgtggcgggcaccggatggaaggtgcctgacctggtcatggaaccgatccatctgatcggcggcgcggcgattcccgccatgctgattgcgttcggcatgagcctgaacggcacccgcccgctgcaggcctccgaggcccgccgtgtggacacgctccttgccagcgcgttcaagctcggcgtccagccagcgctggcctatctctttgcccgcttcctgctggggctggacggccatgtcctgttcgccgtcgtggtgaccgctgcgctgccaaccgcgcagaatgtgtttgtggccgccagccgctacaagaccggcctcaccgtggccaaggacaccgttctgattaccaccgtggtggcagtgccggccatgatcggcgtggcgctgctgctgacctgaccctggagggctgatggaaactgttgtggacaccgtggtgatcggcggcggggcgatgggctccgcggccgcgtgggctttgtcgcgccgcggccggcaggtgacgctggtggagcagttcgggcccgggcaccggatcggggcctcgcacggcaccacccgcaacctcaacccgggctaccaccggcccgagtacgtggccatgctggccgaggggctggccctgtgggacgagctggagcaggaaagcggcgagcagctgctggcgcgcacgggggtggtcaaccacgggccggaaccgctgttcgccgatgttgcggccgccctggagcaggccgggatccgcgccgaattccttcatcccgaagaggcggccgagcgctggcgcggcatccgtttcgaccagcaggtgcttcacctgcccgacggcggccagctcaaccctgacgccgccctccccgccatgcagcggctggccatggcccgcggcgccgagatgcggcaccacaccaaagtggtggacttccaggtaatggatgacggcgtccggctggttctggagtccgctgccggaacggaggtgctcaccgcggcgcaggtggttgtgacggccggcggctggacggaaaaactcctgggccgggcgttcaccaacggctccgggctgaggattccgcagctgcgcgtcacccaggagcagccggcacacttccgggtggcggacgcgggggctttatggcccggtttcaaccactacccgggcaccggagcggagtacaggaactggtactccccggtgtatgggatgcagaccccgggtgagggaatcaaggccggctggcatggcgtgggccctgtggttgatccggaccggcgctccttcctgccggagcctgtgcagctcgcagccctgcaggagtacgcccggacctggctgcccggcgtggatgcggactccttccaggcggtcagctgcacctacaccaccaccccggatgaggacttcatcctggaccggatcggcccggtggtgatcggcgccggattctccggccacggcttcaagttcacgccggtcatcgggcggatcctcgctgacctggctacgggcacccgggccgctccggagatcttccgcgccggccgctgatcgaccggccgctgatcgaccggccgctgatcgccggctgccgggcgcattatcgcgagctgtcctccgcatcggtaaggaccggttccccgtcgtcctctccgtcgccactcgcggcgtccgcgttggccgcccgcacggcaggcattaccaggactgctgccaccgtcaggaccccggctgcaagggcggccacgaagaccgcaccggaagcggccaccaccgccgggccgttgctttccccgccgggcgtcccggagtagatggcgttggccacggcgccgaagacggccacgccaagtgcgctcccgatggaccgggcgaacatgttggtgctggtgaccacgccccgctcattccaggaaacgctggactgggcagcgatcagggtgggggtggcaaccagacccaaaccgagtccgacgacgaagcagctggcggcgaccagcgccacactgggcgtagcagcggtgagtgcaaggaccgcgaggccaatcacggtgatggtgatgccgatgagcgctgtggccttgaacccgatccgcaggtagaagcgtccggcctgcgaggcgctgatcggccagcccagggtgagtgccgccaaggccagcccggcgaccagtggcgagctggccagcgcgccttccaggaatgtgggcacgtaggacgtcagccctatcatgacggcaccgacgccgaaggacacgagggctgtggttcccaggagacggcgtgataccacccaggacggcagcactggttccgccgcgcgccgttccaccacaaggaacagcgccagcagcaccccgcccacggtaaagatgccaagactggccggtgaatcccaggcccagccctggccgccctcgagggcgccaaggatcagcaggccaagcgaagccgccaatagggccgcgccggcgtagtccacgcggtgcttggccctttccacgttctcgtgcagggtccggacaagcatccatcccgccagcaggcacagcgggatgttgaccaggaagattccccgccagaagcccaaggccgcaaaaatgccgcccaggctcggccccaccacggaggaaaccgcccacacgctggcgaggtagccctggaccttggcgcgttcctccagtgagtagatatcccctgcgatggtgatggagacaggcagcactgcgccggcaccgagtccctgcagggcacggaaggcgatcagggcgggcatgctccaggcgatgccgcagagcacggacccgaggaggaacaggccgatacccgcaaggatgatcggtttccggcccaccatgtccgagagtttgccgtagatgggcacggagactgcctgcgccagcaggtacgccgaaaagagccaggggaacgactcgaacccgccgacgtcccggacaatcgacgggacggccgtggccacaatggtggaatcgatggccaccagcccggtggcgagcatcagggcaataaggatggggccccgttcagaacggaagcccactccctgggcgcgggcggttggcatgggtctcgtttcggtttccgggtggtgtcacctccactctaggtacccaggaagaaggccgactaccgtttcccctggtgttcgtccaggatccgtgcgcaccggatgaagccaaggtgggagtaggcctgggggtggttccccaggtgggtttcggtgccggggtcgtactcctccggcagcagcccggtaggcccgaagaggttcaccagctggtcgaagaggtcccaggcctcctcgatccgaccagtggcaacgtacgcctcgatcagccaggtggtgcagatgtggaagccgccctccagccccggcaggccgtcgtcgtacttgtacctgaacacggtgggccccacccggagttcccgctccacggcggtgacggtatccaggaagcgctcgtcggtgacgtccagcagcccggagagcccgatatgcaggacggcggcgtccaggtccgggctgtcataggccaccgtgtaggacttcgcggactcgtcccagccctcccgcaggacttcgtccctgatggtggcggccaccggcgcccaggctgccccgggcacccggccgtggcgggacgccgtgcggagtgcgcggtcaagggtcacccagcacatcactttcgtgtagatgtggtgccgcggtgcccggcgggcctcccagattccatggtcgggttcgtgccagcgggccaggacggctgacgccatctggaccatcagttcccagtgttcgttggcgagcgccccctcccgttcactcagggcaaggatcagctcggcgatggggccaaagacgtccagctggacctggtggtcagcagcgtttccgatcctcacgggacgggacccggcatacccgggcaggctgtcgatgacggcttccgtggaaaggggtgcacccgtcacggaatacagggggtgcagccattcggggccgggggcgtgctccaaaatccgtcccagccatgacaggaagcccgcggcctcccgggtggagcccaggtccaccagcgcgttgacggtcatggaaccatcccgcagccagcagtaccggtaatcccagttcctcgtcccgccgatcccttcgggcagggaggtggtgggggccgccaggaccgcgccggtgggctcatgcaccagggcgcgcagcaccagggcagaccgccggaccagggagggcttaacgcccggcaggacgagcccctgcacccactgccgggcatgcagcgccaccgcggaacgccggtccgtctcactctcgggtaccgcgggctggtgctccgtgtctccgcagcgcaggttcagcaccaccggaccgtcctgcaggttgacggcggcggtggccgtggcatggcgcccgtccgaggtaatgctgaaggtcacgcccggcgccagcaggataaacggctccgacgtgcccaccacgtgcagttcatcgccgcgggcctccatgctgaacggggcgttggcgtagtccggccggggggcaaaggtgatcctggcggcgccattgccggagagcacccggacaaggctggtgatgccgtccggggccggctccaggtagtccgtcaccgttacgtccgcccagcgggtttcaacgatcatggtgctgtccacgtagcgctgccccagcacctgggaggccttgaccggctccaccgaaaaatggcctgcggcgtcacctcccaggatgtgggcgaacagcgatccggagtcaggcagggggtggctcatccagcagatcttcgcgtccggcgtcaccagtgccgtggaggatccgttgccgatcaggctgtgccgttccagccccacggcgtcctcgccgaacagccaggcacgccgcagttcgaacaggattgccagcacccgggcgaaggattccgggtcgcggagccggtaggaggcagaggtctcccccgggcctacccgcagtcccatgtccggcccgcgcagggtggacatggccagttcatcgctgtcagcgtcgcccgcatacatggccgcgctggctcccagccgggaccgcaggctttccagagcctccgccttggacggctccatcacggacaggtccagcacggagccgtcaacaatgaagtgcagtccgtgggcgcgggccacctcccgtgcggtgtccgtcaccgccgccacaacgtccggggcggcaggccgggtgtgcactgaaacggccacgggtttgcgctctatccagatgcccttctggaaccccacggcctcgttgagcgcggcatggactttttgcagaacggactcggtggcgagggtctgctggtgcgcaaaccccatgtcgaactcggcgccgtgcgagcccaccaggtgcacctcggccggcaggcgcgatactgcggcgaggtcacgcagcgaccgcccggaaatgacagcggcgtgggtgttgggaagcgccgccagggcacgcagcgcgatggcggcacttcccagcgggagtgtctcggtggagatgccttcggcgtcgcacagggttcccccgtaattgcaggccaccagcagcccgggcacccgggccagcaccttcagttccgccagcagcgcaggcgtgagcccttcgtcggcggcgtcggactggacgaaggtgcggagcatgcccagcggaagggacctggtgagcaatgcggaatccgcgacgctttggttcaacggcgttggcatccatagacccctttgaggcaggaccgggccgggactacagccgctggatctcctgcaggctaccggttggtgcccctccccggggttcccggaactccggagggggcactcccatcgtcagcctccgcggttacccccgaaagtcccctgtattgcgtatgtgtaaaagtctgtggtcccctgcggcccccacgcacggcgggctttgactgcccgctcagacccgcgcgagcccggcggcttcggccaggagctccacggaccgcagccgggcgtccgtgccggtgctctggtgcgccacgatgagttcgtcggcgtcggcgtgccggccgaagctgtccaggtagtccatgacgacgtcgggcgttcccaccgcggagtaggtcatcatctgcgagacgtgctggccctgcggcgaatcgaggatcatgtccgcctcgtcgtccgtgaactcgcggccgccgccgaagaacagcgacacccgggcacgcttggtggcctgcatcatggcctgcgcttcggaggccgaatcggcggcaatgacgttcacacccgcgatgacgtgcggagcatccagctgcgctgagggcttgaactccctgcggtagagggccaccgcgtcctgcagggcgttgggcgcgaagtgcgaggcgaacgcgtacggcaggccaagctgggcggccaggcgggcaccgaacagggaagagcccaggatgtacagcgggacgttggtgcccttgcccggagtggcttccacgccctggatccgggtggggccggtgaggtagccctggagttccagcacgtcctgcgggaagctgtccgcggacatcgggtcccgccgcagcgcgcgcatggtgttctggtcgctgccgggtgcacggcccaggccaaggtcgatgcggccgggatgaagggtctccagggtgccgaactgctcggcgatggtcagcggtgagtggttgggcagcatcacgccgccggcgccgagccggatgctttctgtatgggcggcgacgtgggctatgaggacgctggtggcggaggaggcgatggaggacatgttgtggtgctcggcgtaccagacgcggcggtaccccaacttttccgcgctctgcgccatggccacgctgcccgcgaagctctccgccgccgtctggcccttgccgatggttgccaggtcaaggatggagagggggagagtcacgtcgggtgccggcctttcaaagctgttcagtgggttggtgcccgccggatcgcggcaggcacttgatgcataacgacggcgggggccggcttatttcaggccgcccaggaatactcagcaaacttatgatgttgccgcccctatgagcctgaatacgtcgaaccagctggaactgtccgcaacgattgacctgaaggacctgggaaccgtgcaccggcttggctttggtgccatgcgcattgtgggtgacggcgtgtggggtgagcccgctgaccgcagcgccgcgatccaggtggtgcgccgcgccgtcgaactcggggtggacttcatcgacaccgctgactcctacggccccaacatcagcgaggagatcctggctgaggcgctgcacccctacaaggaggggctgaagatcgccacgaaggtgggcttcacccgcaccggccccaaccagtggattcccgtgggccggccggagtacctgcgccagcaggcggaactgagcctgcggaagctcaaggtggacaccctggacctgctgcagctccaccggattgaccccaaagtggacgctgaggagcagttcggtgtgctccgcgagctccaggacgagggcaaggtccgggcgctgggcctctcgcaggtcagcgtggaggagctcgaagccgccgggaagcacttcaccgtgtccacggtccagaaccggtataacctcacggaccgaagctccgaggatgtcctgcgctactcggaggaaaacggcatcggcttcatcccgtgggcgccaatctccgcgggcgagcttgcccagccgggcgggccgctggatgaggccgccaagcgcttgggcgccaccacctcccaagtggcactggcgtggctgctgcgccgctcccccgtgatgatgccgatccccggcaccgggtcagtgaagcatttggaagaaaaccttgcctcggccggtgtcaccttggacgaggacacctacgctgaacttgaagccgcggccggataaccggcccctcaagaagcagccaggaagacagataacaacgacaggagcaacaccatggcaaacattctgatggttgtatccgcagccgattccctcaccatgaaggacggcagcgaacaccccaccggcttctgggccgaggagctggtggtggcgcaccagaccctgctcggcgccggccacacggtccacatcgccaccccgggcggggcgaaacccacggtggaccaggtcagcctggcggcggaatccgcgggcggcgaggaccgtgcgaacggtttccgggactatctggcgtccatcgacggggagctctcgaacccgctggtgcttgccgacgtcgacccttccgcctatgacgccgtcgtaatgcctggcgggcacggccccatggccgacctgtacaaggacgcccacctgggccggctgctggctgcggcggacaaggacggcaaggtcattgcccccttctgccacggtcccgccgggctgctcagcgcaacggacgacgacggcaggttcgttttcgccggacgccgcctcacagtcttcaccaacgaggaagagctgggcggcggcacgggtgagaacaccccgtggctggtggaggacgcgctgaaggagaagggcgctgtaattgagaacggggctgcctggacctccaacgtggtccgggacggcaacctcatcaccggccagaacccgcagtctagcgaggacgtcgccaaggaagtcatcaaggcactgggctgatccaggccacacgctgctgacacacggaggggccaggtcattgtgacctggcccctccgctgggacgcacttacttaggcgccgcagactgcagctcagacggcgcagccgccgagcgcgatggttccgtcgatggcgttgatttgtgcctgaactgcaccaagctgggcctggaggccaatgaccaccgccttttgtgtggcgactgtgtccttgttggccttcttttgggcctccagcgtccgcaacgtttcctgggccgcggtcaattgtccatcgagtgttgtcagttgggactgcaggtccttgagggctgcttcggtagtgctgatttcagcattcagctggttgagctgctccaggagcggcgccaccctggcctggagggtaacgatttcagcctccttggacttgatgtcctcgttcagcccgcccagccgtgtgaccaaatcatccatgatcaggttgagggcgccgatctggctggtcttgcccgcaaccgcctcgttggcggcgtcgacgttagcctgcagggcgggaagctgctcctggagcgtggagaggtcggctttctttttctccaccgcggcggcggccaatacctccgcttcctgggcgctctccagggttgaccgtttctgctccaggtcgtcctcttggtccgcaatggcccgctgcgcatcgtcgacgccctgtgtaagcccaggcaacgccgcttccaggttttttacaacgtcctcctgtgcagcgacgtccgccgcagccacggaagcatcctcctgagctgcttccagttcctgctggagcccatccagcacaacctgctggtcggccaccgcgttgttggccttggtgacggcaccctcgagtgccggcagttcggactccagtgccgtaatctcggcttccttcaggctgactgctgcattcgctgccgtgagcgttgcctgcaggggtgccgcctgctgctggagtgcgctgctttcctgttgcttcgctagcagttgcgtgttcaaagcagcaacctgcgtgttcagggttgcaaggtcgccttggaggccagagatcagtgcattcttgtcggtgatctgcctgttgacggtggctagctgcgtctgtttggcgttgcgctggcttatgaggccgtttgcgctgccattcgctttttcaattttcgctgtcaggtccgcaatatctgcttcaagtgtgctcctggtgagctggagctgacccagctcattctgtgccgtggtcaactcgctctgccgggcaaggacttcagcgtttgcggcatcgatctgctttatgagcgtcgtgatgtccgcggcgacgccagtcaggctgtgggcgttgacctctattgcctctgcagccgcagccgcggcggcctggaggttttcaagctcttcttccgcagatgtgatctggacgttctttgcggtaagggcagcggcagccgcgcgcgcttccgcctggagcacctcaagccggtcctgggctgccgccacctcagttgccttggccggtacagcggtgtctgcctccgcagccacatcctcaagttcggtcagggcgagccttgcagcatccacgaggtcctgctgcgcctgcaaagcctccccggccgtcactcctgccgcttcgagacggtcgagctcaacctccgccgcctcaactgcttcccgggcgctgaccacgtcggccaccgcttccgcggctgcagtttcgaggacggtgagctggtcttgggcatctgcaatctcggcctctttgtccgcgagcgcttcggtggcctcggccgccgccagctccagcgcgaggagctcggcattcgctgcgtcaatgctgtcctgggtgccagcgatgtcttgtgcgacggcggcggcctcgaccctgaggtcctcggctgccgcctccgcggcagctttttcttcctgcagcggtgtgagttcggctaccagtgctgccacgtcgtcgtgcagcttggcgaggcttgctttcgtcgcatctatggtcgcctgcgtagcatccttatcaccggtgagctttacgatgccagactcggctaccgccagggcatcttccagctcaactacctcctccgccaacctggcagactctgcgtccaaggcggcgatctccgcattcagcctgtccttttcctcctggagcggtgcccgctcagcctggagtcttgcgatgacgtcagcattcttcttcgcggctgccttcagaaggttctcctggacgccgccccggtgcgcctgctggttcaccaccccgttgcagatcccggcattggcgctggtacctgcggcagccggctggatcagcaccaggctgctggtgagcagacccggcagtacgacggcggccgcgagccggcgtgagaggacagacttggacggggaagtgcgcatgcgagctcctgttgagaccatcgggcggcccactctggccgctgcctggactaacggtaggtgtcggcagggcggagcacacgcgtaatcccccacccgtctttccgcttaagtactcgttttcccacgccggccgacatcgtcactacttggtgtacccggccggttggactccgaaggtgacagctccggccgcccagtggcaaacggatcatcgggactccggcaccgaccaggaggccatcctggtgcgggacgtggagaacaggaagaacgggctgcagccggtcgagttccagtattacgacgacgattccgcctccacgctggccctgcagtccggacgtgcggacctgacgttcgggcccaacgccgccgctgcctgcaacgacgaaggaatccccgccccgctcccgcagcgcggggattcttttgcgtaaagtgcactcctccagctttggcaatagtgtggccggatggggacaaataccgtgaagtccggcgaacaggttgacaggcagtcgcgcattctcgaagcggctcttgacctgttgtcgcgccacggcatctcgggcgtcagcatgcgtgccgtggcccgggaagccggcgtcgcgctgggcctcgtcaactactactacgacgacaagatgagcctgatccgggcggcactgcacagcgtggacgagcacgacctgaggctggtggcaccggacccgtcgttggccccggatgagcagctccgcacagccctgcaccgggttgccggcgcagaactgctcaccacccggtacctgtccctccgactgcacctctgggccctagcgcaggcccacgaggattttgcccggatcaacgccgcagccttcgaccggtacctggacgggcttgcggcgctggtgtccgttgcccaccccgcgctgccgctgaaggaatgcagggatcgagcggcggacattgtcgtggtccaaaacggcatgtggctgacagcccttcttggaattgacaaggcagctatccaacggagcatcgcccgtaccgagcagatagccttcgccccgccgcgggacaactaacttccggttgggcttccggcgcaaggcaccacacgtcggccctaccgcgcgcacctcagcgcttcacattgaacacttgttcaagaaatctattgaacgcctgttcaacctcggctactctccttcgtatgacatacgccacaccacgccacggcgtcgctcccagccctagggctcccattcctctcgccggtccccgataaagcgcccggacagcgcaacggtcaaccgtgccgcctgttcctgcgtaccgaagctcttttgccctaggccgctgtgcggcagcacaacctgcagcacaccgcctcagcggtccccggcccgccccggggccgccagtcctacaccccaggagacagcatgaccgaaaaagcctccacccttttcatcaacggttcatgggagccggccgcatccggcgccgtgcgccacatccgcaaccccgcggacggcgagctggcggccaccgtgtccgaggccggccgggaggatgcagggcgggccattgcggcagcccgcgcggccttcgactccggcatctggtcctcggtaccggctcccgagcgcggcacgttcctgctcaaggtcgctgctgggctgcgcgaacgccgcgaaaagttcgcccgcgccgagtcgctggacaccggaaagcggatggtggaaagccgcatcgacatggacgacattgccgcctgctttgagtatttcggcaggctcgccgggcagcaggcgggccgcgtggtggacgccggggaccctgccgtcgccagcaggatcgtctacgaacccgtgggcgtctgcggcctgatcaccccgtggaactaccccctgctccaggcggcgtggaagatcgcgccagcactggccgccggatgtaccttcgtcctcaaaccatccgagctgacgccgtccacggccatcctggcgatgcaactgctgaaggacgtcggcctgcccgacggcgtcgccaacctcgtgaccggacccggcgcggaggcgggcgcaccgctctcggaacaccccgacgtcgacctcgtctccttcaccggcgggctggaaaccggcaagcgcattgccgccgccgcagctggcaccgtcaaaaaggtggcactggagctgggcggcaagaaccccaacgtggtgttcgccgacgctgacttcgatgccgccgtcgacaatgccctcaacggtgccttcgttcactccgggcaggtctgctccgccggggcgcggctggtggtggaggaatcgatcgccgaacgcttcgtggacgagctggtccgccgtgcgcagggcatccgcctgggcggccccttcgatgacgacgccgaaaccgggccgctgatttccgcggcccaccgcgacaaggtccacgcctacgtccagcgcggcatccaggagggtgcgcggctgcggaccggcggtgcggcaccgcagggagaaaagtacgacggcggctactactaccagccgacgatccttgaccaggtgcaacgaggcatgtccgtggtggtggacgaggccttcggcccggtggtgacggtggagaccttccgcaccgaggacgaagccgtggccacagccaacgacaccgtctacgggctggccggcgcggtctggacccaggacgccggaaaggcgcagcgcgtggccggccgactgcggcacggcacagtctggatcaacgactaccacccgtacctcccccaggctgaatggggcggtttcggccagtccggcgtcggccgcgagctcgggcccaccggcctggcggagtaccaggaagccaagcacatctaccagaacaccagcccgcaggtaaccggctggttcgctgaccacggcaaggagaactagatgcacttcgacaacgtcgaggacctcaccgagcgcgcgttcgactacatcgtgatcggcggcggatccgccggggccgcagtggccgcacgcctgagcgaggatccggacgtgacggtggccctggtggaagccggcccggacgaccggaaccttcccgagatcctgcagctggaccgctggatggaactgctcgaatccgggtatgactgggactacccggtggaaccgcaggaaaacggcaactcctttatgcggcacgcccgtgcaagggtgatgggcggctgctccagccacaactcctgcatcgcgttctgggctccccgcgaggacctggacgagtgggagtccaagtacggggccaccggctggaacgccgacgccgcctggcggctctaccagcggctggaaaccaacgaggacgccggtccggacgcgccgcaccacggcgactcaggccccgtgcacctgatgaacgtgcccccggcggatcctgccggcgtcgcgcttttggacgcctgcgagcaggccggaatcccgcgcgcgaagttcaacaccggcaccaccgtgatcaacggcgccaacttcttccagatcaaccgccgcgcggacggcacccggtcctccagttccgtttcctatatccacccgatcatcgatcgcgcgaacttcaccctgctcaccggcctccgcgcccgccagctggtgttcgacgcggacaagcgctgcaccggcgtggacgtggtggactcagccttcggccggacccaccggctctccgcacaccgcgaggtcatcctgtccaccggcgccatcgactcccccaagctgctgatgctctccggcatcggcccggcagcgcacctcgccgcgcatggcatcgaggtgctggtggactcccccggcgtgggcgaacacctgcaggaccacccggaaggagtggtccagttcgaggccaaacaacccatggtgcaaacctccacgcagtggtgggagatcggcatcttcacccccaccgaggacggcctggaccgcccggacctgatgatgcactatggctcagtcccgttcgacatgaacacgctgcggcacggttaccccaccacggagaacggcttcagcctcacgccgaacgtcacgcacgcccggtcccgcggcaccgtccggctccgcagccgcgacttccgcgacaagccgatggtggacccccgctacttcaccgatccggacggccacgacatgcgggtgatggtggccggcatccgcaaggcccgtgagatcgccgcccagccggccatggcggaatggaccggccgggagctttcccccggcgtcgaggcgcagacggacaaggaactgcgggactacatccgcaagacccacaacaccgtgtaccaccccgtaggcactgtacggatgggaccggccggcgacgacatgtcgccgctggatcccgagctgcgggtcaagggcgtcaccggcctgcgcgtcgccgatgcatccgtcatgccggaacacgtcacggtcaaccccaacatcaccgtgatgatgatcggcgagcgctgcgcggacttgatccgtgccggcctcacccgcgccggcggcaacggcgaaaccgcgacggcggaactggagctcacagcctccctcgcctgagttttcaggccaccggccttccgtgcgccgcagtgcggacggtcattactatcgtgcttttttgattgaggagtccacatggcggaacccagcaagagtattgattcaagcggcatggacgagtttggctacgcgcagaccctggaccggagcatcggcaagttcgccagcttcgccgcaggcgtcagctacatctccatcctcaccggtgttttccagctgttctattttggtttttccatggccgggcccgcctatgcctggtcctggccccttgtcttcgccggacagctgatggtggccctgtgttttgccgaactggcgggccgctaccccgttgcgggatcggtgtacaactgggccaaacggctcgcgtccggcacctcggcctggctggccggctggctgctgatgctctcctccatcgtggcgctgggctccgtggcgctggccctgcagctcaccctgccccagctctggtccggcttccagttcgtcggtgacggcagcggcccctacgatttcgccatgaacggtgtggtgctggccagcatcatgatcaccatctccaccctcattaatgcgttcggcgtgaagctcatgacccggatcaacagcatcggtgttttcgtggagctgagcgcagcagtgctcctgatcctcgcgctgggctggcacgtggtgcgcgggcctgaggtcctttttgacaccgccggcttcggcgaaggccacgatctcggcttcttcggcgttttccttatcggcgccatggcttcgggctacgttatgtacggctttgacaccgccagctcgcttggggaggaaacgaaggaccccaagcgcaccgcacccaaggccatcctgcgggccatcacggcctcgttcgtgctgggcggcctgatcctgctgtttggcatcctggccgcgcctgacctggcagaccccaaggtgggatcggccgacggcgggctgcagtacatcgtgctctccgtcctgggcggaccgttcggcaaggcgttccttgcgtgcatcgttgtggccgtggtggtctgcaccctggccgtccatgccgccgccatccgcatgatgttcgccatggcccgggacaacaacctgccgttcagccggcagctcagcaaagtggacccggtccgcaggaccccgactgttgcggccatcgtgatcggcatcctggccgtgatgccactgctcatcaacgtcacgcagcctgcgattttcaccatcatgtccagtatcagcatcgtcctgatctacctctcctacctcctggtcaccgtgcccatgctgcgcaaccggctcctgaagaagtggccgctcgccgcagacggctccgagcccggcttttccctgggcaagtgggggctgccggtaaacatcctcgcggtcctgtggggcggtgccatgacgctgaacctggtgtggccgcgcccggagatctacaactcggtgccgccgttcgagtggtacctccagtggggcggcgtgatcttcgttgccgccgttaccgttggcggggccctgctgtaccggctgaagatccgccatcagacgggcgtgctcgccgagcacgccgcggccgtcgcggcgcatccgtcatcgggcggtgccttgcaggctgctcccgctgagctggacgtggtggacgccaaggtgtcctaggacaactgctcccacgccagctggagcctggcggtccccaacggaaaggtcgacgacggcactcacctcagtgccgtcgtcggcctttccccgtggaggggaactggacgcgatcctgccgcccctgacgcgcggccgccgctaagctagcgccatggccaacaaaaccacagcagagaagctcgccaccctccagaagggttacaccctggaaggcgccaccatagagctgggagccgcaattatcgacggcgagctccacaaggacgcgccggtgcggctgccgctttccatgatgaaccggcacggactggtggcaggtgccaccggcacgggcaagaccgtcacgctgcacatgatggccgaacagctttccaccgccggagtgccggtcttcctggcggacatcaaaggcgacctgtccgggctggccaccgccgccaccggcagtgaaaagctcaccgcgcgcaccgagggcatcggacaggcctggcagggcaggacattccccgtggagttcctggcgctgggcggtgacggcaacggcgtccccgtgagggccacggtgtcctccttcggccccatcctgctctcgcgcatcatggaactgaacgacacgcaggaatcgagcctgcagctggtgttctacttcgcggacaagaacggcctggagctcatcgacctgaaggacctccgggcggtgatccagttcctcacctcggccgagggcaaggaccagctggaggaactcggcgggctgtccaaggcgacggccggcgttattttgcgggagctggtgagccttgaggcgcagggcctggagaagttctttggcgaaccggaattcgacaccgcggagctgctgcggaccgccccggacggacgcggggtgatcacctgcctggagctgcccaccctgcagaccaagcccatgctgttctccaccttcctcatgtggctgctggcggaccttttcgaggacctgcccgaggccggcgacctggacaagcccaagctggtgttcttcctcgacgaagcccacctcctcttcaacgacgcctccaaagccttcctggaggccatcaccaccacggtccggctcatccggtccaagggcgtggggatcttcttcgtcacccagacccccaaggacgtcccggcggaggtcctcggccagctggccaatcgcgtgcagcacgccctccgcgcgtttacccccgaggacgccaaggcccttaaggccacggtgtccacgttccccatgagcgactacgacctcgaagagaccctcacctctgcgggcattggcgaggccgtcatcacggtcatgaacgagaagggcgccccgacacctgtggcgctcaccaggctccgcgctcccgagtccgtgatgggccccagcgacgacgccctggtccggagcaccgtggcagggtcagcactgctggaaaagtacgggacagccgtggacaaccactcggcgttcgaaaaactgtcagggaaggccgccgcgcccaccggcccggcagccgcgggcgggccggtggtacccggtgagtccgttccgggcggggcaggccaggacgacgtcgacgccgaggcgcgccggatcgaggaggagatccttggacggcccagcagcaggcccgccccgtcagccggagcaaggcgccgcacgcccgccgaaacagccccggcccggcgccccggtgcgggagactcgatggtgggcgacattggcggaatgctcggcggcgccctgggcggcgggctgaagagcatggccaggtccatcggcacacagctcggacgggagctgctgcgcggcgtgttcggcacgtcgtcccggcgccgccgccgctgaaaggtaccgcatcctgctgactcaactgccgccgtcggacgcatggcaggtaacgtatggaacgtgcagatgagtcaagcgttggtgaggatcgcggccggatggctgctgggactcatgcttgccatcgccggcgccgtggtggcggtgaacctggtcaacaacaccgtggccagtccccagcagcccgtgcgcgaatatctggacgcgctgcagagcggcgacggcgggaaggcgctggggctgctccgcgctactgtcccgcccagcaacgccgccatgctcgacggcacggcgctgcagaccgcaacgtcccggttcacgaatgtggacatcggggatgccgaggaacgcccagacaaccaggtcatggtgcccctggagtacaccattgacggcagccagctccgcaccgaattcctgctgcgtaagaccgggactgagtgggtcttcttcaacacctgggctttcgttccgtccaggctgcccacgatggacatcacggtggtcaattccagtgaggccaccgtcaacggcgtgcccgtcaacatgcccaacggccggaactcctttgcggtcttctaccccggcgagtacgaggcctccgtgaacggggagtacttttcggcggcccccacccgtgccacggtgacggcacgggacgccccggtggcgccgctcaacctcctcacacaggccacggacaccctgaagaaggacgtgtccgcgaaggtcagggaattcctggacggctgtgccgccgtcgccgccaaggaacagaaactccagccggactgccccttctactacgccagcaacaacacggtgcaggacggcagcatcaagtggaccgtgacggaataccccaacgtgtccattgaaccctttgacgggcgctgggtggtggctcccctcgacggcaaagccaaggtggaggccctccagcagaacctgttcaccggcgcctggtaccccctcaacgaggaagtggacttcagcttcaccacccgcctggacgtcaccggggacacgatcaaggtcaccccggtactgagcttctaaggcccgtccggccacactggcccagttttagtggccaaacagcagatttaccagccgttgtggcgccaactaggcgaaaaaccgggccggtctggttgcggccaccgcagcgagccccgggcaagaacctcgcggacctgcgccaggacagcttcgggtgaatgaaccacgtcgtcgtagaagaatcgaagcacgggaaggccttgtagtattgcggagttgtccctgcggcggtccttcttgaactgcctggcttcaagatggaaggccagcccgtcaatctccacgatgaggaacccctccaacaggaagtcaacacgaccgatgccatcgatccacacttgggtttcggtaagaatgcctgcatcccggaacagcacccgggccagggtttccagcagggaatccgcgccccggtcaaccttggacactacattccgcgccttgccgcaccggggtccgtccaagtgacggagcaggtacggcggatcgatgtctccgcggttgtacgcacactccaccatcaccagggactcgagttccggcaggcagagcagggcatggagcaggacgtcgggaagggctgcaagcgtccggtgccggggcgactgcgtcaagtcggtacggtggctgacacaccgtactgcgcttcggccgttgctctgccagtagtggggcctggcaggaggccgaagctgccacaggccgtatgccggagcagcagaaacgcacgtaatcagaccgcgggcgcgtcctgccgccaccagttccgcatctgcttccgccacggccagtagtcccctgtccagccgaagcacctggccgctgcggaccgcacggcgaagctccgtatccgtggcaccggcggccaacacatcccgtcgcagcaacactccgccagctgatctaaggatgtccgttgggtccatcaggccacaatgtctgccatcctggtctggcgtcagcctcgagcggccttatgtggacacgcagcaccccactggcccgcttttagcgggaggaccaacaaaagcggcccggtttccgacccaagtgggaggaaaaccgggccactctgggcatcaaggtgcggagcgtcagtccatcccgcgcaggtccagcaccaactcggtgtcgccgtcgccctgcagcaccacgggaatgccccagtcctgctggtagaggtggcaggcggcgtggtcgggaatctcgccgtcctcggtttcggggccgtcgcaggcggcggcccgtgcggtgatgtgcaggatgccctccggcacatccggtgaaagctccagggtgcggagcagccccaccgaggttcccccgcccgatgccagcaactccggcggggtggaggagatcttcagctgggtgggatcgccccagcggtcatccagcttctgcccggtgggggcggtgaagcggactgtcagttccaggggaccgggcgcgacggggctcttgggccggtgcgtctggaccgcgccttcatccacctgctgggcttccttggggatgggaacgaacaccacttgatgcttgttcgcctccaccaccaccagcagcggctccgacccggccgagtgcgtgtggtccacaatcacgtcggacggttccaagaggccgcgcgccagggtggacactgtgccggaggcggggtcgtaccgccgcacggcgccgttgtaggtgtcggccaccgccacggagccgtccggcaggacggtaacgcccagcgggtgttgcaggcgtgcctctgcggccgcgccgtcccggaagccgaagtcgaacagccccttgccgatggcggattccacggtgaccgtgccgtcgtcgtcaatcgcaagcttccggagggcggacgtttcggagtcggccacccagatgttgccgtcggcgtcctcggccaggccggagggctgggcgaaccaggcctcgtgggccgggccgtccagcaggccttccaggccgttgccggccacgatggccaccgccccgctgagggggtcgaaactgaagatctggtgcactccggccatggccaccaccacggcgttgagcttccgggaccatacgacgtcccagggcgagctcagtgccacgtccagcggatgcccgccgagttggccggtgaacccggccgcgtcctcgtccacgcgtgccggaccggactccagcagccgctggacgccgctgccggcaagcgtggaggccttgccgtccgcgagagacagcccacggagccggtggttgacggagtcggcaatcacgacgtcgtagccggccttggctgccacgtcttccggcagcaggaccaggccttggggctcgttgaactgtgccacggcggaatcccccgcggctgggccgtccgcatggcccctcacgcccgagccgaaggtgcccaggacggtgtggaagtccgtgccgagctccaccagccggtggtgccccgtgtcggtgaccagccaggaacccttcccggcagcaccgttacctgcggcacctgccgctgcgcggtcgtcggacgttccgttcacggcggtggaaccgcggcccggcggcaggaagagagccttgccggggaagcgcagggtgccggaggtgggctccggggctacgtacgggccggaaccgcggtgcagcgtccccttggcctcatgttccgcgatgagttcgggaatcaacaccgccaggccgtccgcgtggccttcgccggaaaggtgcgccacgatgtagccctcggggtcgatgaccaccagggtgggccaggcgcgggcggtgtaggccttccaggtctccagctcgggatcatccaggaccgggtggtggatctcgtagcgctcaacagcggcggccagcgccaccgggtcggcctcgtgctcgaatttgggcgagtggacgcccaccgtgaccaggacgtcggagtactgttcctccagcggccggagttcgtccaggacatgcaggcaattgatgcagcagaaggtccagaaatccagcagcacgatcttgccgcgcagggcctcaaggtcaagggttttgccgccggtgttcaaccagttgcggcccaccagttcggaggcccggacccgggcatgcgtgcgtacggtttcgctcatcagcgtccttccagcttgttgcgttcagccagcctggcgtcgcgttcggccaatttggcaaacatatcgttgtaagcggtgagatcggcgtcgttattcctgtccgcggccctgtccacgcgtttggtctcccgctggtcagaccgggaccacatgatggcgacgccgagcgccaccagcagcgtggggacctcgccgatgccccaggccacggcgccgcccctctgctggtccaggagggcagacgggccccactccctgcccaggttgccgaagtagtccgcggcgaggaggttggtcccgcccatgatggcgacgccgaagaaggcgtggaagcccatggtggccaggagcagcaggagccgcatggggtacggcgcccggcgcggcagcggatcggtgccgatcatggtcagcacaaagatgtagccggtgagcaggaagtgcacaatcatcagctcgtggcccacgtgctcacgcatggcgaagccgaacaggtccgagtagtagaacagcacaatagagccggcaaagttggctgccgcaaagagcgggtgggtgaccagttgcgagaacttcgagtggatgaacaccagcagccactcccgggttccacgggagccgtcaccccgggcgggcagggcccgcagggcgagcgtcaccggcgcccccagcaccaggaagatcggggccaccatggtcagtgccatgtggtccaccatgtgcgccgagaacagtatgcggccatagaccgacggcgggccggacgtgatgtaggtcagcaccaggagtccgatgacccagttcacggagcggaaccactgccacttgtcaccgcgccggtggaccttggccacgcccaggaagtaggcgacgaggccgaacagcgctgcggcgatccagagccagtccaggcgccactcagtgagccagcgctccggtgtgagctcaggcggaagctcgtagcctgtgaggatgaaggcgggcgaggcgtcaggggcgaaagtggtgggctccggcggggcggaacggcccagggcgacggcgatacccgaggttgcgcccatcaccaggaattccgtcaggaccagctgccagagcacacgccgcgaggacagggtggagcccttgcggcccagctgcgggatcacccactgccggtgcatgaatccaatcccgcccagaaccacggtggccgcggacttggccaggatcagctggccgtagggagagccgaagaggtccccccagttggtgatcctgatgctcgcgttgatgatgcccgaggcgaacaccaggacgaaggcgaagccggcgagggacgagaaccggcggagcgtgggttccgtaatgtcggcggaagctgcggccttggggccggtcaggactccggacagcagggccagcatgatgatgccgcccacccaggtgctgacgcccaccaggtgcaggcccagggagttgatggcgccttcgtggtctgcggagctcgaggagtggccgatcagggcggtgggtaccagccccgccagggccaggacaagcgtcagcgcaagtccgccgagggacctcaccccgaacagcgccgttgtcacaattgccgcgatgatggtgacggccagccaggcccggcccgtctcgatgtccgtcatgaagaagaccagggcctgcgtgaactcagcgtcaccggagagcccctggccagcaacgtcagagtaggtgaggaccaggacggcgatggcggacagcgtccatgcggcacctgccgcggaggccacagccagggcgcggctgaaggcgggatgctccggcgcctcactctcggcagcctctttggcccggctgcggggcccggcactccgggggaggataccgacggcgaagatcaggccgccgatgacggtcgccaacgagacgttatggatggccttgctggcagggaggccccagcgggctaacgcccccgggtcggagactgcccgggcgccagccgcgccggagaaaatcagcgccgctgcaaggcccaggaacagggcagccagcccggccacctgccagccccggggaatgcccagggaactgctgtctttgcccggcgcacccttgcccggcgctcccttgacggaaacggactgggagtgggtggaacgtggttttgcggcagaagacaccattccattgtccgctacgcccgcccggcccgcgaatcgggcttaaaagcaaaaggagcggcaaccagctggttgccgctcctcttcctgcgccggctacgtgccggggaggaagaagcttacttcttattggagactgcagccttcagcttcgagccggcggtcagcttgacgctgtggcctgctgcgatctggatggtctcgccggtctgcgggttgcggccggtgcgtgctgcacggtcggtgcgctcgacggcgagccagcccgggatggtgatcttctcgcccgcggcgacagaagtctcgaaaacctcgaacagtgcgtcgaggacggagttgacggctgcctggctggtgccggccttgcctgctacctctgcaacaagttcactacggttcttagccatttatgtcctcctggacggtcatgattctggagcctgaacgcggcatgcgtacaagccactgttcgaaaacttaccagcttgggccccccggttccgcaaattccgcgtgtttccgccactttttgaggttaatcaccgcgttttcggcgttttcggccccggattcagccaccagcggacggcctttgactcatttgccggctcatcccctccgatgctctctcacttgatgcagggtctcccgggacgctctctcagatgatgcggggtttcctggaatgctctctcacgtgatgcaggcttttacgggatgctgtctcacttgatgtcgggttttccgggacgctcaccgggtttcttgccggcaggaagtgggagaggatcgtccggaaagcggcatctactgagagaggatcgtccggaaagcggcatctactgagagaggatcgcccgggggccggcattaagtggaagagcgttggggggggtgggtgtgaccggggtcgttgctgggtgtggtgtgtgtttaaatgtgggaggccccaaccgttgtggttggggcctcgaccatt

SEQ ID NO: 38 - DNA, 258581 bp, Arthrobacter sp. OY3WO11
aggagccaagagggctaccctcaggcccccagccatcccctggcgcagttcgttcgctgtatgccgtaggttcagcgcgagacgtagttgaacgccgttctgagccgtctgaggaccatcagcatcgtcaggccgagatgcgtaaaaagccagatgcagaggggcgtccaccaccacgaaaggcccccaattggatcggtagtcgagggcggcggcgtgacggcagcagccacagcaagaagtagcgataggcacacggcgacgactgccgcgtacgttacgttagctctcagatcagatatgaccaatttcaggtcatgcgcgtgttcgaagactgccaagtccttacgtaccgctattccagtgttgaacattagtaccaagagtccgaatagcagcgcagtaaaaatagtcactccgctgagcaattgtccaattccctgtagccgaaagtggaaaaacacgaacggcagtgccaggaccgcgggaatgccgaagtacttaaatgccgcgcggcgacgctcagccttttgctgaggcccgactgcggagctccaagtttcaatatggtcttcaagcaccatcctcagaccccaatgcttacccaagggtcgcctcactcgttcttagactgctcttgttttgattcctgcaaccaacccgcaggcaggcgcacgccccgattcttgaggatctttgccgcatgcgtttcccagaggttcctcagctggacgtccgccagacgtgccccagtttcatagataaattgaggcatcgcatctccttccagaacgaaggtcctttccggacgttcgttgcctatgccgacctcgaatcgcttcgtcctaagatgttctcgattgaccggcgatactgcctctagggcaaccgtgagattggcatcagattcctctgcttgttccaacgcggttagttccatgaccaaagcctgatattcagtctcatcctgaacggtgaacactgatcttggagccgccttgtaaaccgtatgaccactttccgagttcttttcatccacgatctttcggcgattttcgacaggtgctatccgcgccaaggcatctagcttcttgtcgcgcctagatagccgatcagtgataagagctttgattccctggcttgcccgcctaagtccggggccctcagtgacgaccctcaccacagtgtcttgaggcgtagagtcatcctgcccgccttccgcggaatagagaatttccgagactcggagggcctgttgagtctgaagttcccgccgccagtcctcactctcagcgaaggcttcgactcgtatgactgcctccatgtagtgcgaggacggcttcattgccttcgtataaagcagttccttgagattccttacgcctatgcgctcgacaaataacagtccgaagtagctgtcctcagggatgaatagttggccgcgaaggccgcttaagagtgccgtccgttcgttagtatcgactgatacgcccgtttcagtgtcgtatgtctccccccgcccgccctctggccctttattgatgcgcagccaaagcgaacggccagcgcggtccgcttcccgaattcgaaaaccgtccgccgacttttcgtctgagtggtagtcctcccctagctcagttatctgcttatgaaggacgtctaacaggtcatgagagccggggccacatgatgtcaaacggtacaaggcccgcgatctgtgcggagcgtttgctcgtatgagatagaccaagtacccgaatgtagccacgtttccccatctacagcatttgctactacctattgactaagtatcaccgcatcctctgacaattcgccgcagcaagggagcgcgctctagagatgacctcgatgtcctacgatttctgccatagcccggagaacgaagccccgacagtcaacgagtcctgacttcggcccgagtgacttgcccgcgccgttgaggttgaactcctgcagtttaaggcctcgaaggtcgacggctattagcctgcattcgagagttccgtctactgtcacgatggactcgacgcgttgtgcgacgtagttggagctgccttgggcgaacgacggtgagcggtccaaccttgttccctttcgtcggcgaggcgggcagtataggttcccttggcttgtcaaagttcctgctcgtttgtccaggtaggtggtcttcacttcgaaagccactaattcaccttcgacaagggccaccatgtccaagtcctgtctggcgttactacggggcataccgctatctccaagcgagacagggaaggctccgttctcttgcaggtagaaacgagcggtttcttcgccaaggtcaccaaattgtcctcttgtaagtacgtcgaggatggacgtcagccctgcgtccgacagttctaaggggttgaaatcggagccaaccaggagatccatccgattcaaaaaggtgtctgattcgagggtggccgtggaaacgagtccgaggtctacccaagttggtatgtctgtttcgtctgagtaccttaggtggcagaaaaatatcccgctcgagatactcaaggcttttcgttcaagtgcacgatatcgccggccttgcgccgacaaacccctgttaagtgcacggtcttgcgcatagatgtttgggccgaactgtcctcccgcgctatgaggcatcatgtggccgcggtcgaacgcctgtttggcgttaactttcaggggaaaaccagcttggtaggcgacatcacggaccgatcgcagcccattcaccttcccgaacgcagcaatggtcctggcacattgcgctgacgcgatctcaggcgcggcatcgaaaaggaagtgcacgtcgccttggttcatcgtcactatctcagaaccgggccaagctctcctgtatgacgctgcccattggtcctcgagatcagcgatgactgcttcctgaaactgggacggttctctgcggcccgcagcctgggctgcttcgtagtcgatggacccaaaatcgtgcactattcctcctcatgctgcgcaattgtgggacaagcttcgtcagcccattggatcatcacggcgtggatgatcctcgacgtccagcgtgacgtgtcgatatccggccctggccagcttgcgtatgccgcctttgttctggaaggggggcagaaaagccggaggagcctactcccctgcccgtgacaacgggcgcctccaccgggccaataaaagatctctgacgacttcaacgcaaatcattagaagaatcgtcccgattttttcagcaaatgcagacctggggtgcggctgaccgtcgattgccaccgtcctacttttccaattacaaacattccttgggcgaagaaccgccatgttcactgaccggaggactgtctttgcgtcgattacagcacctctagccttgcaacagcattcttatcagttattctcatgatcaaggtcagcggcttggtcgacttggcaggtggtgccctgctcgagtcaagcacagagttatgtaccgatgcatagcccggttctgcggcgaaccgcattgccggcagcagggcgcattcgaaatgcgtcgcaaattttttagaacaagttgggggcgaagtggagaagtactacctgccaggaaaagatagctggcacaactttgatgttgtaggcgaagcctatcgagaagcacaggttacggcggcgcttggccgccgcccgcggctggacgaggagattgaagaggtctttgaggcccttctcgtgccggagccggacaaccctcatgacgctaatgctgtctccgtgcgtgtgaacggacacgtgattggctacctggaccggggcgctgcgcaggtgtacaaaccgatcttccaccgcatcgctgccagcgggatggtcgcgactaccgcagccaggatttgggctgtcgttcgagaatcttgggaagatgacaggcgggcacggtttttttcgaacgttcgtatctatttgccagagcctcatcagattcttcccctcaacaaccacaaccaggcgaacgtggcagtcctcccttggggcggcgcgctacaggtgaccggtgaaaatagtcactttagccaccttttcaactaccttcccgaaaacggcgaagggcttgttattctcacgatgcacaagctcgttcagaccctgaaaaacgggacggagaagcacctcgtcgaggtccggctcgacggcgaacgggtggggcaactaacctctgccacctcgaaccactatctgccaaccatcgcccacgccgcagacattgggaaggaattggggatctgggccaagatcaagggctccgggctcgcggccgagctagtcattcaaggcgccagagccacggaacttaacgacgaatggctcaatacaatgccgactttccccccactcgcaccggaggctgccgtctacaatgtgccgccagccttcacaggagatttgccgacccgccgcgaccccagagccgctcagtcggtctctggtttgcgatcagcgccaactaacaattcatctgcagctccgttcgtgaagacaaacccgaagttgcccaaagggcatgtcattgtcactgagaaagacaggcgatacagtccccttacccaccgggtcggtggagtcgcaatgatcatcatcgccgttatcgtcggtgctgtgctcgcggcgatccctctcattgggccagtgctattcattgggtgtctggttctgggcatcatggggaacattcgatcccgcaagctcgcagcggtccttgagagagaaaggtccattccggagatgcgcctttgagctctgacgcacatgtcgactagacatgggcccatgggaagaccaggatgagggttcaccgccgccgacatccacgtctcctacaccttgacacttttccgagtaagccttaaaactcaatctgacgggttgagggttggaggcacctgtggttggtcagcgggtcggctacgtgcgggtgagcacgctggaccagaacgagaaacgccagctcgaaggccaggttctggaccggatcttcaccgacaaagcctcgggcagggacaccgcccgaccgcaactcgcggagcttctgcggttcgcccgcgacggggacaccgttgttgtgcacagcatggacagactggcccgcaacctcgatgacctgcgtgccttggtccaaggcctgacacgcaaaggcgtaaaggtggagttcatgaaagagaatctggtcttcaccggcgaggactcccccatggccaacctcatgctctccgtgatgggtgcgttcgctgaattcgaacgctccctcatcagggaacgccagcgggaaggcatcgccctggccaagcagcgcggcgcctataaaggacggaaaaagaccctcacgccggaacgggcagccgagctcgtccagcgcgccggcaccggtgttccaaaggccctccttgcccgtgactacggcatcagcagggagaccgtctaccagtacctgcgccaggccaagctggcgtgagccgctcccctgactaggctctcgacgtgcaatagttcgagcggccttagcttgacggaatctctgttatcggcgttttaaaatggtcgggggagggttcggtagaaggaccttccgtcgctcctcgaaatgtttctttaggccggtgttgtccgacgcgcatcgcatctcgctcgtgctgaagggggacgggtgattcctgctatgtcaggccgatcgcgtcgtcccagttcattcctgattcgatgcgggaccgccattggcgaagtgctttggcggcccctaccgccaggactccggtcagtgcaggtcccctcctgtagagggctatgagccgccgtgatgtgaggtctccctctgcgacatggacctcgtcgtgtccgcgcaggtagccgtgagcttggagtttgagatcgtactggtctgaccagaaatagggcactggtgcgtacggggtgcggtccccagccatgatccgctctgcgacgtgcagcgcctgctcggtcgcgttggtgcggtgttcgacgcgcatggacatgttgaaccgcgggttgtgccaggtggcgacatcaccgacagcgtacactccctccgcagcggagcagtcggaagcgcactgcacaccgtcctcaacggcgaggccgctgaagcgcagccagtccactgccggctcggacccgatgcaaacgaccacgaggtcagcaggttccggtgccccgctcacaaaagtgactcccgacaccctgccgcccctgctttgcagtgtccgcacgcgtccctccgatccggcccggacccgcaccctgttccctcggtgaagatcggtaacctgttgcccgatcagctcaccgacagcactttgcaatagcgttcggctgctgctggcgatggtcaccccggccccttggcctgcggcagcggcggcgacttcggtgccgaggaacccgcctccgatgacaacgacgcgagaagcctcagtcagcgcggaccgcagcttcagcgcatcgtcaattgtccgcagcgtgtgtacgcccgccaagccttcggcgtgtggcagtttgcgggctgctactcctgtggcgatgatgagccggtcaaattcggcggcagtaccatcggagagttccacccgtcggcgcgccaggtcaaggtcgtcggcggttaccccgtatcgttcctctattcccaggtcgcgaagatggtctttgccgcgcagtgccagcgttgcgctgtcgacgggtgcgctgcccaggacctgtttggataggggcggccggtcgtagggggcgtgctgctcggaaccaatgaggatgattggtccttcgtggccccgggcccggagcgcttcggccgcgctggttccgcctgccgaggctccaacgatcactacccgtgcggtcctgggatctgcctgcttcactgctcagtcagtttgatgacggccgccgggcaccgcaccgctgcgtcccgcactgcggcttcctggtcaggggaagggctgggattgaggaccacgatgatgccgtcgtcatcattttggtcgaacaccttgggggcggcgatagcgcagacccctgcacccacgcacttgtccagttcgatatcgaatttcacgcaactacctcatcccagtcgatcatgagctctttgatgccgtagacgaccatgtcgtttttgaaagcaatgtcctcatcgggcactgctacccttagcccgcgcaggcgccggaacagttcgggcagcgcgatgcgaagttccagcctcgccaggtgttgccccaggcattggtgcggcccgtaaccaaacccgaggtgggcggacttcctgtccagatcgagctggtccgcgtccccgaggaagtgcgcgtcgcggttggctgactcaagcacgacggcgacatgctctccggcccggatgatccggcctccgatggtggtgtcgcggaccgctttcctcagtacgccgttatgaacgatggtcagataccggatcagctcgtcaactcctgtctcctggaaagccgcgtcctgaagcttggctgcctgctccgggtgctggagcagcgcgtaggtgctaagggtgatcatgttcgcggttgtgtcatgtcctgcagccagcagcagcaatgcaatcccctgcagttccgccgcatcgagcggaagctcggtgtgttcgaggatgagccggctgatcaggtcatcgccggggttttcaatcttcgactgaacgaggcggacgaagaacccagcgctttcgatggcagctgcctgccgttcttcaagactcaggctcaaatcgacctgcgatgccgttgcccgctcgaattcgtccctgtcctcctccggaacgccgaggatctcgctgatcaccagcgcgggaacaggaagactaaatgcgcggtataggtccaccgggccctcacgttccgcgagccgatcaatatgatcgcaaacgagccgccgaatgaacggctccagtttcgctacccgcttcaccatgaactcacgggcgagccgaaggcgcaggcgggagtgcgagtccccgtcatggcgcaacatcacccccggcggcggtggcgcaccaaggttgtctttgtctcccatgagatgggaagaactggcatcaacgctgctgaacgtttccgcatcacccaggacagcccgtgcatcctcgtaccgggtgaccagccagacgtcgaatcccgcgggggtgctcacccggggaacaggctcatccgcgcgcaattcttcatagcgccggtccgggtcaaacgggcagcggttggccggcagggattcctgtgcctgaggcggcgttgtctgtggcaatgaaatcatcagtctctaacttttagtctttatcccgaagctgacggcaggaccgggaactcccgtaaaaccggtgatctgcaccggtacgtctcagtgtctagcgatttcagggcaatcaaatccggcagcggcagtattgggacgtactgcgttcgcagtacgccccaatcaggcgagacactggcgccggcgccgggcatcaataaccccgggcccggaaagctattgcgcgctagtagactcgaggcccaggagccgaccttcactgattgatggtcgcgcgacgagcggacgcctccttacccggcccctgatgagaaggatgcttagtgccgcccttagtgccagctacgaaagaagaaccggcgatccggcctcgcttccggtgggacgtatggcagctgttcctggatgtcgtcgtcctccttgtcgtagccacagagatgctgcagcgggccccgctggacccggtggaagcggcctatcttgctgttgccgtgattattgccggcgcccggcgccggttccccgtctcagcgctgggtgggtcggccgttctggcctttctctacccgctgtctaccggagagcaccttctggcctggtgcctgctgcagatttgtcttctgtcgttcgccatcatcaagccacgtaaccaggcaattgtcgcgacggtgtcggtcggagtgatccttttaatcaattccggcctgtggctgcagatgccggtggtggacccgatgtccttggcccttgttgcctggaccgctgccgcaggaggcgtcggatcggccgtccactcacagaggggatacgttcaggctctggaaggccaggcacagcgtgccgaagcgacccggcgtgccatcgtggagcgcgagctggtcgaggaacgccttcgtatcgcgcgcgaactgcacgatgtcatggctcatcacatcgcagccatcaacgtccatgccggttcggccgaagccaacctggcctcgaaccagaccagctcgctgcagtccctgcagcgcatccgcagcgccagcggtgaagcgttacgggaactgcaggcgattctgaaagttctgcggaccagcgacaccgtgtccgggaccgctcccccggtcccggacagtagccagctggattcgcttttcaactcatttcgtgcgctgggcctggagcttcagctcagcggcggcgcatctccggagcttccgcccggaatgccggcagcgattgaccttgcactgtaccgcgtcctgcaggagggacttacaaatgcccacaagcatggtgacgggaagactgtcgttgatgtcaggaccggacaggagaagatcaccgtgcggctggtcaacaaacccgctacaacgcgcaagcgtgtaagaaatgcagacggacaaggattcggtctgattggcatggaggaacgtgtggccgcagcaggcggacaactccgtattacaccgtcccctgaccaattcgtcctggaagccgtttttcccttgggagtacatgaatgatccgcatcgttattgttgacgaccaggaaatgatccgggtagggctcaaaggaattctcggctccaaggccgacttcgaggtgatcggcgaggccggtgatggcctgcaggcagtcgccgtcgtgaccgcgacccgcccagacgtgatcctgatggatgtacgcatgccaggtgtggacggagtcgaagcaatccgccgtatccggaagaacaatcggttgaaccagtcaaaaatcctggtcctgaccacgttcgacaacgaccagaacgccatccgggccgtgcaagcgggcgcccagggcttcctcggcaaagacgtcggccccgcagaactgattgccgcggtccagaccattgcgaccggcggcgcatcactgtcccctacagcagccgaaacactggtagcccacgtcgcagacccggcccgccggcccgtcagccaggaagccaaggacgcaatctccgcgctgaccgaccgtgagcgcgacgtcctcaagtcagccgctgcagggctgaccaatgaccagatcgcggcagcattgttcatctcgccctatacagtgaaaacccacctgaaccgggccatgactaaaacccgcaccaacgaccggtcgcagctggtggtgctggcctaccgttccggattggccgatccgcagccctgaaccggcaccaccgcctactgcatccgcagtacatcaaagcactctaccggcaggattcgcgcagaacactaccgacagatgatggaacgaacctgccgcttaccggcattacctaccctccaggagctcgttagcatggcaaaacttctttaccgcctgggcctgcactgtgcccggcaccgcctcacggtgctcttctcgtgggcggccgtcctcgctctgctgggagtgacagccatcaccggcatgcgcttcggcgacggtgccttcgacatccccggcacagagtccagcaaggcgatggagagccttgaaacggaattccccagcagcacaaccgagggttcggcatcactccaattcgtgctgcggaccccggacgggagcaccatcagccagaacccctacgccgccgagctaacagagctcctcgacgcggccaaatccattagcaacgtatccggtgttgtctctcccctcgacccggcccggccctttatctcccaaggccagaccaccgccgtagcaaccttcaacttcacggacataaccgaagcaaacgctgaatcggtgtactccgaagcggagaagctcgctgaaacggcacgagatgccgggtttgaagcacaaatcggcggcgccctcaccagcccccttccggagatcctcgggcccagcgagatcgtcggagcactcatcgctttcgcggtcctgttcattaccttcggttccctggtcgcggcgggtgcgaacatgctcaccgcccttctcggtgttgtggtcggcgtgctcggcattttcgcttcctcggccttcctgcagcccatcggttcgatgactccgattcttgccgtcatgctcggcctggccgttggcatcgactactccctctttatcgtcgcccggttccgctctgaactgcgcgaaggccgggagctgcacaccgccatcggccgatcagtgggaacggcgggctcctcggtcatcttcgccggcgcgaccgtcatcatcgcccttgccgcgctctccatcgtgaacattcctttcatcaccgaaatgggactggccgctgccctggcagtgttcattgcagtcctgatggcactgacgctgctgcccgtcttccttgctttcatgggctacaaagccctccccacgcgcgaacgcccggactctggaaccccaatccaggtgcacaaacagaaggacaccaccaaggtgggcatccttgaaaaatgggcctctgtcgtggtctacaaacccgtacgttccctgattgcaggattcgtcctgctcgccgtcctggccatcccggtgctgtcgctccagactgcgctgaacacccccggcggggatgatccggagtcgagccaacggcgggcctacaacatcatcgccgaggaattcggcgccggcagccagaacccgctcgtcgtcctggtcgaatccaaagatgcagtgcaggcccatgcatccgagatgcaaaccatcctgctcacgctggacaatgtgcagatggtggccccgccccaaatcagccagtccggaaccgcagcactaatcagcgtcctgcccgccgagggcccggccgaggacagcaccaaggacctcgtgcacgacatccgggaacgggcaacaaatctaggcgccgcagtgtcagtcaccggggagactgcagtttccatcgatgtggatcaaaaactcagcgaagccctggtcacctacatcgcagtcatcgtcggccttgccctgatcctgctcatcatcctgttcaggtcgattcttgtcccgttgatcgcaaccctgggattcctcctgtccctgggagcaggaatcggcgtgacggtggcagtcttccagtggggctgggcggacaccatcattgccgctcccacaggctcccccatgctgagcctgctaccaatcctgatcgtcggcatcctgtttggcctggccatggactaccaggtcttcctcgtctcgaggatgcgtgaagcctacgtcaagggctggtccccccgggaagcaatcctggacggcttctcaaagtcagccttcatcgtggttgccgctgcggccatcatggcagccgtgttcggcggcttcgcactcagcccctccccgctggtcgcctccatcgcactggccctcaccatcggggtcctcgccgacgcgttcatcgtccgcatggtcatcgtccccgccacgctgtcactcctcggacgctcagcctggtggatcccgtcctggctggataaagcactgcccaacctcgacaccgaaggccacgcgctcgacacccatgacgctgcaagcaaccaagaagcgccccgcgaaatggcgaccacccggtaattgatcgccgggtacgtccagaaggcaggtccaaatagagaggttgcagccgtccgatgggcggctgcaacctctttcccttgatctcccggtcccggggaactagggttaccaactagcgcgcgctactctacgcgaggcgttgaagggagttcagcgtggcagctcatcacaccgttactacgaagatcaggttcaccggcacaacgcctgcgccggcctccgcgccgggaccggcggaagtagacatcctggtggtaggcagcggtaccgggctcgcggccgcgctcagcgcccacgaggctggcagttcggtgcttgtcgttgagaagaccgccgtcattggcggatcgacggcacggtccgggggagcgttctggataccgggcaaccatgttctggctggcaagggcgcaggcgcatccctcgactctgcagcccgttaccttgcagccgttgttggtgacggcacccccgcgcaacgctggaacagcttcctcgcccacggcccggaagcgctggcaatgctgcaaaggaccacgcccatgaagttcacctgggccaaaggctattccgactaccacccggaaaagcccggtggatcagcggttggccgtagctgcgaatgccgccccttcaacctccggcaactcgggccgcaccgcgccaaactccgtccaggcatcatggaagctccactgccgatgccagtcaccggtggcgactacaaatggctcaacctcctcaccaaagtccccgctaagggtctgaagctcgctgcactccgcgcgatccaaggcatcggcgggacccttctgggccgggaatacgccgccggcggacaagcactggccgccggactttacgccggggtactgaaggccggaatccccgtttggaccgaaacgtccttggtccgcctgcttaccgaccaaggccgggttaccggcgcagtcgtttcttccggcggccgggaacacgcgattcaagccaggcgaggtgtcattcttgccgccggtggattcgaccacgacctcactatgcgcaggcaggagcaatcgacgagtctgggcccttggagcctcggggccgacgggaacaccggcgacgcgatcgctgcggcaacctcctgcggagccgcaacctcactcctcgatcaggcctggtggttccctgctattgccccgatagaagacggtgccccgtctgtgctcctcgccgagcgctccctgcccggttcgtttatgaccgattcgacaggacggcggttcacaaacgaggcccaggactacatgtccttcggccagcgcgtcctcgagcgggaaaaacaaggtcgaccggttgggcagatgtggctcattttcgatcaggaatatcgcaacagctacctgctcgcgggcgctatattccctggcatgaaacttccggcatcctggtatgacaacggaatcgccgtacggggctcgtcctggtcagacctcgctcacgccatgtctatctccccggacgcactgaacggaacgggcacccgcttcaaccaggcagcagcactgggcatggacgatgagtttggacgtggcaacagcgcctacgacaggtattacggtgatccgacggtgaccccaaacccgaacctacgcccactgaaccaccgcaagctgtttgcagttaaagttgttttgagcgacctcggaacctgcggcggtatcaccgcagacgagttcgggcgcgccctcgatgccaaggctcggccaatccctggactgtacgtcgtgggcaacaccgccgccaacgctttcggtaaaagctaccccggggcgggagccactataggacaagggctcgtcttcgggcacattgccgcgcaacacgctttgcatagcagttggcagggagctactccaaccgctccccttcccagctgtggataaccaaagttgaccccagccgtggaccgtccatcgtctccttgtcggcaggaagcaaaggctgttccagacatactcagctgatagaagtccggtcatctgcactctgaagtggccaccggagggcctatagacggggctgcttcttccagcatttgtcgccatttacccactcgggaagtccgaactgtccatttttccaaatgctgggagccatgggcctctggctccaagcattaggaaacacgccctaggtgttgactaggagctcgcgagacgaagcaggcgtcgtgttgcacgccgctcagcttggcggtccggatcagctgtcggcgaggcaagcagcaggcgccgcgtatattcgtgctgtgggttcgtggtgacatccggggtcgccccggtctcgacgagttcgccttgatacataactgtgacgcgatggctaatgtgccgcacgactgacaggtcatgcgtgatgaagaggtacgcaacgccggtacggcgctgcaactcgatgagtaggtcgagcactcgcgcctgggttgtaaggtccaaggccgaaacgggttcatcacatacgatcaggcgtggcttcagcgcaagagcccgggcaatggcaattctttgccgttgcccaccgctgaactcttttggatagcgctgggcggcgttcgccggcagtcctaccgagtccagcagttgccgcacggagtttcgagcctcctgcgacgatgttccttgagcgatgagcggctcggccaggatatcggcaatctgcagggaggggttcagcgaggtgtatggatcctgaaagatcacctgaatctcgcgggcaagaggccgtcgttcgcgggaactcaggtgggtgatatcgcgcccgccgaacttgatcgttccgccggtcggtttagccagccccagtaccgccctaccaagggtcgtttttcctgacccggactcccccacgacgccgagcgtttcgcccggagcgatgtcgatagaaacgccacggagtacctccggtgacgctccgcggaacccgaccccagggtagcggagccggaggtcggagacgtttagcagtgccttgctcatcgagcattctccttggtcagatccagcgacgccgatgcgggcgggtcagagcgggtagtgttctcatccagaatcgcggcaattagttgctgagtgtattcattcgacggcgcgtggaagatcgatcgcacgtcgcccgactccaccatctcaccgtccttcatcacaaccactcgatcacagagatcggcgacaaccccgaagttatgcgtcaccagtaggactcccatgccgaactcggcttgcaggtctcgcagaaggtctagaatctcagcttgaacggttacatcgagagcagtggtgggttcgtcggcgatgagcagctttggtcgcgatgcaacggcgcctgcaatgaggacccgttgggccatgccgcccgatatttggtgggggtacgaattgaaggttcgaactggatcggggatgccgacccgggcgagtagggccagaatggtggcgcgtgcctccttcttcgacatgccagctgtcaggggttcgacgagctggctgccgacggtgaaggacggatccaggttcgacatcggctcctgcggaatgtacgcgaggacactgccccgcatgcgccgcagtgagcggtcatcctgcacggcaatcgattcacctgcaacttcgagtacatcggtgctgacgcgggcttggcgcggcaaaagcccgagaatggagaacgctgtctgggtttttcccgaccccgattctccaacgacacccacgacttcacccaggctgacgtccagcgacactcccttgacgacacttttgtaggtgccatcggcctgcggatactgcaccctaaggtttcgcaccgtcaacaggttacctttgcctaccgcttcgtattgcccgccagcgtttcttggtccaccatccgtggcattgaagtcaccttctagtggcatcgctgtgtgcctgcgtggcttcttggggacggcgtttggagctgcgagggagtcccggtaggcgttggcgagcatgaccaaagtaccggttatcagtgccagaaagagggagggccagagcatctgaattggatgctggtagatgttcaagaacgcagctcccgccatcgagccgaagctgggaagctggctggacccgagcccaaggaatgccaggcctgcctggatgcctattgaggcgacggcgagaaacgcggaggcgatgatgatggggcctcggacagcgtagagaacgtgccgggagaggatacggaaattggagagtccggctacgcgcgcggcatccacatatagttcgttccgcacgccgaggacaaggttgcgaaccagacgataaatgccggcggagatgaagatcccaaagacggccatcatgatcttgtagtcgccgccggtgattgggtagagaatcatcacaaggatcagtgcagggaaggtcatgaccaggttgaacagccaggacaagactgcgtctgtgcgcttggcaaggtagccggagatgaggccgaacaccgtaccgatggatactgccacccctgccccgattaacccagaaatgacggagacgttgattgcgaccagactgcgtgaccagatgtcacgtccgtactgatcggcaccaaggatgtaatccggggagaaggggggtgtgttgaccgccttcagggaactgaaattgggatcgtgcacgctcagcacaggctcaagtaatccgagcacgacgacagcagccagaagaaggagtgccccgagtccgaggggggttctgaggagccgggcaaacgaccctttgcgacgctcttccacatggcttgtatcgagggggagttcagcctggcgttcagggagtgtcatgtgagcctcgctttggggttgagccagccattggcaagatcgactaggaggttgactaccacgacgatgaggattccgaagagggaggccccaaggagcgcaggaaggtctccggtgacagtcgcttggtatccatatgttccatagcccggcagagcaaagattttctcggcgaagagggctgctccaaacatgccgatgaattgaagggagaaggtggtgaaggctgggcttgcagcgtttcggagtgcgtgcttcaacaggagtgagcgttcaggcactcctctgctgcgcagcgtcctgacgtagtccttctcgagctcgtcgatcatcgaaccgcggacttgggccgcaagggctgcaattcctccgatcgcgagaacgatcgcgggaagaatgactcccgcaaaccaacgcgttggtgaatcgctcaggtcggtatagccgactgctggaacccacttcagcgagaccgcaaagagaaacaccattccgaggccaaggatcagggtggggaagatgaaggtgatcaccgagatgaactgcaggatgctgtcaaggatgcccggtcgtgccgccgaggccacaccgaggattgtgctgaagatcagcatgagggcggcggcgacgaagacgacggacagtgtgacgggcaatcgcgttgccatggcgtccacaacgggctcgttcgagaagtatgaccggcccagatccccttgcaccaagtttgcaagccaattgaggtactgctgacccactggcaggtcaaggcccagctcggcttccaactgggcgattgcctcaggcgttgcgttcttaccgaggatgttggtggctacagggatgcctgcactgtacgtgaggaaaaaagtgattgcagtaacaatgaggatcaagaccacgccatgccctaatcgccgaatcatgaaagagaacaacattcgctcctatgaagggtggcgtggagcgacgctccacgccacctaactgatgcttttatgaacctgcaggggcgaagggccggacagtctggccattcaccaagggcgcggtgtacttgacgtccttcgtcacggcgtagaaccccgaggtgtatccgatcggcgcagcccagccgtcctcgaccaggtactcgttgaccgctcgtaatgcctcggtctgtttctcaacgggcgcgctgttcgcagccttcatcagctcggtcaactcgggagtcgtgtgattgaaggtgttgaatattccgaccaggcttgcagtgaggtcctgggcatcgttgcttgtgagcccgttgtagaagaagaacgccccgtagttgcccgtgaagatcttggggaacagatcctggaattggatgggttcccacgtcacggtgatgccaatgtcgccgagggcttgcgcgatcgctgactcgtacgtggtagtaagagcagtactgggcatcttcatctcaaacccgtcggcataaccggcttcggccaggagtttcttggccgcttcgggatcgtagtcattgaccttcagaaggtcttcgctaaagacctcgccgcgtgggctcaccagctggttggagggataagtgccgccttcaccgagagactccgcaatcagtgatcggtcgaaagccatgttgactgcctggcggacgcgcttgtctttcagggctggaatgatgtccccgtttcggtcgatcagccacagcgcggcgatacccgagggtgtgccttctccaacagtgaacttgtcttcagggaactggctcctctggtcagcggagatgttgacgaagtcgagctggccggcctgcatggcgttttgctgtgcaaccggatcttcgatcacccggaactccacggtgtcgtaggggtatgcctcggcgttccagtaacccgggttccgcttcagggtgtagacagcaccaaccgtcgtcgaactgtcatcgatcacgtagggcccggatcccacgggcttcagcttagaactctcgtcggtgagcaccttcggagaaccaacagccccgatagttccggtcaggatggggagcagcgccgcatccggctcagacaggctcaggaccacagttgatttgtccggagcttccacaccggcaatctttgtgagggaactggctgtggtggggccttttcttgccacctcgagggacgcggccaccgcactggcgtcgaccggctccccatcagtgaatttcatgccctcacggatcttgaaggtcagtgtcttctggtccgccgagtactcccatgtctctgcaatcgcagggacaacgcttccgtcgaggtcccgaccgacaagggtgtcgtacaccgagaggaacatgtaggcctcaccacctggccagttcccgatctggaagtttccgggggtggttgaaagtggcaactgaagcgtttgaatcttggcttcacttgcatctggtccggcgtcgcctgtcgaggagcatcctccaagcgttagcgctgtagcagcggcaacaaccgccgcaagacgcctatatctcattttcacgttgactaccttgtctgctgtggaatgtgtggctaccggcctgactgccggcgtggagcggaatgcaaactagcgcgcgctacttacttagctcacccgactatacgggcggtaagtagcgcgcgcaagtgatttcgtgagactactcacatgcacatcggaggtgtgtctgtcgagatgagtagtgccaccgcaaacaggagtctgagccatgatggacacccgcccataaaagggtttgcgacggatgctgatgcaccaactgggccagggacggccctgctgccgggatggtccctcagattgtgcttctcagctcagttctcgtgattgtggatggcttagcgcatattccgcggccacctggcctcttcaaacaggagccgagtgtgcaatttgttgttgcacactccttcctggtcaatcgttgtgcggaacctgcgagggtcgatcactggggtcgctggtctgagtcgggtcctggtcctcatatgtggcaccctcggggatggggacggttgtcgctagcgggatttccttgacgaagaacagcagtaccagagcgacaagaaccaagggcaccaggaacaggtacacgggccccagcgcttccgcgtacgcctgtgcgatagcatcgtgctgctcaagtggcagggcattgatctctgcaggggtcaggctttgagcgccggcagagcctgcgggggtcaccatgtcttgtgccaaggcttcggtgaggcggcttacgaacaggctgcccaccaccgctgacccgacgctggcgccgatctctcggaagaaggcattcgcgcctgtcgcggtgccgaggaggcgatgtggtaccgagttctggacgatcagcacgaggatctgtacgcccaatccgagtcccagtcccagaattcccagatacaacccgctctgccagggagaggtgttggcggtcatggtcgagaacaggatgagcgcgagggcgatcattgctgtgccgacgatgggcatccatttatagcgaccatacttggagatcatgaagccgctgccaaccgcggtgaagagcactcctgccagcatcggcagcagcagcaacccggattcggttgcgttaatgccgttcacgatctgcaggaaggtcggcatgtagccgatggctctgaacatcgcgacgccggtcatcagcccggcaatcgtggtgatggtgaagttccggtcccgaaagagggacagcgggatgattggttctgccgcacgcgtttccgcccataagaacagtgcaatggaagcgaccgtgatgatgatgatcgctatcatcgcgggcgagtcccaggccagttcggtcccgccccatgatgtagtcagcaccaggccggtggtgcccagcgcgacaaaaactgtgccgaggacatcaatggatggcttgcccctgcccgtagggggaaggtggatgaacgcagctgcggcagcgatagccccgatacccagcgggatattgatccaaaaggtccagcgccaggagaggacatcggtgaaaagcccgcccagcagcgggccgatgaccgaagagaccacgaacactccaccaatagcggccccgtatttgctccgttcacgggcgggaatgatgtcggcgatgatggcttgagcgaggatcatgatccctcccccacccatcccctgcacggcgcggccagcgatcagggcctccatgttcgttgccatgccgccgagaattgatcccgcgacaaagatgatgagggcagcaaggaagacactcttcctgccgatcaggtcaccgacttttccatacaccggcatcacgatggttgcgccgaggatgtaggcagtcgccacccagagcatgtgggtcacaccatcgagctcacccacgatggtcggcagcgccgtaccgagaatcgtctgatcgagcgaagacaggagcatcgccacaataagggcgatgaaaaccgggataatcctggtttccttggcaggtcgcgcttgtctgacgcttcctgcggtagcgctcacggcgcgtccatcccgcgaacggcagttgtcatctcaaaagcttctgcaaaatcgcccagcggcccgttgggactatctggtagttgctgaagcgtgcgcctgaccggcggtgcctgtactgacgtttctgcgggggtctgcacctcgacggaaacgatgactgccggcagccctgcagcgctgacggtgatctcgacgtgccctggagcatcggggcggatgatcgccagcacgcgaccgtcgtacgtgccatgcgtttcctcgtcgaaccgttccgtggtggcgggccgcccgctgccaagggcggccagcgagcctggcccggaaaccgcgaccgtgaccggccggtctgcatcgttcacgaggttgccgtcgcggtcccgcagttcgatttcggcgaaaacgagcgctccgtcgcgcagttcgatcaccgatttgtccagccggacgtcgagcatgatgtcttcggatgctgatcgcagttcggtgcggctcacctctgttcctcccatgagggcgatcgcggtcagctcccccttctcgtacggaagctcgaagtccgccacgaacgcccggtggctgccgacggggttgcgggccacggtacggccgttcagccgtagctcgatctcatcggcgtcgctgtagacctccaggatcatcggggagccctgggcgatgttccagctccagctggagacggcgtcggtccagctccattggccgagcgtgaagttgcggccgtggttggcagggcggcggacagcgatgtacggtgtggtgcgcaaaccgaagacagtctcgcggtagaaggacacggtcggcggcacccggtcatgtcgaggtcggccgaccaggaggtgagccacgggtactcaccgtcgaatgcgtccgattcgccctcgtaccggacgcggccgacgccgacttcacccaggtagtcccagccggaccaggtgaagtcgccgatcacgtgcgcgttgtcggtcacgagcttccagttcgcatctatccgggatgggaacgtctcggtgccgacgacgatgcggttggggtgctcgcgcgcctccatctcgtaccgcacgtcgccgtagttcagacctacgacatccaggagggcgaaggactcagccgtggcctcggtcaccagcggtgagaccatggcctggtccatgaagtctgcggtgtttcccatcagggcgttgactccgccgtcggctgcgtcctgctcggcgtgtgcggtggcctcggcaatcattaccgccatctcgctgagggccgagacgaacccgttgatcccgttggtgatgaagcgcgtgtcgtccagctcgcggatcttttctgcgagcttgcgaccccactggctgccgatcgggttcccggtctccggaatctcgttgccgatggagtacaggatcacgctggggtggttgaagtcagcggcaatcatcgcttcgacgtcgcgctcccaccactccgggaaggcgagggcgtagtcgaagggcgacttcgattcgctccacatgtcgaaggtctcgtccataacgagcatgccgagcctatcgcacgcgtcgagcatggcggcgctcatcggattgtgactgctgcgaatcgcgttgaacccggctgctttcagcaggcggacgcggcgttcctccgcatcggcgaaggtcgcggctccaagtatgccgttgtcgtggtggatgcaggcgccgcggagcttcacggtctcgccgttgatacgcaggccgttgtccggatccagctgcagtgtccggatcccgaaaggggtggcgcgaatttcaggctcctcgccgacgccgtcgaggcgggtgcgggcggagtagagcgccgggttgtccacactccaccgctgggggttcggaacgtacattctctgacggacgacaccgtcggactggggcaggaccgtcaccgggctggtctcggcagcgaccacgcggccgtccgggtcgaggatctccgtcgtcacggtcgccgtgctggtggtcagtcccgcattccgaacacgggtggccgaagtgatgacggctcggtcactgtcgatgtcaggggtcgtgatccggatgccgccctgctcagggatgtgcatgcggtcgctgacccagaggtgcacctcacggtagatgccggcaccgctgtaccagcgggagtcatcgtgcgctctggcatccacgcggatggtgttctcggccccgtacctcaggtggctgtcaagggacaccacgaaggctgcgtacccgttgggacgctgggcgacgaaggcaccattcacgtagaccatcgcgtcccggtagacgccctcgaactccagggccacgtgcttgcccgcccactcctccggcacgtcgagcatcgtgcggtactcgaaggcgccgtcgggaaagaacgccccggccgcgccactaggggcatcggctcgacgatccagactgaatatcgcgtcatggggcaggcggatggagtgaccggactcggcctggccctgaacgtcggcaaagatgcttgtcttgcggcggcaggaccagcccgtattgaaaggtgtgcgcgtcatgactgtctttcttctgggacgagggtgggaaggaggatcaaccgatggttcccggcggtgaccgctccgtcgcccagaagggcgcgaggagtgcggcccggccggcggtaccgcttatcgccgtcgttcgaggtacgtcagtatcgaggctgcgggtttgggcataccgcccaacagggaacttgaaggtggctggtagcgagagatccacgccgtcggagcgcagaggcccaggagggtgctgctgcgccgctccggaacaaggcgtaataaggggaagggctcggcactgcgacgttacggaggggcttctgggcgtcagaagtgggttccgccgtcgatgcggacctctgtgcctgtcatgaacttgccgtcgtcactggcgagcatggctactacgccggcaaccgcctctggccctgcgaacccctcccctagtgctggggtgagcttgccgaacaagctgaagtctgcgtcctgaggaaggccaggaccctgactttgtttgctctgaccggatccgtccgtcataccggaggagattgagccgggctggacggcagtgaagcggattccgtcttttgcatactcggaagccagcgcatgcgtcattgactggatgccgcccttgctcgctgcgtatgccgccatataaggatgagcaaacgatgccgaggtggaagagaagttgactactgccggtgcgctgctggcccggaggtgagggatggcttccctgatgaccaggaacgttccgaccaggttgacgcggatgacctgctcgaacaggtcgagcgccgtcttctcggtatgcgaagaacgcagaatgcctgctgcattaatcaggacatccaagccacccaatccatcaactgcctgagcgagaccctgcttcaccgattcctcatcaccgatatccatggtgagagttgtcagctgccccgacagggggccggctgctgtcctggtgtcttccaggcctgcctccgatacgtccgcggcaacaacgcgtccgccttcggagagcaaacgcagcacagtagcctgtcctatgcctgatcccccacctgttacgagtactcgacgcccgtcaaaacgattcatgtttctccctgcatgtattccagagcccgataggcatttttatctgcggtctatttccctgatctcgccgtacggaacgtccaggctgaggcttagggtgaactcgtgtattgaatttctcgtgatgagaattcctcggtctccgggtagagccgcacgatcgaccagcagcgccacgttggactccagctgcacgtccatctcatggcggttttcaaccgcaacttcgattctgtcctcaacttggacacccgcgatcatgggtcgatcccttcaacttggcaattgcgtcaccgctcacacggagcggtcttttgtcttctgacttaagtccgggtctgcttgcggttcagctcgcgtgaacctgttctgtttggatggtcttttctgcgcgcaggtcatcactggcgaacccgatcatgatggtcacatcgccggcttcaagcatccgctggtcctcggtgatgctgtaggcgagtcgggaaagagggatagtgaaatcgagggtctcttgttcgccggcgggcacggatatcctctggaattcgataagttgccgtaccgggcggacgattgttgcggcttcgtcgcgtgcgtagacctgaaggaccgtatctccgtcggtggtgccggtgttgtggaccgttgcccggaccgtgacttcttccggtgtcactgtcacttcttcgagtgttgcctcgaatgtggtgtagctcagtccgtggccgaacgcgaacaggggcgagttcttggccagatcaccatagccgtgacggatgccggtggggtgggcgtagccgcttccgtaccggtggccgtgatagagcgggatctggcctaggtggcgggggaacgtggagggcagttttccgctgggattggtcttgccgaacacgacgtcggccagggctggccctgcaagttcaccgagcagcggggcgacgattgttgcagctgacgccccgacgacgggttcgatgagcagtggccggccggtgatgatcacgctgatgacgttcttgcccagtttggataaggcaagtatgagttgttcttggttgcccggaagggacacacgggcgctggtgcggccttcgccggctgtgtggtttccgacccatccggtgcgctcacccacgactgcaatgacagtgtccacgccctcgaagcgggtggcaagctcatcctctttgattggttcagcgtcctgctcgacgctgccaatgcggtggtactccgtgtctggtgctgtccggtaaatcgcatcgatgattgtcacggcgtcggggtggatctcgcgggcctgggcttcgaatgcggtctcgattccaggtagccgggtctggaagaggtcggtgaaaatggcgttctcggggtcgattcccgggacgttgccggtcatgatctccatgatgccaaggggctgctcggcgttggcgacagctgtgtaggcaccaaaatttatccggatctcattcgcgagctcgccgaccacggcaatcccccgtgcagggttcagcggaagggttccgtcgttggccagcagcacgatgctcttgttggcgatcgtgcgcgccagggccgcggcctgctccggctgcggtacccgtgccggccggagtttgggccgtggtgtcacctccggtatcagaccgagccgggccttgatagccaggacgcgttcgacggcgccgtctaggacctgctcggggaggcggccactggtgacttcttcgtgtagagatccgaaggtttcgttgccggggagttcgacgtcgactccggccgtgagtgcctggtttgctgcctggccgggtgttgttgctgtgtggtaggtcttcaacagcatgctgatggcgtcgtaatcgctgacgacgaggccgtcgaagcccaaggtgccacgcaggaggtcggtgacaagccaccggtcagcggccgagggtatcccgtcgatgtcgttgtaggagttcatcaccagtgacagattggcttcgcggattgcgcggcggaagggttcggcgtagacgtcggtgatggcgcgccggcccaaaggtgaggcggcctggttcagggcgccttcggacgcaccatacccgaggaagtgtttggcggccgagagtacgccggagtcattctgttcgccgtgtatgccgcggatgtaggctgttccgatttgggcgatgagttcggggtcttcgcggtaggtttcgtggacgcggccccagcgggggtctcgagcgacgtcaaggacgggcgcgaatgcgaggtggaccccggcggagcgcatttgcgcgccggcggcggcgccgacattccggaccaagttagggtcccaagtcgctgcctgcgcccatgcggtagggaattgaaatccttgaacatgcaggaagccgttgatcccttccccgtggatcagggccccgataccgaatgggcttgccgctttggcgtgttcctgaagctgcgccaggtcctgccggaagccatcggagtgggggttcagtagccaggtcagggaaacgtgcccgactccgtgcgggcggagctgttcgattctggacagatcaaaactggccatcgcctcggaggcgtgatccggagggttgtggtcgatgagatcgaagatggagatgccgtgcagctgtgcgatcttctggtctaggtccagacgctggacgagggaggaaatgtcagtcatgggcttccttcagtcaatggaaatgttctcccaggcatggtccgagcagtcagaggatcaagtggttgagtcagcggtaagggtttgtattgtttcctcgggcgacgtacatcagcggtacaccgaacttcggcgacttctgccaggagctgtgaaccgccaacggaaatcagggatgcggttgccgaatccggcggggtggacgagcgcatcgactctcagcccgtggaagatgagcggccatggcactgatgccgacgaatgtttcctggaacggcccgtttcggcggacgcgactgttggtccggcttcgttactttgcatagaggactccgttgtcattatggattgcggatgcatccaggacgagctaaccggaagactagcacgcgctagtttggctgccaagaacctgacgcagcttactcaggtgggttgcaggggcgccgaagctgcgcttcggtgatgtccttgacgtcttccccgccggcggggtagaggggtgggctgggacagcgagcacaaaccaacagctatgagcacatccgaggccggggatttccggatatccgccagcaggaaactctccggagagccctcgaaggttaggttgattcgcgccggataagggcagcgatcagggctgggtcctcagcgggcacgacctctccatggatcgcgtttagagcggtcatggctatttggcgtccaaggccttcaatatccagccggattgtggacagactggggacgaagagctcagcccatgggttgtcgtcatggccaataatggccagttcacccgggacggagatgccttcacgcacggcggcggcggctacggctgcggcagtttcgtcgttgtaggcaaccactcccgtaacgcggttttccaaccattgcctaacggccggacgtgtcgatgagtcgtgcaggttgatgcggcgataatccggcgcatccagccccagcttcgtagtgttgtcccggacgacggagaatcgcgcctcgatgatggcggcgagccgtgcatcgtcaggtgccgcaaaggcgatcctgcgatgcccgaggccggcaaggtgcttcacctgaagctcagggccggcgacgatgctcgggccggtctgccatgccatcggttcatacgacgggtccgggatgatagtagagatgccgctcgcccgcatcgatgccacatcgcgttcagaaaaagggagtaggcccatcaccgcgtcaggatccagggcttcccaaaggggtcttactgcctcgcgctcgtgcagggtgtacgtcacgagggaatatccggcttcctccaggaccctggaagcttctgcgacatgacgacccagactgtgctcgatcggccagttaggcagtgccagcagaatgattctgctgcgtccccgtgcgagggcctgggccgcagtgtgaggtcggtagccaagacgctccgcctcggcgatgacccgttgtcgcgttgcctccgagatcgtctgaccccgcgtgttgttaaggacgaagcccaccgtcgctctggagatgcctaaggacttggcaacgtccgccgcggtcacccggcgattcttcgtctctgcagtcatgccagaatcctaccttgcgcgcgctagtattgtcggctacgatctttcaaaagctagcacgcgctagcgatgtagatcacttttttcgcatcgacaacggagtcatattcatgaattctccaacgggcaacaccgcgcattctgacgcgcctttgcctcacccgctcccccagctggatgtcctcccggatgcccccgaggctgcaggcacaccatctgcagagccattgactccggttggtaagaaatacatctggttgatggtgcttgcccagttcggcgtgttcgtagccttcatcacgcccttggccatctccttggccatccggctgagccagctggcgccgggacgcgaggaatacctcggctacatcaccggtgcaggtgctttcgccgtcatgctcaccgccccgtttttgggggtagcaagtgaccggacccgtacccggctcggccgccgccggccgttcatgatcggtggcatgatcctcggaatcatctccttggttgtcatggcggttgcccccaccgtgcttgtgctgggagcaggatggatcctcgcccagcttggctggggccaggtactgagcaacctgcagatttccactgctgaccggctgcccgagagccagcgtggcaaggttgccggccttaccggttttgcgacccaggtggcacccgtcgtcggcgtggtccttgccggcagcttcaccaccaacaacctgctgctcttccttgttcccggcgccctcggcgtgctcctgaccctcctgttcgttttcctggtacacgaaaaggacagccggggcaacacgttcgaggaaaagctcaacctgggccgtctgctccggaagtatctttacaatccgaagcagtaccccgacttctcctggaactggctgggtcgcttcctgttctactttggcctgaccttgaacaccacgttcaccgcgttcttcttcgcttcacgcctcggggtcagcgtcaccgaggtggcggggatcatcgccatcctctccatggccggcatcctcgccacaacagccggtgccatcggcggcggattcatctcggacaagttacggcgcaggcgcgccttcgtcttcggttccggcatcatctttggtgccggcgccatcgtcatggcgttcgccaccgacatgccaatgcttgcagcaggttcgctgctcggagcccttggaatcggagcgttctccgcagtggaccaggcccttctcctggacgtccttcccgaacgggataccgacgcaggacgatttatgggcatcacagggtttgccacctccatcccccagtcgatcgcaccgctaatcgccccgctgttccttgcggtcggtgtgaccgcaggcggggagaagaactacgtcctgctctatatcatcgccgctgcatgcaccttcttcggcggactggtcgtcctccgcatccgctccgtccgctaaaacatccacgttatttgaggaatccgctatgccccgcaactggaccggccagttcatcacccccaccacctcccacggccaggagaacgacccagccgtctacttccgccgcgaattcgacgttcccgaacccccggtacgcgccaccctgcacatcaccgcactgggacttgtcgaaccccacctgaacggggcagtcgtgggcgatgaagtcctggctcccggctggacctcgtacaagcatcgcctggcagtcagcacccacgacgtcaccaatgcaatcgtgccaggaaccaacgtcattggcgccattatcggtcaggggtgggcaatcggccgcttggggtgggaaaacaagcggcaccactacacggaccgccccgcgctgtacctggaactggtccttgagtacccggaccggactgaaacgctcaccagcgacggctccttccgggcaggaaccgggggcgttcgagccgacagtctttacgacggggaagacttcgacgcccggctcgaatccgacggctgggaccagtccgggtttgatgactcgacctggaatccagttgaggtctttgactggccccttgaggcgctgttcgaagccacggccgatccgatccgccggatcgaggaaatcgccccggtggagatcctcaccactcccagcggcaagaccgtggtggacttcggacagatcatctcggggtgggtgcgcctgacggtggagggtgaggccggtactgtcgtcacgctccggcacgccgaagtgatgacggacggcgagatcgacgtcgaaactctgcgcaccgcaaaggcgaccgataggtacacgctccgcggcgggaaccccgaaacctgggagccaaggttcaccttccacggcttccggtacgttgagatcgccggctggccaggaactgttgaaccggattccttgcgggcagtggtggtccattcggacatgcgccgcacgggctggtttgaaacgtcaaacccgctgctgaaccagcttcacgccaacgcggtctggtccatgcgggacaacttcgttggcgttcccacggactgcccgcagcgcgacgaacgtctgggctggaccggtgacctgaacgccttcgctcccaccgccgcgttcctctatgacgtacgcgccgtgttgggttcctggctggaggacctcgctgcggaacagacggagaagggcttcgtgccgtgggtggtgcccgacgtcttgtcgaccccgtcctcccccaccgcgttgtggagcgacgtcgcggtcagcctgccctgggccctctaccgcgaatacggcgacgaaaccatcctcgcgaacgcctacgactccatggccgccttcatccgccaggtcgcaggcctgttggacgagaacgggttgtggagcagcggcttccagtatggtgactggctggacccggacgcccccatggacaacccggcaggcggcaaaaccgacaggcaccttgtcgcctcggcctacctgtgccgcaccacccgcgagatggcagacaccgccaggatcctcggccgggcagccgacgccgaagagttcgctgccctcgcggcacgcgtcagagaggctttcctcaacgaatacgtgaccaggaacggacggctcgtcgaccagaccgccaccgcgtacgcccttgccatcacgttcggaatccttgacgccgaacagcagaaggtcgcgggcaaggtccttgccgccaccgtggccaaatccggctaccggatctccacaggtttcgccggcactcccctggtcaccgacgcgctctccatgaccggccacctcgacgaggcctacctcctcctgctcgaaaccggctgcccgtccttcctctatcccatcaccatgggagcgacgaccatctgggaacgctgggactccatccggcccgacggaaccatcaatccctcaggaatgacttccctgaaccactacgccctcggcgcggtcgtggactggatgcaccgcaccatcggcgggctcgtcgcgctcgaccccggctaccggcacatgcgcatcgcaccccaacccggcggaaacctgacccacgcgaagctgcgccacgacaccgtccacggcgaagtacgtatctcctgggccatcacggaccgaaccgtgtccctggaggccaccatcccggccgggacaaccgcagaggtcacgctcccgctgcaccctgactcccagaccgtccacatcagcggcggcacccaccaatggtcctacgacatggccgaagacgcagccgccgatactgtcttcaccctggattcaacgctggggcagatcgccggcaacgcccgggcctggcgcgccttcaccgacgccttcgccagccacttccccggagtgcccctggacggccgcgcacctgaggcggccgtaatgtccgtccgaacgatgctggactacgtccccggcgcctccgacgagctcaaaaatgacctcacttcagcactcatctcagcttcccaaggaacccacgtatgaccgccgatatttcctcgctgaccctcgaacagaaggcgtccctgttgtccggaaaagacttctggacgaccaagagcatcgacgacgccggaatcccgtcgatcgtcctgacggacgggccccacggtatccgccggcaggacgccgaatccgatcacctgggcatcaacgacagcctcccgtccacctgcttccctcccgccgttgctgtggggtcgagctgggacccggacgtggccgccaaggtgggtgccgccgtcggccgtgaagccctcgctttcggcgtgtccgtggtcctggggccgggcgtgaacatcaagcggtccccgctgtgcgggcggaacttcgagtactactccgaggacccgctgctctccggcgttctcggttccgcccacgttaccgccctgcaggaaaccggtcccggcgcctcgcttaagcattttgcagccaacaaccaggaaaccgaacggatgcgtatcagtgcagacgtggatgaacggacgctgcgcgaaatctactttcccgccttcgaacgcatcgtcaccgaagcccgccccgccaccgttatgtgctcctacaacaaggtcaacggcgtctacgcatcccacaacaggtggctgctgaccgatgtcctgcgcggtgactggggcttcgacggcgccgtcgtgtccgactggggcgcggtcagcgaccgcgtcgcaggcgtcgccgccgggatggacctcgaaatgcccggcagcggcggaggcaccgaccagcagatcgttgacgccgtccgcgatggaaggcttaccgaagatcaggttgacgacgccgtacgccgcgtcctcaccctggcagccctgcacagggaagccactgacgatctgccggttgacgagcaccacaccctggcccgcgaagtcgcagcagaatcgatcgtgctgctgaaaaaccaggcagtcctgccgctgcgcggcggacaacgcatcgccgtcatcggccccttcgccgtatctccccgcttccagggcggcggaagttcccacatcaacgccacccggactgactcggcaatggacgaactcacggccctcgcaatggaccgcaacgggacaatcgattacgcagccggattctccctcgaagaaccggacgccgcgctgctaaaggacgaagccgtaaacctcgcccggaccgccgacatcgccgtgatctttgccgggctcagcgaacgtgaagagtccgaaggcttcgaccggacaggtcttgaactgcccgccaaccaggtcgaactgatccgcgccgtcgccgcggcagcgccgaaaacagttgtcgtgctgtccaacggaggcgtcgtctcgcttgaaggatggcatgatgacgtcgacgccatcgtcgagggctggctgctggggcaagccagcggcggggccctcgccgacgtcctcttcggtatcgtcaacccctccgggcggcttgccgaaactatcccgctgcgcctcgaagacaaccccagctggctgaacttcccgggagaacagggacacgtccgctacagcgaaggggtcttcgtcggctaccgctactacaccaccgccgaggtaaaggtccgctacccgttcgggcacgggctctcgtacaccaccttcgacacctccaatgtggaagtcgagacgctaaccgacgacagtgtcaccgtccacacgaccgtcaccaacaccgggaaccggcccggcaagcacgtcgtccaggtatacgttgcaacagcagcgggtccggtccggcggccccttcgtgaactgcgtgccttcaccaaaatcagccttacaccaggtgaaagcaagcaggtcgcactgaccctggaccgccgggctttcgcctactgggacatcgaactgggccgctgggtggtaccggccggaacatacaccgtacaggtctgctccgacgcatccaccgtcctggccgaacaggacaccacccttgcaggcgacagcatcatccgcgaactgaccctggactccaccgtcggggactggttcgcccatcccaccgtcggccctgcactcatggccggcctcgccgcgtccatgaccgaagagcaagcccagcaggcccaagagaacccagaccaactcaaaatggttgagtccatgccgatgcagcagttccttgccttcaccaacggagccttcccgcctgaagcccttcactcactgatggagctcagcaggacggaaaccgcagcctcatgacgacggacaagacgggagccagttccaggacggccgcccggacccgtgtttttctcaccggcgcaacgggcaactggggacgcgccacgctccgggaattcagggaacgcggggaccggttcagtgttacggcgctcgtgctccccacggaacgggaccgggccgcgctggagcaattcagcgacatggagaacttggacgtggtctggggagacctgaccgacccggcagccgtggagcggtgcgtcgccgacgccgacatcatcctgcacgtcggggcggtggtctcccccctcgccgaccagcaccccgaactggcccgcaacgtcaacgtcggcagcatgcgcaacatcatccgggccgtcaaaaaccagcccgatccgtcccggatcaaagtggtcggcgtcggatcggtggccgaaaccgggaaccgcgccgttccccaccactggggccgcgtcggtgacccgatccgggtctcaaccttcgatgaatacggacaaaccaaagtcatcgcggagcgggaactggtggactccgggctcccccgctgggcctggctccggcaaaccgggatctttcacccggacatgctcaccatccgcgaccccatcatgacgcactccaccctggacggggtcatggaatgggtttcggtagaggactcagcccggctgctggccaacatctgcgaacccgcggtccccgaggaattctggggcgggatctacaacattggcggcggagacccgtggcggctcaccaactgggaacttcagaccgccgtcgccgacgcgctgggagtaaaggacatcaggcggtggtatgaccgcaactggttcgccaccggaaacttccacggccactggtacatcgacagcgaccgcctgcaagcgctcgtacccttccgccaggacaccttttccgaagccctgtcccgggccgtcggctccctgccccctgccgtaaagtctgccgggaaagtccccggctggctcatcaagcacctggtcatgaaacccctgacccgccagccacgcggcaccatgcacgccataagctcaggcaacgccacggaaatcaacgcccacttcgggtcccttgccaactggcagtcaatcggagattggtccacgttccagcccccgacgcctaaccggacaccagtactgctggaccacgggtacgacgaagccaagaaaccctccgaatggaccgaaacggactacagctccgccgccgaattcagaggcggccaactgctcacccaaaacatcgccccgggacaatacaccaaaccgatcacgtggaggtgcgcattcggccatgccttcggtgccagcccccgcctggtcctgacggccggccactggtgccccacctgcgtcgccgacactgccagctacccggaccaagccgcgcggaatcctttcctcgcccaacttatccaagccccggaacaaccagtccacatagcggcggcgggcagtgcagccggtacaccaaacccgaagccctgaccccgctgaggaacgttcacaacacccagacacggaaaccccaaagaagcaagaggcaggaacaccgtgaaacccaccgaaatcatagtgaaccgacgggcggccggagccggcaccggcacaacccccagtagctggcaaccggtagacgactgggggacgctgaatggctgcctggtggaaatccaccatcgcgggcaactggtcgacttcgggacagtcgaatgcgtcacacatgacggaagcctcctctggctgcaccaaaacggggcaattccacgacggatcatcgaaaaaagccccgatacctatatccgcctaacccacgtcacgccggacgaaggccaaaccatagtccaatacaacggagacctggataacgcgatggcatgtaaggacatccccgccgcctaggccaatcccttgccctgaacggtttcgtccagaaccgaagtcccactgctcagtaagaacatcgcgcacctcataagagataaggaatgctcatgcacctccacagcagcgtacgaaggacagcggccgccctgggcgtcgccatcactgcggccgccttggtcacggcgccagctcaggctgtcccagaagaggcgccgggtcctggaacaaaatatgtagcacttggcagctcctacgccgccggggccagcgtcggccctgccgacccaagtgacaaggacggcttgtgcggccggacaatgattgcctaccccaacctcgtagcccgaacccttggcctggacctgactaacgccacctgtggcggagcgaccaccgacaacatcacgaccgttccgcaaaaggtctcctaccccgcttcagggacgctggccccccaaatcaatgccgtgacagcagatacagacctggtcaccatcacaatcggtggaaacgacgtcaacttcgttggaaacctttatgcggagtcctgcctggcggacctcgcagccaacccctcaagccccctaagtaacgcgttgaaagagtacgggctatgcacgcccctgcctgatgaaaccgttacctccgccctcgccgcaatggagtccaagctgacgcgaatggtggaggcggtgcaggccagggccccgaaggcacgaatcatcctgatcgattacccggtcgtgctgcccgaaaacggcaagccctgcagtgccgtaccaatcacgcaggagcgccagaaattcctgaaccaggtcgcccggcaactaagcaatgccaccaagcacgccgcccaaaagacgggaaccgaattcgtcgccgcctcaaaaaacagccgcggccaggacgcctgctcaaccaccccgtggatgacgggctacgatttctctcccggagtagccgcaatgcaccccaacgaggccggacacgcagccgtcgcagccgccctcacccgacaactgaccacagcaggcaaggcatcctaaccccagaggacgtgcaagccaagggagcccaagcttcactggagcaacgaaccggactcaacccggggaggtgacctgaaactttcccggctgctgagacgtccatcgatgcggtagcactggcgaaaagccctcagccagtgctaccgcgtcggggttagaagaattcagtattctcaaactttcgtatgggtcaacagatctgcaggtacaacgcactatgctgcccttcaggtagagggtggtctataaagtccggattgcaatatgacgtaccaaaaaccccgaacatcaaaacgaacgttgcccaagctcctgtcatagaagggttgcattaatgtcgaaaagagcaaccgcagtgcagctgcttttggaaaacctggaagtacaagatgaggaagtaacgggccggcacggaggcatctacatcaggagatacacaccagaatcccaggtacgcggcaagctcgtctgggtccatggggccttttcgggtggggggctggagcatctcgagtcacacgcggccgctgccgcactcgcccgccaaacagcaatggaagtcgttaccgtcgactatcggcgggtacctcaatggaacccaatgcgagacccgaggctccctctccccccgggcacccgattccctgttccgatggaggacgtcatggatgtcttccacaccatcaacaccgagcacgaaaaagtattgctcgggggcgcgagtgctggagcatgtcttacaaccgctgcgactatgaggctgcgcgatgagggaaaacaacaaccccacgggctgttcctcgcgtacgggaccttccacgcagcactcccttcgctctcacccgtcctccaaaaacgggtacgaggccaccacgggattttccagttccgcccctcaacagtccgccgtatgaacctcaactacgcaggatccaaagaagccatgagccatccccacgcgtttcccggcggccatgacctaaaagggttccctcaaacactcgtccttgacgccgatcgagacaccctgcgggcatcgggggaagccctcgcaacagaactcgcggcagcgggggtaaatgctacctaccaagtaatcgcggaatccacacatggctttctggatcgcccccacaccgcgtcctttcgcctcggcatcgcaaccgtgagcacttggctgaaggcaaattctcgatagtccctggcactcccaacgtgccacctgcatagaaacagtcggcgcggaaaagggcgccgggcacggcccgatgcaagcctttgagtaaaaccagaatcacgaccccaccccgttcccgaccagcaggaaaaccgatgaacaccagccagcacaacaagcaaaagacagccgggacgcaacgaaccggcgtgactatgcgcgtcgtagcccaggcggcgggagtctccattgcaacggtctcaaatgtgattaaccatccgcacctagtggcaacccggaccagggaacgggtccaaaacatcgtccaggagatggacttccgacccgatccacatgcgcgggctctacggggatatgagtcaaccaatgcgaaacaaagctccacccgccccgacaacgtccctgaaagtgatgaggttcctcaacggcagacagtgagctctgccgccaccccatcgtcggtcccctcacgtccccgcctcaaccctgaagacctcgtacccgggcagcatctcaacctccaagttggccttgagaaggttcggggcacgatcgacgcggtaatgcctgacaaatcctgcttctggatctggaccaataacgggatgggccgacggatgatcgacttctgcgaagcgactatcctcactagccgagactgaccataaaagccgctagctggtgcagcaggcaccaaacgtattacccagagcaccttttgctgtcgcggtgatcgccgtcctagggccgccacatccgccacattccgccggcctgtggacgttcctgctgacattgaccgtcgtggatgacctgctcgccacgataagcgtctctaacgccagatcgagtatcttggactattccgatccttcgcgagcttcctggcgccggcttcagtcctctccaactgtgaggatggcgtcttagaacatcattagccgctgtcaaggaaacggaacttcgcgctactctgacgccagcaggccaaggtgacagctgccgatcgctctgggcagctcgcgccggatccccaaggcgaaggccaatccgtggttgacggaatctccattatcggctcttaaagcacaggagtggaagtaggtgcgagaagtcctgtgtgctgaataattaggcgtgttgtccacatggtttgccgcggtagcagaagtcgtcccacacgtggttggcggctggcgctcctacacttaagtttgacatttccgaaatcaatagcccagtgccggcatttcgactcccggaatagaaaccgactttggtgcgttgattgatattagagggtgtctcgcgtcatcttttgttgcaagccccttggagatgcgcggaatttgtttttgggtgctgaaaatgatataatggagatattagggcaagagattaagttcttctttcggctcatttgccgatttgctcacaatctcaggatgcgggttcgagtcccgatggctccacttcaaggggccatagctcaattggcagagcatgggactgaactgaaaatggacccgcctttgattggcgggtccatttttttgcttcaaaaatcggctagtttccatcagcctttgcgccaaccatcgcctggcacgctatcgccgcattcgcggacgcagagtagctgcttggtaatgttggaggaacgcgtcagtgtacggattctggcagattttcaattaagttctcagcgtggtttcgggtggaggcttgaggttgcctgcctgcgaatgtgactgactcgccgagggtgctccaggccgcgcagcggatcgaaagcgcgctccgaaggctctcccgcggcggcattgagtggctaactaataccttcccggccacgccgcgagccggtcaacgatttacggaaatgacaacatgaatgagaaagaatccgccggttttgtctcatccaatctgtcagttcccacgtcgggactgacaactacattgagaacggacaatatcgttcatctgccgacgaagtcctgcgggcgggtggctagacgggaggtctcagctggctgtttcgtccaccatcattgcgagcatctcccgtccagcgccgtccactcatagatgccgtgtacgcaggcatcgaactcaaacagcttcatgcaccgccgacggcccagtagcgcagccacaattcccagtgatactggccgtcctgcgcaacgatccgtcgtatcttcagccgtggatcttcggtactgcacattcctcggccgtcactgcaggagctatatcaatcgttgaggttagaccggcagagtcatcagcagcgttcgacgttgaaacgcgaacttgcccttggatcggcttgccgctgcagtttcctgcatctaatgcatgtttcgatgggcgccaggtgctacgcttcggcgaccgttacgaaggtggcgagcttatgacagcgatggcaaggaagtcacagtccacccgtcatccgacaagacctctgaagtaccgtcgaaacggcggcggcacggtcgggagaggaacggccggggccgttagcgccttggtcgggtcgttgcgccggcaggatcagtggtggttgagctcgtccgagatggcctgggcggcattgcgcagcaccgggacggcacgctcggcgaaggactggtccacgcgggataccggcccggagacggagatggcggcaggagtaggcgcatcgggaactgccatggcaaagcaacggactcccagctcctgctcttcctcgtcaattgagtagccgcgttcccggatcctggctaggtctgccaggagggattcgatatcgccgatgctcttggaagttggagtgggcatgccggcgcgttggacgatgccgcggattacctcgtcatcaagctgggccagaatggctttgccgacgcccgtgtcgtgggtgtgggcacggcgtccgacctcagtgaacatcctcatcgaatgccgggatggaaattgcgccacgtagataaccatgtccgagtcgagcaccgccatgttggcggtctccccgagctgatccacgagggatttgagctgcggccgggccgcggcgcccaactggttatttgctccttcgccgagtctgatcagccgggggcccagggcgtagcggcggtggggcagtcggcggatgtagccaagagtgaccagcgtacgcaggagacggtggatggtgggtagcggaagatcggtcgataaggagagctggctgagcgtgacgtcgccgcctgcatcagtaatcagttccaacaactcaaaaacgcgctcaacagactgcacgcctccggggtatttctcagccatgagtctgtatcctgcgactcttcagcaaccagggcatcgcttcaggggcgcgtccgcacgcccagattgtggagtgtgcggtgcgagagtgccgtagctgttcaggcaatggcccgtctccgacatgttggattggtgcatcagagtccatgagactcatgggtcgaagtatgaatttttccggttgcttcgagatgttgactagtgagcgccacatagttttcggcgttcgctcggcagtgctcgatttcctcaggcgtaaggggcctgcggactttggcggggacgcccgcaacgagggaacccgcgggaacaatagtgccctccagcaccaatgcgttggccgccacgagtgatccctccccaataactgcaccattgaggacggtggcgttcatgccgataagcgagcccgcctccacggtgcagccgtgcaggaccgctccgtgacccacgctgacctggtcgcctagatgggcggggtatccgggatctgcgtggacgacggctgtgtcctggatgttgctgccggacccgacggtgatgcgttccatgtccgcgcgcaatacagctccgtagaagactccagatgcctcccctaggctgacgtcgccgaccacggtggcggtcggggcgatccaagcgccagcagcgagacgcggcgttcggccatttatggtgatgacgttgttgctcatgatggttctccaagggctatgaggtgtgggaataaggcaccaccctagtaccttctggcagccagtcttgccccacatttagtggaggggatcgaggctaatcatttcgtgcagatccacacctgttctacggctctttggttatcggtttgctcagttccgagcaaacaaattgaccacatcacatgcattcctcagagttagtgcatcaattcattcactaaacgaacgctgatcccacctaggaggtgcccgtcttggagcttcaaaccacaggcccaagaccgcacttgacgacacgatatctaccagccgaatttcagccgtcccctcggcagaaaagacatcacgggaacacaagacccgagcagaagaacgttggttcatggtcgccgaaccgctcaaaagctggtgttcgcaagcgtccagtggcggggcgcctgttgagacatggtgagggtgcggcgggaaaccagtgtagtgaatgctcagagcagctccgctgaggctctcgggacttgccaatcgccgacctgaagttgccttcccacaacctacgccgagcttcccgcagaactgacacggatgatctaacacccttggaccttctccgcatacggaagtaagtcctaatgtgcggccagcggtccgagtaaatggagcgcggccgtcgacgagagcagcgcggtgagtgccctcaggaactctctcgacctaactatgattgaaaaggagcgacgacatgtcatacccagccattgagcgggaggcggagttgcaaggttctccatttggagttactgatgaacaaagtaccgccggtgagcccgtccatgagctcgccgcggtactcccgcccgaggccctaattacggatcctgcagccatggggccgtaccaacaggatcgcgccttcgatcccaacgctggtatgccgattgctgtcgtgcttcccctgaccaccgagcacgtccaggtcacgatgcagtgggcggccaaacatcggattcccgttgtgcccaggggtgccggaacgggtctatccggaggagcaaccgctgtaagtgacggaatagtgttgagcaccgagcggatgcgcagcatcaatgtggacgcagtcacccgcactgcggtggtccagccaggtcttctcaacgctgaggttaaggcggtggccgctcaggcaggactgtggtacccgccggaccccgcgtcctacgagatctgcaccatcggcggcaacgccgcgaccaacgccggcggcctgtgctgcgtcaaatacggtgtcacctctgactacatcctgggcatggaagtggtcacggctgacggccgggtggtacgcattggcggaccgcggctgaaggacgttgcgggactgtccatgctcaagctctttgtcggcagcgagggaacgctgggcattatcacggaactcaccttgcggctcctgccggcagcgcctcccgcgcggacagtagttgggtggttctccagcagcggggatgctgcagccgcgatccttgaggtcgcctcgagcatccgcccatcaatgctggagtacatggatgcgacgtccatcaatgccgttgaagacgtgctgaatatgggcttgcaccgccacgcgtccgcccttgtcgttgcccgctccgatgatcaaagccctagtggtgccgaagtcacgaccatgctggcagccttccaacagcacggcgcgttcgaggcattcgaagtcgcagaccagcaggaaggtgagcggtttgcccacgcccggcgaatcgccatcccttccgtcgaacgtatgggcacgttgctgctcgaggacgtgggcgtagccatcccccgactgggagaactcattctcggagtagagaaaatcgctgaagcccgcgacgtggtcatcgcattcattgcccacgcgggtgacggcaacacgcatccgctgattgttttcaacccggacgacgccgccatgaaggagcgcgcatacctcgcctacggtgaggtaatggacctggccataaaactggaaggcaccatcaccggcgagcacggcgtaggccgactcaagcggccctggctcgttgatcaaatcggagaagacctccttgaaatctcacacaatgtaaaacgggctttggatccagcaggaatcctcaaccctggaaccatttttgctgcttcaggtactgccggcggcgctgcgaagaaaggtcactcgtgatggatcagacaggacgcatccaaagcggagggctctccgtcgacgcagctttgcactgttttgtcgagcaggaggcactgcctggctccggcatcgaagcggcagacttctggactggtcttgaacaaattgttcaggacttggcgccccgaaaccgtgagctactcgcccggcgcgacgaactccaagcccagattgacggctggcacgctctgcacccagttccattcgatcaacatgagtaccgatccttcctgcagaacatcggatacattcttcccgaacccgaagaagtacaagtacacactctcggagtggatgaggaaattgcccgcgtggcaggacctcagctgattgtgcccatttcgaacgcccgctacgcacttaacgccgcaaacgcgcggtggggctcactctatgacgcgctctacggcaccgatgccttgggcccggcaacaggagcaaaagaatacgatccagcacgaggcaagctcgtggtctcacatacgcgcgaactgctcgacgagttcttcccgctaaccgccggacgccacgccgattcagtgggatacaccgtacgtgacggcgtgttgacggtggaacttgcagacggcaccttgagcagcctgattcagtctgaactgctcgtcggctaccgaggggagaccggctcgccatcggcaatccttctgcgccaccatggactacacgtcgagatcactatcgacccttccacacaggtaggacagacggacccggcaggaatctctgacgtcctcctcgaatccgccattacgacgatcatggacttcgaggattccgtttccgccgtcgacgccgaagataagatcctctgttaccgcaattggctagggatcaatcgcggcgacctcgaagacaccttcacaaagggaggcgaagtgatggttaggaggttggcaaacgatcggcgctatacgtcgcctgatggcgcgggagaggtaacggtgccgggacgggcactcatcttcgtccggaacgtcggccacctcatgagcaccgacgccgtactcgatgcccagggaaatgagatcggcgagggcatcctggacgccgtcctcaccacgctaaccgcactgtccggtcgtgacccctccaaccccatgcgaaacgggtcccaaggctccatctacatcgtcaaaccgaaaatgcacggcccggccgaagtggccttcacggtggaactcttccggcgcgtggaggaacttcttgaactgccggcgaacacgctgaagctcggcctcatggacgaggagcggcggaccacggtcaacctcaaagcctgcatagcggaagcccgggaacgactggtattcatcaacactgggttcctggacaggtccggtgacgaaatacacacgtccatggaggccgggcccgtcgtccgcaaggctgacatgcgcaaccaagcttggatctccgcctatgaggatcaaaacgtcgatgtcggcgtcgaagtggggctgcccggccacggccagatcggcaaaggcatgtgggcgatgccggacctcatggccgcaatgctcgagcaaaagattgcccaccccctggccggggccaccactgcctgggtaccctcacccaccgcggcgaccctccacgccatccattaccaccgcgtagatgttccttcccgccagcaggacatcgccaatcagggccgccgaggcacgattgagggactgctgactctccccatcgcgggtaacccgtcatggtcggcagccgagcgccgggaagaactagataacaacatgcagtccctgctcggatacgtcgtccgctgggtcgaccagggagtgggatgttcaaaggtgccggacattcatgacgttgcactcatggaggaccgcgccaccctgcgcatatcaagccaacacatcgccaactggctccgccatggagtagtgagcgagcaggacgtgcacgaaagcatgcgacggatggcaacagttgtcgacgcacagaacgcaactgatccgctgtaccgccccatgtcttcaaactacgaggaaagcatcgcgttccagtgcgccgcggacctggtgttccaaggagccacccagccaaacggctacaccgaacccctcctgcacaaacgacggcgtgagcaaaagcgactcacccgatcagtagcaatccacaccgctaactcatagacctcaaggaacttcatgcagaactatgttgaatcactttcggtaagctacacggccgccgcccgggctgtttcgttggctcttgaggaagggtcaaagcgaggtgttatggtcgcagtcactgttgtcgacccgatgatgggcctcgtcgctttcggccgggcggacggttcgatgccccacagcgtggagaccagccgacggaaagccaatacggcggcatccactcggaggcccagcggctggatgcagggagacttcgcccttgcccttcccatgggcaccgataacctcctgacaaacattcgtgggggattcccattggtgttcgctggaaagcacgtgggtggccttggcgtcgcgggcgggacccctgaccaggacgccgagatcggctctgctgtgctggaggctctaggcagcgccctagcggcaacctgatccttcctgctaaaaacctgccggtttgccacaaggatcgctccaattagtacgtgtggcgccgccatacgcggccctcctccgccccctcagcgcgcacacgggtccgggcagcgttccgtttaactgcaatccctacggccacaattcctgcggtggggtgtcgatggtcacagggatcatcaaaatatcgctgtgtatgacaccccatcgcaggctcgcaaaacgaccgggtacacctgtcccaatctcacccgcgtatattcaggagcaaacgatggaccttcacctgcaatcaaattggcaacgaacggtcgggcagcgtgtggaaatctggaataacgggaagctggtacgcaaaggaactgtggaggtcgtcatgccagatgacacgcttctttggatttcagcggacggagcctcgtcgcggcagatgattttccgtttcgacggagatcaggttttcgcacatttcatgcccccgagggcgcccgagaacaatcagtaggatttcggcaggtccccaacggggtgcgtcatgccggatatcgcggccgcgcggcacaatacagcccacctaccggagcttccaatgaatagaacaatgttcaagtccaagatccaccgggcaacggtcacgcacgctgacctgcactatgtaggatccgtcaccgttgaccttgatctcctcgatgctgctgacattcttcctggtgagcttgtggccatcgtggacgtaaccaacggcgcccgcctggagacttacaccatcgccggcgaacgaggctcgggcgtgatcggcatcaacggccccgccgcccacttggtacaggaaaacgacattgtcatcttgattacctacgccgaaatgaccaccggggaagccaaagcctacgagccccgggtagtccacgtagacgaaaacaacaagatgatccagcttggcaacgaccccgcagagggtctcacgcccgggctcttgcgcccgccacacgccctgaacaacttcgcaatctaaaccgcaccctgcgcggtaggaccaccagttgcgcactggagaaacccctagctaagaggacgggtggccggtccctaatccatacactgcaaaaggccgcttcatgcttatccggttccgttcttgacagaggcgcttgtacccttgccgttgcccgttacatttattgggtccccgatggtgggggatttggtcgctggatccggtatgactttcttgccctgtctttgatgatccgggggggtgttgtcgccgggttcggaggcacgcgttgactgctaatagggacacggccggctccttccgatggtgccaggtctctttgtaacgtgggtgccagcatcgggtgtcggactgcggccatgagcggtgcaaaggagcgccggatggacgaacaatacgaggttttctgtgggcttgatgtcggcaaatccgagcaccacgccgcggcattgaacgcagccggcgaacgagtcttcgacaagcccctacctcaggatgaggcgcggctgcgcgagctgttcaccgggctgcagcagcacggccgcgtgctcgtgatcgtcgaccagcccaacaccatcggcgctcttccgatagccgtggccagggactgcggctgcactgttgcctacctgcccggcctcgcgatgcgtaaagccgctgacctttatccgggaaagtccaagacggacgcgcgggatgcgttcatcatcgccgaaactgcacgtgcaatgccgcacatgctccgggccgttgaccgagacagcgaggtgctcgcggcactaaaagtgctctccggattcgacgcggacctgacccatgagtgcacctcgatacggggtgaattccccgcacgatcagggaacaaacaactcaaaaacgccctctttagatccgcctggatcgccagctgccaccacgccgcgtcgaaggcctactaccagaagaaacgggcacaggggaagaagcacaacgccgccgtcatctgcctggcccgccggcgctgcgacgtcatctactcaatgctcagacacggcaccttctacgaggaaaaacccgccctggccgcttgaccaaaagcatagggacaccccccggattccagtaggacctgatgccccgctcgcattgctccaaggccacagggacgtcagtcccctgccgcagtcaccgccgccctggcactcagcggcactgttcgcccttatgccgacgctggtagttccgctccttcccgatttcctttgcatgctgcaggtgacacccgacggcgcctcctggctggcaactatcaccctgctctccagcgcggtggctacgccaatagttcccgcagcgcggatatgtacggcaaccgcaagatgatgattatgtgcttagccctcatggggggtcggtggtggaagcagtgtgaggtgccattatgtggctggtcatcggcgggcatttcagggcttcgcctctgcgttgatcccgggtgggcacctcggtcacgaggacggtcggtgagacccgactcccgtccttcgtagcatttaaggacatcttttggatagcagcgcttacggcgacaggatcggcgtgggccgcggtagacatccggggccctcagcgcgcccccgtgtcaggcgtcggcgctgttgaactcgtactccaaggacgcgtcttggctccggaccaccggcccctcacactcgccgttgtaaccgtcctggcaatcagcggagatcaggtcgactggagccgcgtggacactgagggcaactactcagttgctctccagttccggcgaataccccatggtggccaacgccgctggttggtcgcccatggccaggcctttgagcttgacggacgcacttcgccgtgaaagcactctttgaagccggcggcgggcactttggaccatccgaacggacgacgacggcgggtaagtcttcccgctcccactcgccggccctcacgtgataaccatgcttaagtcctagactcgcgtagcgatggcgcaaaagatcaccgtggaatcccgctccatgcgtagactttgctgctccggctgtgcagaggtgctccgggagcgtgaacatctttagtcatgatgaatgtcttagctccgcctgcgacttctcagggcacaacggctaccgcgctatcaaggtacggcaccgtcgtcgccgacgcgaggggaagctttcgatgccgcccgtgcccacgagccgcagcttaccaagctgaacgtttcaccggccgaactcggccgaaacccttgtgttccgcgtaaggatgcgcagggaacgagggacgcaggagccatggaccggaactccgatggccgtacttggctcccccgaccctgcgactgtaagttttccgcgaaggctatctatcttccatcgctcagttcatcgaggacacaaacccggccgccgttctgcgtctaccgtggcagccttgacgaccgctttcggtgaaacagccatgctggatctcttcgacgggtggaattttacgagcggttcgcactacggcgctattgtccaaacgaatcgacgcctgcacggcagcagccgactaaaatcagacctagcacgtcaataatccttctatctaacggccgtttgcagagacaatctggaagcccatcaatcactgcagaagcgcggtccagatggggttcggtactcagtcactccttcatgctgttgcccttcggctcagcatgaaggagtggctgaagtcttccttcgttgagcagctcgggatccacttgaccacctaaactcgtcccgattgaacggcgagtccgcggatgccgttgccccagtagctacagctgcgtcccagcgacaccgcggccaccgcactacccctctcttactgttacggggtggaggaggctagcagacacctcctggtgacacatcaggcagttaagttttttgaccccgtggctggggttcacgtccttagtacgcgaaactgcggtcgactccatccaggatgcggtccaagcccggaagccagtcctcctcaagacgactggggggataaggggtgtcgtacccggtgacgcggacgactggggccaacagcgagtggaagaccctttcctgaactcgggaggcaatttcggccccgagtcctgcggtccgcgatgcctcatgggcaacgaggagccggccggtacgttctactgaccgaattatcgtggcgtcatcgatcggagacagggaccggaggtcgataacctcgatgcttcggccctcttgatcgcatatttctgcgactttgagggcgacgggcacgagcgctccgtaggtaacgatagtcaactcgttccccgggcggacaatttcggctttctcaagtgcctgaggcatcctgttcggatccacgtcgcctttaagccagtaatggcgttttggttcaaggaaaatgacaggatcctggctgcggacagcgaggccgatcatatcgtaggcctgttgcggtgaggacgggcagaccaccttgagcccggctgtatgggcgaagtacgcctcaggcgattccgaatgatgttcaatggcaccgatgcccccgccaaccgggatcctgatcaccacggggacagtgattgtcccctcggaccggtgccggtattttgccagctgggtaatgatctggttcatggcgggaaagacgaacccgtcgaactggatctcgcaaaccggccggtatcctgccattgcgagtccgatggcgccgccgacgatgccggcttcccccaacggtgaatcgaccacgcgctgcggtccaaaggttttctggaggccgtcggtcacccggaagactccgccaagttgccctatgtcttcaccgaggagcatcactttgtcgtcggattccattgcatggcgcaacccgaggttaagtgcgtgtgcgattggcatcttgcttatcgtctggttcattctcctgcctccacgaattcaatgtgttctgccatctgctgttcgagttcgacgggcagatcaacgtaggtatttcggaagggcgactcaggaccagggcttggcaggttacggcaaccggtccgcagccgctctgccagacggctttcctcttcggcaatctggttaagaagggcatcatcgatctgtccagtggagtcgagataacgccggaaccggtcaatcggatctaaggcggcccactcatcgttttcggcgccggatcggtatcgaccgtcatcgtccgacgtggtgtgcgggttgcgacggtaggtgagggcctcgatcagtgtcgggccattcccgctgcgggcgttgtcgagagcctgcctggctgcagccagacaggcaaagacgtcgttaccgtccacgcggacaccccggaagccaaaaccttctgcgcgctgcgcgaccgaaaccctgctttggaccgagaacggggccgaaattgcccattgattgttctggcagaagaatacaaccggcaaattctgcgctgccgcccagacgaaagcttcgttcgtctcgccctcgcttagcgccccgtcaccgaggaacaccatcaccgcccggtcccggcccggatctccggtgccaacgtcgccgtcccggacaatacccatggcataaccaaccgcatgcagtgtctgtgcaccgatgaccagcgtgtaaagattgaagttattggccgttgggtcccacccccccagcgtcgtgccacgaaagagtcccaagaggttgacaggatccaccccgcggcaccaagccacagcatgctcgcgataagtagggaaaacaacgtcacccggctgtagggcacgggcagccccgacctgcgcggcttcctgacccaacagggacggccaaaggcctagctccccctgtcgctgcagagcaatcgcttcggtatcgaccctccgcgccagcaccatgtcccgatacaagccaggaccatcaaccgtcgataaatcgagtttcaacacctcatccgtttggatagatccttcctggcttatcagaaagatcggtttgtccgtcatgaactggttccctttcctttgggctggactccccggaccatctgggctggtgcagcacaacccacagcggcagaaggacgtccgactgggcgaagccgtaccgttgccgctgtgcagccagacacggtccgggccggggttagatctaaaatgctgccctgttctgtcctggggccggtagtcggagccacaagcatggcgctctcctaaaagtgttcttccgacggattgtcgtgaatgaattgctgacctaactctgaagaggtgacgtgttgtggtcaacttgttccattgcaactgagcgatctgttcataaggaactcaaagacgcaggcggagctggactaaacgattagcaccgacggcctccactacgagctgctgaaacgacgcacagccaacgcccgcaaaggtgccaccgaataaggatcagaatttggtagatcgcacagtccggtgttggcgagcctatagaacctgggaaaagacagtgggccgcttcgagtggaagcgtgcggaattggtcatcgcggtcacggttcctccctcgaaaatgggctgatgcttctggtcgcggtgcatccggaagccgaggcagcaccacccctgtgatgagtcattcgaaagcccgaaagcaccacctgcgccaatgttgaggcaccaaccgcctccccccactagctctgcggccatgcgccatcactcggaatattcggcaccctgatgcaatccctacacaaggctcgcgggttcgtttcacagtgcgggaattcggaacaagccaccttgtccagcggtaaagaggtcacctgtagacctactggtaaggccggtgtgtccggcggaagcggtcagctcgtctgtggctttcgatacagaaaacgccacagtggccctaaatcgctcgcaccttgacagctactgtcttctaggtcacagtttatccatgctgttcgagtctctggatccagagattgctatcagaggtaaacgaggactggtgcagttcgcccttcgagatgacgaccggagaggtttctcgtccgaggcccatacgacacccgtgacaaaccgtgcttggtcttcgaaacagtcagttttagttagcgaggtcgcgttggaaccaacaggctcgctaatggtctgaatttgcgtgattgaacggatctggaagtcaccgccgacgtcaccgcagatttattcgcgtaatcaaccataatcaggagtaattgttatgagtggtccacttagcggcttgcgtgtccttgacattgccaccgtattcgccggtcccttcgccgctgccttgctcggcgatatgggagcaactgtgctgaaggtcgagatgcctggggtgggcgatccgctgcgtagcctcggaccctttcagggcaacacgtcgcttacgtgggctgcatcggcacgaaacaagcaaagcatgactctcgacttgaaatcgccggaggggcaggaaattctcatcagccttctcgccaagcaggacattctgatcgagaacttccggcccggcactctggacaagtggggcctcaccattgatcggctgcggacggcgaatcccgacctgattgtggttcacatttcgggttacggacagactggcccctatggaagcaaggcaggcttcgggactcctgcgactgcattcagtggttacgcccacatcaatgggtaccccgaccgtcctcctgtactgccatcggtatctctggtggactacctgaccggaatgttcggggcgctcggtgccctggcggctgtttatcaactgaaggtgtcgggcgggccggccgaggaagtcgacgctgctttgtacgagtcgatattccggatgctggaggtggtcgtcgccgagtatgacgcgctcggcacagttcgagaacgtacaggcaacgagcttgcagcttcttgccctgcaggaatttatcaggcgaaggacgggcactgggtcgtcattactaccagcacggagcgcaccttcgcgcgactggctgaagcgatggaccggcctgacatgctcaccgacccacgttactcgaccaatcgggaacgactgacgcggaggaccgagatgaaccagttgctttcagactggaccggcacttatacgcgggaagaactgcagaagcggctggacgacttctcggttccgcattccctcgtttacgacatcgccgacatcttcaaggatgagcactatgcagctcgcgacatgctggtagaagtaagccatcccacactcggcaaggtcaccttgcctggagtagtgcccaaattcagtgagaaccctggctccattaggaacgccggccctctcatgggcgaacatacaacatctgttctcactgacctgggctacaccgccgagcagatcgctgacctcgaacatcggggagttgtctgatgctaactgaaagcgatcgccccgctagcctcgagaagggagcatgacgtgccaagcggactaattatagaaaagcacgagaacggtcatgttctagaggtggttctggaccggggcgaacgcggaaatgctttgtcggcttccatgtatcgtgggctggccagagtaataagggacgcagagaatgatgcatctatcggcgcgctcctcattcgcagcagttgtgaaactttttgtatgggcggtgacatagctgatgaccgcggtaggcgtgatccggattacagcgcggcgattcgcgactttgccgagcagtggttgtcacggagcattccaacagtggcgttggtcgacggaggcgcccaagcgttcggttgtgcactcgctcttagctcagatcttgtgttctcgacggaaaaggcctggttctcactccccgaactgatgcacggactcgtacccgtatatgcgttggcggttttgaacgcgtcggggcatgcctcgaccggagctcgactgatgtggcagggcaagcgtttctcgagccgtgacgtcagcagctttgctaacaacgtcgtcctatgcgcttcaacccaggaagcggaagaaggtattgcaaatacgttcaacggatggatgggtggaaacgtggtctctcttcggcacgcaaagaagttcctcaataacgaaaatgatactgacaggcaaaagatcctgtcaggtgcccacgaagaacttcaacgggccttggcggacgctgacgaggacccaaaaaaagcacaatcctacctgtcgggacagcactagtcgcgacagcacaaccgtcgcaggaccccctgagactcctagaacaattcaactttttcgccaccttgctcaagatggctagcgcctatggaaaggcagcttgtaatgaagcaaactgtgctcgacagagcccaaaagaaggcatttcgccggttgatgccattcgtggcactgctcttcgtggtaaaccaactcgaccgcattaatatttcggtagccggacccaatggtatgaatgaagatcttgggttgactgcggcgcaattcggccttgcgtccggactcttttttatcggctacatgacacttgaagttcccagcaatctcgccctgcaccggttcggtgcgcggcgatggcttgcgcgtattgtcgtcacatgggggatcgtggcgacgtccctgacttttattccaaatgcagaatggttatacggtcttcgcatactgctggggatggccgaggctggatttgcacccgggatcgtggtctatctgacatactggttcacgcgcgagatgcgctcccgggctaccgcctttttcttgctgggtattcctgtcgcggccgccttcggcgttccatttatgaccctgattggtgtgcatatggacgggttcttcgggcttgacggttggcgtgtgatccttctgataacaggcctgttggcagtgctactcggcgtcatgtgctggttctacctgacagatcggcctgcggatgcgaagtggctgacagccgaggaaagtcaggtgctgacagaggcattggccaacgagacaccggaaaaagcgggtaatcacagcattggcaaggccctactgaacgggaaagtgtggctacttgcagttgcgccattcctggtcctctactctatgttcgtcgtgacgttctttctgccaaccctgctcaaagatatcaacgcccgtgagtctctcggccttgacagcgtgcaggtgggtctcctctctgcaattccgtgggccatcggcggcgcgggtatgctctttttcgcctctaggtcggacaagaaaaaggaagtaaccaaacacttcgttgcggccacgactatcggctcaatagggttctttttccttgccatgtttggtttggacaacccgtatatcgctcttgcagcgctaacggtggccatggtcggtgttcttggatcccttactacgttctgggttcttccgtcgcgtctctatacaggcgccgccgcggccggcgtaatagccctgatcaacaccattgccaatttcggcagctttcttggcccatactcctttggcgtactcagcgacgccacgggcggatacaggggcggcctgattatcgttgccgtggccatgctgcttgctggacttctcatcgccctgcgattccgcgaccttgggagagccccggttcaggcttctaccgaacgcgaacgcgtcgacagcgtccacaggacgtccaacaatgaacctaaaatcctggcccatcaagctgagacgccttcacggttgtttccacgggaggatgactaatgacactgcccaagtctgtcgtagtgcgtgaagtaggcgcgcgtgaaggtatgcagattgagaagggaccaatcccgacggcggagaagatacgtctggtggaccttctgtccgagtgcaacttcccggaaatcgaagttacctctttcgtctccccgaagtgggtgccgcaaatggcggacgccgagcaggtcgcaacagggttcaccaggaagccgggcaccgaatacacctgtgtttacctgaacaagcagggtctcgaacgcgcactcgcggtcggcactctggacgtcaaagccgcggtgatcgtctcggccagcgaggacttttcccacaagaacatgagacggtccaccgagcaggtgcttgccgacatcccggattcgctcgcggtcgctcgcgatgcgaacgtccctgtggcctacctgtcggtcgcggcagccttcggctgtaactacgcaggagacgtcgacctgggcgctgtgatcgatcgctttacacgtgcgcttgcagtagcagcggacgcaggtgtccatatccccactttgcttttggcggacaccatgggatgggccaaccccgaacagattcgccgcaccgtcggtgaagttcgagagcgttggcccgaacacgacattcggatgcacctgcacgatacccgtggcatgggtatcgccaacgcctacgcggcgatgcagctgggagcacgtgacttcgacgcttcggtcgcagggttgggcggatgtcccttcggcggggaccacggcgccgccggaaacatcgccaccgaggagttcgtgcacatgtgccacgaaatgggaatcgacaccggggtcgaccttgaccgcctcatcgacgtcgccctccaatccgagtccattgttggacatcccctcccagggaaagtaatgcggggacgcgcattgcacacatatcgctgatcgcatcccctactggctccgaacacggtggtgcggcgttttcccgacgcgctacaggaaatattggtccggaggaaccagtccgccttcgcggtgcggggcatcgacaccggcgtcgatcctgagtaattaatgaaatatcgcacgcgggtcaaatacagaacgccgtcggtcactggctcgagccttcgttcgagccagctggcccgcgtgggtcctgtacccaccccgcgtccggcagctcattgcgacagataaaaactaacgtctcccacgtccagacctctcagcaagaagccgatctctcgaccaatcagcatgccgttagcccccgaatgagggtgctcagcacggtccttccgaggaaggaccacaatcagaaagaacttcgatgaaaaagattgcgtttgcagcactatgcctgttcgtcggtctcgcagctacaggctgcggcggcggcaacgcctcggctacgggcagtgaaagaaactatcccaacggtcccatcaaaatgactgtgggcggcgccccaggcagcgggttcgatctcgcaatgcgaacgcttacagaagtccttgggaagaatgacatcgtagatgtcccaacccccatagataaccggcctggggccgacggatcgctctgggcttcgcaaatgatcgacaagtattccggcgctgacgaccgcctttccgtcacatcattggtgatgatgacgaaccatgctcgtggcaagtccgagttcaactatgacgatgtcaccatgatcgcgcagctaatgaccgaaaattttgccgttgtcgcaaaagcggactctgtctaccgtgacctgccgtcggtcctcgatgccgtcgtttccgacccggcatcgatacccgttggcgcggcatctgatgatcaaatgccattcgcgctgctggttgaagctgcgggcggtgacgcctccaaaatcaactttgtggcatacgagggtggcggggaacaaaccgccgctctgctttccggggacatagacgttgctatcgctggcagcagcgagttgcttcccctcatcacatccggggaactcagcgctctggctgtagtgggcgaggaacgatacgaaaagttgagcgatgttccaacaaccaaagagctgggttacgacgtcacaatcgcaaactggcgcgggatctacggccctcctaacatgcctgattacgccgtcaagtactggcaggacgcgattaagaaggcagttgagaccaaggattggcgtgatgccgccgagagaaaccagtgggtaacgagctaccggaccggggacgatttcgatgcgtttctaaaggacaccaaccagcaggtgaccgatgccttcacgaaaatcgagaagggatgagcaagctaatctcgactgagaaggccagaaccttgccccgggggcgctccgacttgctgtgtggtctcggagtgatggttgcgggctcacttctacttgtcagtgcgctcggcatagatactactaccggtactgaagcgggaattggtcctgggctggttccagttgcgttggcaaccttgctcatggcaggcggtgccgtgctctccctcacaagtcttcgaacggcgcggtcaccccacggggagcagacagattcacaggcggaacgtgacgtagaagcgctcatgaaggaatccgagccacccgtcgcgctcaaaaatctccttgtcgtaatcctcctctttgtcggctatgccgtcgcctttatccctctcggctacgtcctgtccacggcgatttttctcggaatcatagtcaccgtcatcgatcgggcaaaatggaaacgaaacatcctgttcgctataggcttctcagccattgtttatctgagcttcactcaactcctgggcgtaccgcttcctgcaggcgtgctcgggctaccggtaggaggctgacatggacgcgttcggttctctcatagccggcctcgggtctgcactaaccccgaccaatctcatgtttgttttcctgggcgttctcatcggcacaatcgtaggcgtgctccctggactcggtcccatcacagcaatcgcactgttgattccgctaacattcggtcttgaacccactagcggcctgatcctgctgtccggggtatattacggcgcgatgtacggggggtcgatcacctccatactcatacgaacaccgggcgaagtggcatcggccgtcacagcgcttgacggacaccagatggccaagcagggtcacgctggaccggctcttgccaccgccgccgtcggatcgttcatcggcggcacgatagccgtcatcggtctggtttttctatctccagttctggtcacagttgcaacgtccttcggagcgtctgaatacaccatattgctcatcggcgcccttgcactcaccacgtccttgatgagcgggtctaggctgaaggccggaatttccgtgctcattggtatgtcattcggcgtagtcgggctcgatccgcagaacggagtggaacgttggactggaggggcaatcgagctttccgacggcatcgacatcgcgctagtcgcgatggcccttttcgctgtgcccgaggcgcttcgtcacctagcactaggcgaccgccagccatcgcctacgatgcgtgtccagcgggcgtggatgaataaggaagaccttcgccgatcggccggcccctacgcccgaggatcgttagtgggattcacagccggagtgctaccaggcctcggaccgacactcggttcgttcgcctcctactcgttggaacgaagtattgctcggggcgagcggagaaaactcttcggtaagggagcaattgaaggtgtcgcgggaccagagaccgcaaataacgctgcagtcggcggtgccatggtccctatgctggccttagcgataccaggctcggcgacaacggcgctccttcttttcgtctaccagatgtacgggttgcagccgggacctcaacttttcgtgaacgatggtccacttgtttggacgatcgtagcgtcgatgctggtaggtaacgccatgctgctggcgttgaacatgccgatggtccgaattttcgtgacgatgctgaaagtgccgccaccactgctttacggcggagtgctggcgtttgtgatgctaggagcgtatgccctgacattcagcttctactcactgttgctacttgttgcaataggtttgctcggatacgtcatgcacgagaacaatttcccgctcactcctgcgatcctggctgccgtattgcttcccatgcttgagttgaatctccgtagagccctgctagtatccggcggcgactggacaacgtttattagccgaccactatcgctcatcttgatcatcatcatcgcgctcggcacgactgtgccgttcatcgtcaaggcaatacgctcgaggtatcaaaccgccgcagcggagccgaccaagatagacaccctaaggtagggggtcgacctcgcatctagttggactcaggcagtggtgcgggcaggacttcggcaggggagatccgatcggcagcaccactcgagccgtagggcctgtagtggctggctgagccagcggttggcacaggtccgggagatttccatttccctggccgcgtcggccacagacgaccggacaggacaccctcgataatgatccgcctatcggtctcggtcaggcggccatcacggtgggacacatgaagacctcttagattcagctggcagttatgggaaccaccaacctaagaggtattcccctacttgcgatgttaccaatgtcctggctcaaaacatctgaaaataagcgttccctgcgaggagggcaaggatgagcgggcgagggctgggttgtcgtggaccgcactttcgtgttggttcgggcttcgtccggtggctggcgcgcgtcgtgatcgactggcctgttagactctcacggaaattagccagccacgggcggtgagaacccgactttggtgcggtgcttcatgcggcacagccgtgcggtctggtcagcccggttgttgggccagttcgaggacgacgggtagcccaaatgcctggagctgattgatgtcgcgtgcccgtgctttggccggctcggatgatcgggttgagggtccctgtagagctcgccggtggtgggcatgttccagacggtgatgaggatcgaatgttcaacggcgacgagggcgttcatgggtccgcgccgtgcggcaagtcttcggtacttggcgccgacatacgttttgttcgatctgcacgtggctagtgcgcttatgccggcggctcctttgagatgtggggtgagcactttgtccattaggaacacgaataacatgaactggactaaatgtttaacggcgaccgcctccactacgagttgctgaagcgattcaacgccaagccgggtttgcaccacgggtagatcgcgtatctcgctggtcagctcgagaagccgggtcgtgcccaccgtcgaccgggtcatgtccaagctaaacatctgcgatgcagcatcgctcgaaaggtcctgcaccgtaatccatcctttgcacaggctggggtcgctcccaaggttgcgaaattcggggacagccaccttgtccaggggttgtaacggcttacttacaaagctccgccaccggtaaggccagtacttcgatggtcgcagccgaatagctctagcattcgttgcgatcgcacgcgaaacggggctagattgcttagttcttgacagccagtgtctactgagtcacagtttattcatgctgtcggacgttctggatccagagagcagaatctatgtaagtgaggtcctgatgcagttcgcccttcgagacttgacgatcggagaggttctctcgtcccaagccacacgacaccgtgacaaaccgtgcttggtcttcgaaacagtcagtttcagttatcaggaggtagagctggaaaccaacagactcgccaacggtctgggttcagctggagttgatttcggcgatcacgtagcggttatgttgggtaacggtccagagattttgctctcaatttttgctttaggaaaactaggcgccgtagccgtcccactgaacacatcggcgagaggcaaggggctggcctacaatcttgatcacgctgatgccaccacgttgatcgctgacgcacagttccttccgcatatcgcggcgatcatccatctaacctcctctttgaagcgcttgatcatcgtcggtgaaccgccctctggcgccgacctgcctgctgatctcattgtcttgaagttcaacgatttgaggtccagcaatacacttgcgcccaaagctgaagtgaaatacaacgatcaagccttccttatgtacacctcagggacgaccggcccatcgaaggccgttatgtacacgcacgcgtacgcccttacgtgggctggagggttcgccgatgcacaccgctatcgcagcgacgacattatgtacgtatcgatgcccttgtttcatgggaatgctttgcattccgccacttacgcgtgcttattggccggagccacagtcgtcataaagccaaggttttcggcgtccaatttttggcgtgacatatattgttacggtgcgactttgacgaacctattaggttcgatgggtgacattctctggaatcttgatgcatccgaatatgagcgcaagaatacgctccgtcaaatcatggcgggacccataccagaccgcggtcgccaaatggaagaacgctggcatgtccagctagtgtcatgtttcgggttaaccgatttcggcgtttcaaatttttcgaccgtcgatgatccgcctgacaagtttggatcttgcggactggtgtcacgtcatttcgaggtaaaaatcgttgacgataacgatttcgaggtacctgacggacagcttggggaaattgtcctgcgtacaaagacgccatggcacagtgcctccggttactacaagatgccaaccgaaaccgcggctagtctgcggaatcaatggtttcataccggggatttaggaattcgcgacgcagacgggtttttgtacttcaaggatcgaaagaaggacgcaatccgcaggcgcggcgagaatatatctgcgttcgaggtcgagcaggtgttgatggactacgagggcattgcagaagtctgcgcctatgcggtagcggttgacggagacgaagaagtcggagtttcgctcattattacaccaggtcataacttcgtgccggctgatctaattaaatggtgtgagggacgaatgtcatacttcatggtgccacgatttatcgatacacgcgaagacttgccgagaactgagagcggaaaaattcaaaagcattcgcttcgcaatgatgcgcaatcaaacgtcaagcagttgtgggaccgcgtgtcagaaggaatcgaggttggtcgactatgacccgtctcgaaaagatagccgcaggatttcatttattagaggggccggtctgggatccaacttccggtttggtattcgcagacgccgaagggggtggggtgtttggtatcaaccaggctggaactggccccaccactatcgtgcaacaccgacgaggaatcggcgggttagtgcgtcatcaggcaggcggtcttgtcgtatccggtcgtaatgtcgcatacaaaggaaccgatacatcgtcgacggtcgttctgttagacaacgcccctgaaatgagtggaatggtcggattcagcgatatgtgtgccgatgcatcgggccgcgtgctggccggtatgttaggatcacggccgacccaggagaaccatctctccgaccacgggagtctctggctcatcgacctggacggatccgcccgatgtctaataccgacacccaaggtccggcacaccaacggtttggcgttctcgccagatgacaccagcctctactatgcagattctggtcagcgggctgtcttcgtatatgactacgacgttgattgcggccgcgtcggcgaaccacgtctgttcgccacgatggacgctggcatccctgatgggctagcggttgcggctgatggaagtgtctgggtagcaaacgcgttcgcatcccgtgtgcttgttttcggtcctcacgggggtcttcagcgcaccatcaacatgccccaggaaattgtgaccaacgtttgtttcggcggcactgcaatggacgagatattcatcaccacggggtccttgaacccggctgaacgtgtcggtgctgtgtatcacctgactaacgacgtccccggattgcaaacccaccaagcaaagtgccccgtgctggtaggagcgactcccccagccgtgtccccgcgggaggatgactaatgacactgcctaagtctgtcgtggtgcgtgaagtaggcgcgcgtgaaggtatgcagattgagaagggaccaatcccgacggcggagaagatacgtctggtggaccttctgtccgagtgcaacttcccggaaatcgaagttacctctttcgtctccccgaagtgggtgccgcaaatggcggacgccgagcaggtcgcaacagggttcaccaggaagccgggcaccgaatacacctgtgtttacctgaacaagcagggtctcgaacgcgcactcgcggtcggcactctggacgtcaaagccgcggtgatcgtctcggccagcgaggacttttcccacaagaacatgagacggtccaccgagcaggtgcttgccgacatcccggattcgctcgcggtcgctcgcgatgcgaacgtccctgtggcctacctgtcggtcgcggcagccttcggctgtaactacgcaggagacgtcgacctgggcgctgtgatcgatcgctttacacgtgcgcttgcagtagcagcggacgcaggtgtccatatccccactttgcttttggcggacaccatgggatgggccaaccccgaacagattcgccgcaccgtcggtgaagttcgagagcgttggcccgaacacgacattcggatgcacctgcacgatacccgtggcatgggtatcgccaacgcctacgcggcgatgcagctgggagcacgtgacttcgacgcttcggtcgcagggttgggcggatgtcccttcggcggggaccacggcgccgccggaaacatcgccaccgaggagttcgtgcacatgtgccacgaaatgggaatcgacaccggggtcgaccttgaccgccttatcgacgtcgccctccactccgagtccattgttggacatccccttcccggaaaaataatgcggggacgcgcactacaaacgtatcgctgagttacgtccactacttcaaaggttttcgtatacaactttcgtgatgtaaaacgtttaataacaggtcaggaacagacatgacgcattacaatctatctacttcagacgcagtaccaaactccggaccagacgcgccactgtccattcaggcgaaccgtcgaagaacagtaatatcaagcgcgctgggcaccacaattgaatggtacgactttctcctgtatggtttcctggcgcccgttgtgttcaatgaattgttcttcccgacattcgaccctgtagtcggcacaattattgtattctcaacgctagccgtgggatacggtgcgcggccacttggaggcatcgtattcggccattacggggacaaagtcggtcgaaaaaagatctttatggtgactcttctcgtgatgggggcctccacagtaggaattggtttgctacccacctacgaaaccataggcgtatgggcacccatactcttggtcgcgcttcgattttttcaaggaattggtgtaggcggtgaaacgggagctggcacgcttctcacccttgaaacggctccagataaccggcgtggcctgtatgggtcaatcgtcatggcaaccgccagtgtcggggtcatactgtcagtcggctccgtcgcattgctaagtcttatgccgcgggaagatctactttcttggggatggcgcataccatttctggccagcattatcctagttgttatcggtgcttacatccgacgccatatcacagaatcgccggctttcgcgaaaaaacaacagatcataaaagttcctgctcttgaagtcttccgaactgcgtggcggcctactcttgccggaatcgccctggcaatggttgcttccactctctaccacctcgttgcgacttttgcgctgtcgattgggcctcggaactacggtctttcagtgaccggacttaccgtcgccaccatggtcgcgggcgttgtttcgctgatcactattcccctcagtggccgcctatccgactcgggaggacgaaaacgcaactactacatcggaattccgctcgcaatggtaacggttacggtctacttcctgtacttactgccgtcgcagaatattctgcttgttggatgcggaatggttgtagctataggggtggcacaagcactgatgtacggcgttgaaggggcactcatttccgagaactatccgacgcccgttcgattctcagggttctcaattgcaaaacagattggaacgttgttgggcgcaggattctcacctctaattgcttcgagcttggccgccgcgtttaataacaacgcctgggcatacattatctttttcggatctgaggccgtaattgctctagtcgcacttaccctaatgaaagaaacctaccgcactcccctgcaaccggcagttccccggtaaccggatcacacgtacagttcgaatctttggtccagttgacgtgacggcttgggcatggacatcgggagtgggcagagtgagagctgccgagtcccatgccttccttcgaaccccaccccgaaccctgcgggccggcgccgagacccggtgccggcccgcagtcaccacagaaagcaaccaccgccatgacaccacagcccacaccccgcgccgactagcttggatcccggatcccggttaccggcttgtatctcttaagtaccccctgttgaggtggggtggtcgtcgtttacggtggccttgggaagggccggggtggttccgcttttcggctgggcgtcatggctcgtgaaagagatcgtcgcccccggcctgtcttccaagcagacccgattgagggaattggtggccggaagaaaacggtgcgcagcaccgggtttcatccgggcggcaccgaatgactcacaagcgccggaactgtatccgacgcttcctcagcagttgcgggcatgtgagggaggtcgccgccggcgcgcaggtagtgcatgacggttctccccaaggatggggaagcccggcctggtgactcggctggtggaccggcaacgacgggttgtcggctcttcacggttcgtggtgaacgttctgccatgagggatgttcatgccgctgttctggcggcgctgcgcaataggatacgcgttttgtagttgcgtgcgttggtgaatccccggcctgtcctttttatgtgcttgatagcggtgttattggcttccactttcgcggttgtcgcgccggtgacgatgaggacttcgatttctttccaccatcgactgaccgtgcgccagaggcggttcgtctccggctgggcggctcgctcgaccaggacctgcagccgggattttgcagcggcagcgtctgcaagggaaccggtggtcagtagggcccggagctgttcttttaccagccaggccgcctggagtttccctgtggcatcgtcggtggcgaacacggtgttgagcctgtcccgtgcccggtctgtgagtgtgtcaccggcgcgcaagagcaggcgccgattggcccagaccggatcaatggaacgcccccgccggccatgaacctgctgagtaaggcgctgccggatttcagtgagcatgtcattaccgagcttgaccagatggaacgcgtcgaccgagacagcggtgcgtggcagccacatccgcaaggccttgcgaaacgccgctgacgggtcgatggcaacgacctgcactcccagccgccactccagcgggcgggcgaacagccagtccccgaccccgtcactgtcgcggccgtccacgatgccaaggacctgcccggtatccagatcgacaatggtggtcatccacggttcgtagcgtttccacgccttggtggtcgggtcacggaagaaccgcacggaccggtagctgtgttcatcaatgccgagcatccgcggcgccagggcatcgacatcaggcagggtcagcgccgcgaaatccagagctcgttggaccagccaccacgagaccccgaaagaagctgcagcctcggcggcggccctgccggatccgatgacggctgccaccagggcatcatggagccggcgggtagaccgtgcccagcgcgggacctcggcggtctcctcggtgaatgtctggcgcgtgcacaagtactcatcgcagaataatctccgcttgacccagaccaattcgaccggaccggcgacagggatgtcacggagacgttgtgaccggagggaatgaacgcgggtgctgatcaccccgcacgatgggcagccggcctcggcggtggcttcgacactgacccgacgctgcccgaaggcaaggacatcggtgtcggtgacccggtagtcgggcaggttgaaaatggcggtggcagcatcggtgcgcggggaagtaggctcgatcaaggctcgtagctcctgacttgatgaatgcgtagagaacatccatcacagcagggctacgagcccttcagctttcaagacacggaacctgtttcaccatcaaccacgaagagccgggttgtcccatcgcacgtattcgatgcgaggaggagaatcatcatgcaaaatcaggataaacccgcggcaatcgtccgggcagtggcaggtatcgacgcggccatcacggcacgccaccatatcgcggtccgggaatttacgacgacggaacagaacatctgagccgcttcacggtcgacccgacgcttgccggacttgagagactctcggcgcggctggccgccgttccggcacctgtgacagcggtcgtggaaccgacctcgatgacctggctggcgctggctctcgcggtcgaacgggcaggcggccagatggaaatgatcggcgcccgccattcctcacggctgcgcggggcgatcatgggcaagaacaaatccgacgtcatcgactccgaagtcctcacccatgccggggagattttcgacccgccacccctggtccttgcatccccgggacagctggcgctgcggcgggccgtggtccgccgggccggcgccgtcattgacggcaacaggtactggcggcggctgctgtcactggcgaggtgggcctttcccgatgtgtggaccgcgttcgccggatccgaatcaacagccctcgccgtgctggccgctggccccacctccgttctctggcatctgcgcgtgccgcgaccctgacggctgtggtcgccgagcacacccgcgatgtcgccgacacacccgcccgggccgcggcgatcaagaccgcggcccggggatgggcagagttctgggacggtcacctggacctggacgcgctggccgtcgacgtgaccgagcaccttactgacctgcaggagtcccgcgccagggtggatcgcttcacggcccattcccggcaacggtgggagcatctctacggcgatgacccgctgatcctgcccctgcccggcgtgggcccggcaaccggtccctgcatccgcgcctacttcggcgacgggtccgggttcgacagcgccaagaaagcagccaactacgtcggcattaccccttcgaactggtcctccgggacgatgaaccagtctcgccgggccagcagcagagaaggacctgcgccgttacgccttgctttctaccaggccggcagcgtcgcccggaccatagacccgcagctggccgcgttctatcaccggctcatgaccgaacacggccactgccacacccaagccacgatcgctgttgcgagaaagctggctgaaagaacctggaaaaccctcaccaccgggcaaatgtatgagctgcgggacctcgaggggcggccactcaccaaacgggcagcgaaagaactcatcgcctcgcactacacggtcacgcccaagcaacgcagtcagtcgcggtcccacacgattgaagcgaaacgggcacgcctgacacggtagctatcgcgatcaccactaccgtttggccggcctgacccagaggcccgtaggcgttcttccgcccccaacagcccgggggatatcagtcagcgggccccccacagctgcggtccgttcccggatggacggcacttcccgtcacggcagaacccggtgacggtgcactcaccctgcctgccgtccagagctaaaaaaagcattgacaagggttagggaatctcttcaaggttaccggggaaataggttcgtgttgtagctagcagaggaccggtggtgctgctgggatgagtgttgccacgcattcaacgtgaacaggaaccacgagtcttgctagagcctactggggctggccatgacgctgccagctcgatcttcaatctgcccgattaccgtgtcgccggcaccgttctgcttcctgacgggatccgccacgtcaccgtggagtccacgttcccaccgggggcccgagctgcggagtgatcgctttccgggttaaggagcgccgctcccagaaggtgctgacattccggtcgccggcgcggtggtgcttctctgggaggatctcgtggtggctggtccagcaggtcatcggtgacgccgctctccgtctgccggacgtggacctcctggcgcccagaatgctgggtatcgatgagcaccggtacgagccgttgatgaccaccattgttaatctggacaccggccaggtcctgggcgtcgtggacggccgggaccatatgggcgttggggactggctcttcgcccggcccgttcagtggtggctcggggtgcaggtcgtcgcaatcgacccgtccgcgttccgcaaagcgctgcggatgcggctgcccgcaccgcggtctcggtggacctgtcccctatgaccatgctggccaacgacatgctcaccgcggtccgacagggccagtcgcagcaggttcggggccggcggggccgggcaacggacccggcgtgggcgaacaggatgctgctgccgagcggacgagaacctatcagaacggcggggccaccacaggctggccgacgtgttctccgccgatgatccgaccgggagcctccaagccgcctggcaggtcaaggaacagctccgagccctgctaacaccagctccctcgaggacgcgggtgcggccaagaacaccgagggcgatttcatggttggggtcccaaagggtgagctggcctcgagtcgggcggattgtttgtagggagggatcccggcgcggcacccggccttcgggcatgtgcgttgcgcttcttcttgccgcgccgggaatttttgacaggtttgtcgtctcgggctgcggggacaatgcaatatgcgcgtcgccccgcagctggcagggcgtcagccgtgggtaaagttgggctgtctcttttcgatgaaggcgcgcataccttctttttggtccgagctggcaaacacagagtgaaaaatcctgcgttcaaagaggacgccgctgtccagtggcatttgaaatgcggcgttcacaacctcttttgccagcattacgattggcgcggacttctcggagatcgccttcgcagtttccaaggcatcttccaggagcctgtcgtgagggacgagccttgctacgagaccgatgcgttcagcctcggccgcgtcgatggtgcggcccgtgaggatcatctccatggcctttgccttgccgacggcgcgcgtcagccgctgcgaacctcccatgccaggtatgacgcccagtttgatttccggctggccaaatcgcgctgagtcagctgcgatgatgaagtcgcacatcattgccagttcacagcctccgcccagcgcgtggccagcgacggcagcaattatcggggtccgtacggcggccaggccgtcccagccctggagccaatcgtccaagtacatatccatgtaagtccgggaagacatctccttgatgtcggcgcctgcggcgaaggcacgatcggatccggtcagaaggatggcacctgtatcagggtccttgtctaagcctttggcagccgagacgacttcttgcatgagttgaaggttcagtgcgttgagggcctccggtcgattcagtgtgatgacgcctacgcgtccactttgctttacggtgatggttcgaaaattcatgctcttcctcgaaggaggctgcgctaggcaactaggagtgggtgtggattccaaccggtaccgaccgctcttcgggcccgttgtaggcgcttagcgggcggatgagggcgttggaggcggcctgctccatgatgtgggcggtcatgccggggatgcggctggcgacgaagattggggtgaacattggggtgtcgaagccgatgaggtgataggccggccctgaagggtagtcaaggtttggtttgatggccttggcttcgtccatggcctgttccaagccgttatacagtcctagaatttccggcctgccgtagtagttgatcagcttgtccagggccgtcttcatggtgggcacccgggaatcgccgttcttatagacccggtgtccgaagcccatgacctttttcttctgcgccagggcttcctccatccaggatttggcccgggacgcggcttcgtcgagggattcctccgggcgtatgccgatttcattgaaggtgtgcatgactgcttcattggcgccgccgtgcaggtgacctttgagcgcgccgatgccggctgtaacggcggaatgcaggtccgaaagtgtggacgtgactacacgcgcggtgaacgtggaggcgttgaaggagtgctccgcgtagaggatcatggagacattgaaggcctctacgacctcgtccgcgggttcttcaccgaagctcatccagaggaagttggccgagtagcccagatcgtcccgggggttcacgagatcctgcccgcggcggcggcgctggtcgtaggcaaccacggcgggcatggccgcgaacaggtcaatggcctttgtcatgttcgcttcgggtgaggagtgctcggccagagggtgacgtgcgccgaggacggatgttgcggtgcggcagatgtccatgggatgagccgtcttcggcagggcatcaatgatcattttgagagccggatcgaggcttctgcctgcacgctcgcgagcggtaaattccgccagttcgctttctgaagggagctcagcgttccagaggaggtaggcgacctcttcgaagctgcaccgggcggcgagttcctgaacagggtagccgcggaacagcagggagttggtatccgggttgaccttggaaatggcggtgtagtccaccacgactccggtgaggccttttctgatgtctgtgtcagtcatgctgaactccttcgttgcagtacgtgaattagcggatgtcagggatctggaagttgaagacgtcggaatcgaatttgttgtaggactcgtagtccaggaggtcatagagacgcgcccgggtgagcatttcgggcacgcggacctgctgtgttccgaggttcctgagggtgtccaggacccgctcggcggcacccatggcgctgcggagcagggtcaccgggtagatcaccatgttgacgcccacgttctgcagttggtccttggtgaacaggtcgcttttgccgaactcggtcatgttggcgaggatgggcacgtccacggcgtcccggatggcacggaactcgtgcaggtcacgcatggcttcggggaagatggcgtcagccccggcgtcgaccagtgccttggcccggtctttggcggcttggagtccgtccacggcccggatgtcggtgcgggccatgatgaggaagttggggtcacggcgggcatcggcggccgcgcggatgcgcttggtggccgtgtccaggtcgaccacgttcttgccgtcgaggtggccgcagcgtttggggttgaactggtcctcgatgtggagcccggcgaggccggcgttttcgatttcctggacggtgcgggccacgttcatgggttcgccgaagccggtgtctgcgtccacgatcgcgggcaggtctgtcatcctggcgatctgtcctgcccgggtcgcgacctccgtcaacgttgtgaggccgatgtcgggcaggccgaggtcgttggccaggacagcgccggagatatagacgccggcaaagcccttctcctcgatcagccgggcggacagtgggttgaacgcgcctgggaactgctggatgctcccggatgccagaagctcccggagtttaacgcgtttccactcgggcgttgcttgggaatacagcatttagaacagccccttgggtgcggcgttcaggtcgatgacgccgggggcggcggtgatgttgagctggtccagtttcccggcgtcgagttcggggaggcgttcgacggctgcgaggaaccgttcgatttccgcttcttcgacgaggccggcggcgagggtgcggaacttgttgatgtactgctggcgggcgaacgggcgtgcgccgagcgggtgcgcgtcggcgaccgcgatctcatcggtgatgaccgtgccgtcggtgagagtgatttccacggagccgccgaaggccttctctgcgatgtccagtgaatggtagcggcgggtccattccaggtcttcctcggtggtgaccttgagccacagctccacggtgtcgggccggccggcacgctccggggcgtaggaatcaacgtggtgccagctgccgtcctgcagggcgacggtgaagatgtacgggatggaatggtccagcgtttcgcggctggctgtggggctgtacttctgcggatcgttggcgccggagccgatcacgtagtgcgtgtggtggctggtcttgatcaggactgacttgatgttggcggggtcggtggcctccgggtgttccttgtggagcttgcgggccagatcgatccaggcctgggcctgatattcggcggagtgttccttggtgtacgtgtccatgatggcgcgcttgggttcgccggcttcgggcagcggaacctcgtacgaggcgtcagggccatccagcatccaggcaataacgccgtcttcgccttcatagatcggaaccggagaggtctggccgcgcatggaccggtccacggcctcaacggccatcttgccggcgaatgccggggcgtgggccttccaggtggagatttcgcccttgcgggactggcgggtggcggtggtggtgtgcagtgcctggccaacggactggaagatggtctctacatcaaggccgaggagcgtgccgatgccggctgcggcggacgggccgaggtgggccacgtggtcgatcttgtgcttgtgcaggcagatggccttgaccaggttgacttggatttcgtagccggtggtgatgccgcggatcaggtccttgccgctggctccaacgtgctgcgcgaccgccaggatcggcgggatgttgtcgccggggtgcgagtagtcggccgcaaggaaggtgtcgtggtaatcgagttcgcggacggctacgccgttggcccaggctgcccattcgggcgagacgcgttcgccgatgccgaagatcttggcaccctttccgccggtactggggctatgggccagtgcctgggcgcgggcggccacgatcggggcacggttcagcgaggcgatggcaacggaggcgttatcgatgatccggttgattaccatctccgtgacctcgggcgtcacgtcaacagtgtcccctgcgatcactgcgatcttatacgccagctgctcctcgcgagcaaggttctcttcactcttgtatacgcggacggaatgtttatttttcacgttgattctttcaggattgcggatgacgggcttctggaccgcgcaggcgtgacacttcgcgatgtggttgaggaggagtgggagctaaatccggtagagcagcagcgcttcaccctgtccaccgccaccgcagagggcgaccgccgcgcggccggcccccctgcggaacagttcgttggcggcatgaagtaccaggcgcgccccggaagctccgatgggatggcccaaagcgatggccccgccgtggatgttgcagcggtccaagggaattcccaactcgttcagcgactgaaccgcgacggcgccgaaagcctcattgatctcgatgaagtcgagatcttcagcggtccacccggcccgtgccagcgccgcacgggtggcgttcgagggctgtgaatgcagtgagttatcaggaccagctacttggcccggggcgctgacgacggcaaggatctcaagctggagtcgttcggcgttggcgcggcttgtgagaacaagggctgcagctccatcggagaggggcgaggcgtttcctgccgtgatgctgccatccgcggcaaaggcaggacgtaattgggacaggacctcgacgtccgtgcctgctcttatctgttcgtccctgtcaagaaccagggactgtcctttcctgccgtcaacagtgagggggacgatttcgtccttgaacactccttcgtcggctgcctgagcagctcgccgatgggacgccgctgccacctcgtcctgttggcgtctacctatgctgtgcacctggttgcctcgttcagtcaggaggcccatagagacgccttcctgtgcgtcgctgaggccgtcgctgacgagggaatcgatcaaattgccgccgccgtatagccatccttggcgcgagccaggcagcaggtgcggactccgactcatggattcctgcccgccggcaactactacttccgcgtcaccggcgcggatgaggcgtgcagcatctatgacggcggtaagcccggacagacagactttgtttattgtggtcgcaggtaccgtcccgctaattccggctttcagtgcggtctggcgggccggattctgtcctgagcctgcctgcacaacctggccgatcaccacggcatctaccaggcccggatcgatgccggccttttcaagtgctccgcttactgctgctgcaccgagctctaccgcggtcagtcccgccaactggccgttgagcttgccttggggggttcgggcaccgccgataatcactacatcctccggacgggagggtatttcatgtgttggcttgttgtgcatgctttgtcctttgaaatcagtgttgatgtgcggggctaccgggaggccattcgcagcgccccatccattcggatgatttccccgttgagatagtcgtgttcgatgatcgacaacgccagttgagcgaattcctcggggcgggctaaccgtttggggaaggtgacgccggcggcaagtccttgacggacttcatcgctcacagaggccatcatgggggtttccacgatgccgggcgcaatggcatttacccgtattccatactgggcaaggtccctggccgcaggaagggtgagacctacaatgccggcttttgacgaggcgtaggcggcttggccaatctggccttcgaaggcagcgatggaggccgtgttaataattacaccgcgttgaccgtctccatccgggtctgtgtgcgagatggcttcagccgcggaggcgagaacgttgaaggatccgacgagattgacttcgatgacctttgcgaagagtgagaggtcatggacgccccttttcccgaggattcgcattgtcggcagaatgccggcgcaattgattactgtccgcaggggcttgtcggccgaggctttcaaaacgacgccacggatctgagcaacgtcggtcacgtcggcctcgacgtactccacgccgttcaccggctgactctttccgatggagtcgccgaggtcgacggcaaacacgtttgcgccccgttcggcgagaacccgggcggtggctgcgccaagacctgacgcgccgccggtaacgattgctgcagtattgctgagctccatattaattgctcctctgtggggcgcttgcttccgggacggtgcatgtggtgatgccggctgttattggggggatggcatggggctttgagtcaagcgaacgccgagatacctgtcagtgcccgcccgaccaagagagtgttgatttcgtagctgccctcgtaggagtagatggcttccgcgtcagcgaagattttcgccatctcgaagtccgtgctgattccattgcctcccacgattgacctaccaagagccacggtcttgcgcatccgctctgtgcagcttgcttttgccagcgcagcatggtccatggtgagaaggcccgactccgtgaggcgtgcgagttggatcatcagggaaagggacatggttgcgtttccgatcattcgggccagttggtcctgaatgagctggaaggaagcaattggtttgccgaattgcttgcgctggagcgcatatgccctcgcaacatcgaatgctgcaaactgctggccgacggcctgccagctgacccacacccttgagtgaaggaggagggagttggcgtcccggaacgttcgtgttcctggcagccagttggtgaacgggattctgacgttatccagagtgatgttggcattctggataatgcggacagctgccttgttcggtatggcttcagtgcggaaaccctcggtgcctttctcgacaatgaaccctttaatctggtcatcggctgtatcgcgggcccagaccaggacgtaatccgcgaaggtaccgttgccgatccatcttttgtgcccattcagaatccattcatctccgcttcgcgttgcagtggtttccatctgcctggaaatgtcggacccgtgcaggggttcagtaagggcgaaggctcctactttcttgagcgacagcaagtctggaagcatggtctgacgatgctcatcggaacccaactcgcggatcgctgtggtgaacagttcgtcatggacgccaaagaacgtggacacggaagtatccgcgcgtgcgaattccatctgaatcagtccggccaatagatgcccacggctattcagtccggtcaattgctgcttgcccagtttgggaaggagctcgaatgggaattccgctcgattccaaaaatcaacggcaatgggacgtacttcttgctggaaaaagttgcgggcctgggcgagctgggcctgctcggctacggtgaggaggcccgaaaggtaaagaagatccgcctcggggtacggcggcaaattgtcctgagctcctggcgctgcggacgcaggcgggggccctttctggagcaccggcatggttcctcttctctgacgtttggtttgttgtttgacggttctggttcgggcacggccacgggggagcttgcctatggacctgaaagttcgatgggatgaagcgcttctagcccggatctttgtccccgagctggcggcagagtccttcgccttgggagagccgaaggatgctgccgtcggcaacacgactgacccgccgtcacacccgttcggagagagcgtcgatgtttgctgactacaaccgacgatccgatcgggatggtcagtcatctgccactagggagcggccttgtgatggcggccgtactcgagacttaggttgttacctgtgggtggtttagagcagtgccagaccgggttccctaaggagcgcggctgtgtctgccaagagttgtgagccctgctgtccatccatgatccggtggtcaaaggacagtgccagctggaggaccgatcgcggctcgattctttcgccttgttcgtcctctacgacccagggggtccgacgaactgttcctaccgccaggatcgctgcctcccctgggttgaggattggtgtgccggtgtcaattccgaaaacgccgatattggtgatcgtgactgtgccgttggtcatcgccgcttgttcggtcttgccggacctggctgtcgaggccaggtcaccgatcgctgtcgctagttcagcgagacccaggcactgggcacccttgatgttgggcacgatcagccctctcggggtggccgccgcgatgcccaggttgacttcgcggtactggataatttcctgcgcggcttcatcccacttcgagttcgcctcgggcgtccgctgaatggccttcaggaaggcgcctgcgacgaaggcgagcggtgtgagcttgacgtccgcaaactccctgcggcggcctatttcggatttcaatgccagcgtccgtgaaatgtcgactgtaacgaattccgtgacgtgcggtgctgtaaacgcagactgcaccatggcagccgcagtgtgtttccgcacccccttgataggaatacggatatcgccgccagcgaccgggtttacctgtgccttcagagtaccaatcggggtgtcgctggaaccattgtcgctggcgtgtgcccggagcacgtcttcgcgggtgcatatgccgccacgcccggtgggttcgacggcatgcagattgaggccaaggtcttttgccagctttctgaccggcgggctcgcctttgggcgcccggtttcgggaggtggctgaaccgctgaactttcctgaacttcgcctgggaccgttcgggagcgacgtcgcttactttgaatttcacgtgctccatagccgaccaggagtttgggatcttcctcatccgcggtggctgttgactctggggacgtccctgacctgtcggatccgtcagcaggctcaggtgatgaagtcgcaatgctgatgattggccgtcctacatcaaccgtttccccttgttcggccagcaattcgctgacttcacccgcatatgggcaaggaagttctaccagcgattttgctgtctcgatttctacgatggcttggttaaccgtgacctggtcgccttgtttgacaagccaagtgatgatttccgcctcggtgaggccttcacccacgtccggcagggcgaattgttttacgatcatggttcatctcgtccgttagtagttgaagctgcggtcaaccgcatcaaggattctgtccaacccgggaagccactcttcttccaacctgcttgagggtgggcgtgacgtacccggtgactctgattaccggggcctccaaagaatggaatgccgcgctatgcaccagggacgcgatctctcctccgattcctgcgccaggggaggccccgtgggcaccactaaccgccccgtccgcttcacggaactgattcgcatcggggccgatcaccaaaacctcacacatgggtgcctccttatctgtcggtagtagtgctgatggatctgatatataaccttgagatgtgcctgcggctatggtcaacttataaacaattaactaagcatccgacgtagatgagggaaaatttgcgggatacagctggacgaaatgattagtatcgataggctcgactcggagctcctgaagaggctggacagcaacgcccgtgctggcgtcgcagaccttgccgcccagttgggcatctcccgcaacacggttctggcccgactccaacgtttggagaagcgcggtgtgctccaaaaattcagaccggttgtagacctagaagcagccggcatcccggtgcaggcattcgttggtctcgaactcgatcagcggcagctgcgcaacgtcgtcatagctctcagccagatcccggaggtccttgaggtaacgacccaggcgggcagggaagacctcctggtaagagtggcatccgcaacactccaggagcttcaagctgccgcagcaaggatggtcgatattcccggtgtcaggcacacgaatacaaccctcacagtgtcgacccccctcccctatcgtgtccagccgctgctggaccatttaacgaaggatttaggttggggacgttctactccactccccgactgacccggctctacctgccggaccgaggcgcgcagatggcgtgattgcagcaaagggtcggcatgccaagagtccgccgttttcaaggcattccgcaagcctccaatgccaacgcctgctgagccgttcgcggccccctgtccgtatctctgcggtgcccagtcggggctttcaggagtttgatgtttttggaatctctgcctgctggaagccagcattcatggccgtctgcgggccggccctgagctgccgtaaggcagttctcgtggccgccgacctatgaggttaaaatctcgatttcgacgaaatcggagaaggccgaccgcggcgcggaccacctaataagaccaggtgatacagaatcgatgtgctcgctacgacgacagggccaggtggcgagcatcggtgtgcactgtctttagtgctcgggcggccaggcgcccttgctctggggcgcccggccgtcgctgcaccgggaggcagaacgagtgccgccaaactttttcggggttggtttcacatccgtccacagggctgctaggtattacagcaggcgtgggcgaccgaggcagggccgttgtaaccgcgacctgcgaaccgaactggtcggctcccagagcttccctctggatccccattccgcccggtttgcctagaagttagctgcaatgccgacaggaagtcatagggtcgcccggcgccggatgatcggcgagaaacgccacagatttatgaccaaccactggcatgctgtggctcggaaccgttggagggaacgcccactgcctgcccaacccgctgtcttacgtcttcggagattcgtccggcggttagggcaatatccgctccggcttgggacatcaccccgtacacggggaggatttcaggcattcgttccgacagggcgcggatatgctcagccaccgttccgatgtcaccgcgtaccactggcccggtagctccggcggcgcctcgcacgagtgcattttccagcgccgccgccaccgccgggcgaagcacttcagatgtgtccttaatcgagatgctggcgagcatggccgaagactgaacaatcagggttaccaggtgattgctggcatgggtcatcgccgcgtggtacatgatgcggtctgattcgtcgaccttgaaggggatcccgcccatgtcctggacgaggttctctgcggtcatccggtcctctgcagtcacggcaaaacgggcaccgactatacggctcagttcggtgtcccggtctccgctgaaagccattgccgggtgcagcgctatcgccgcggctccctgctcgctcagggggccaagcacaatggccccatatcttccgctgacgtgaacgacattgacgccgcgccagtcgtttccctccgcggccaaggtctcgacgaggccttgcagaacgtcatcgggcacggcgagaagtaccagatcggctccggcggtagcttcagcaaccgttgacgctgcctcgaaatcccccagtgtttcccgcgccccgtctatggcagttggcgacgggtcccacacggaaaccacagtgtggccagcgcgaaccaacgccgttgcgagaactatgccgactttgccagccccaaccagaccgattgagtgctggtgacgactatgcacgggggttctcttcggacttgcgtgagttttcctgaaggcgcctggttatagggcgcataatgcttcgttcgagttccggcgtcccgtcgaggacaccggcggcagtgatcagtgccactgttaccttctttcgttgttggcgggcgcgtttcagccatcagccagctcatggctgtgtcagggagggtgtgatcagggcttaccgttctccgccgaaacgccatcgctgcgatcctccattctcagcggtgcagcgtctcgggctagagccctaaaatgagaaaattggaatactttggatccagacggttcacaggacgtacgttccactgtgccgcgacaagcggaacatgtcaatagctgctagaagcggtgtgccacatgcaatactgcagaatcaagacatgcaagaccgcacatcccagaggtaaggccggtgactttcctggccgggcccgttgtggcgaaatggtagtgcggttgctggtttaccgggcgccggagcagtaactggtctcatgcccggtcggcacgcttttggctcgactaaggttgtattaacgaaaggttgtggttggtgggcggttcacagtcaattcagcgcggtcgcggtgacggcctcgttgatgctcctgctcggcgcaaggtccctttggtggatgaagtcactgcgcttctgcgcgagcgaatttattcgcagcagtatcctacaggggcatggctaaagcaggaggagctctccgaggaattgggcgtaagccgtacgcctctgcgcgaagctctgcggcggctggaacaggaaggactgatcaagtctgacgcgcgccggggagtcagagtcatttcaggtgatgtccagactttgctcgcggcctacgagctgcgggctgtgatcgatggcttagcggcgcgattagctgcggcgaacgtctcggttgcacgcctgcgtgaccttaggcaagtcattgctgcgcagcgcaaggctgtcgaaccatggaacccgcgggggtattcaaagctcaatgttgatttacacgaaatgatcgcgcaaatgaccaacaacgagtttgtgattgcccagacctccattattcggatgacagctcaggtatttgcccccgtttcgatgatcgagcccagcagtgcacttcgcgcaatcgatgagcacacagcaattgtcgacgcgatcgaattggcggatggagtcacggccgagcgcctcgccagggaccatatcgagaaaacgatccatcagctccgcagcggcgctccccgggagtccacagcaggatatttacgagcgcctgcctagctgacagcgccctgggttgcggagtagtagccggactggcctaacggctagacctgtcggattggttcttttggccctgtacagcaggcacgccaaatcttgactgggtccctgctgtacacggtggggtcagatcgcggccatcgccgtcatgatggatgtctcttcgatctgggaacttatgcccgtttcgtccgtgattcgctcagcgatccgatcgccgatctgctcggtcgtggcccccatacccgctccggccaaggccgggagttcaccaagtaccgaagccgctgcgttctccagagccagcgctgccttgccttcgcccaaggatgccaggcatagcgcggcggagagtacagccgctgccggattcgcccatccctttccggcaatatcgggcgcggacccgtggacgggttcaaacatgctgggtgcggtgccatccaagttaaggttggcgctggccgcaacgccgaggcccccttggatggtggcgcccaagtctgaaatgatgtcgccaaagaggttgtcggtcacgattacgtcgaatcgctcaggattcattggcatgtgctggcacattgcatcagcatggacgtagtcaacttcgacgtcatcgtactgggcagcgtgctcgttgacgacgctttgccacagctcgccggcgtggacgaggacattcttcttgtggcagagcgtcagtttaccgcggcgtgctcgtgccagccggaaggcgtaatcgacgacgtcagagatggcctgggccgtgttaaccgattcctggagagctacggcgttcctggtcccggcatggactgtcgaccctccgcccacatacatgccctcggtattctcacgaacgaccacgaaatcgcaacgccccgggtcgagatctttgattggggtcgggactccgggatagaggcggacaggtcgaaggttgacctgctggcgaagctcgcggcgcatcctcaggatcaaaccccgttcgaggatccccggggttaccctaggatctcccatggcgccgaacattatggcgtcgtggtcccggagactgtccatggtgcctgggtcgatgagtgttcccgtctccagatatgcctgtgcacccagcggatattccgtcgtctgcagaccaaaaccgaagcggctggccgcggcgtggagcgctttgacagcctcccggttgacctccgggccgatgccgtcgccgtgaattatggccaagtcataagtagtcaagaatatcgcgtcctaattcgtgaggttaaagtcgggccgaagctcgtcgtccccgtcggacgacatctcttggtgatgctccgccggtgtccgacaacaaggagatgcagcaattaaagaagcggcctgctcggacttttcgcaacatccgaggactcacggcttctttggatccagaggctctagtatcccgagatgaacgacttgcgtcaacagttcttgccatttcggtgaccattgaagcgacaattccaaggtcgaagcgcagatttatggcgcccgtgattcggtctttagctgctgtgcttgacgtgagactgctcgctagcgcattctattagaagctaccggccttaccagtggctactaacgacccccgaaggagtggaccgaacagtgggcctttttaaacccccttaccccaatggactacctattgccggagaatgggttaccgacggcgtcggtacgtccaccatttcgtttccctacgacggctccgaggtggcgcaagccccggtcggcacaaccgaccacgccagaaaagcactggatgccggcctcagcgctcagccgctggtcgcagcgctgcctgcatccacccgccgccagctgttgttggatgtccgccatgcccttgagcagcgccgctccgaactcgaacagctcctggtgacagaaacgggcaagccgcttgtggattgccgaacggaagtaagccgcaccctgttcacttgggccgcggcggccgaggccatttccgccctccatggggagacggtcccgctggacatccaggcgggcggcgaagggctgatcggatactggacacgcaagcccattggcctggttatcggtatcgccgggttcaactatcccctgctactggccacccacaagatcgcaccgagcatcgccgctggatgcgctgtgatctgcaagccggcacccaacacgcccttgtcgaccttgtggttggtccacctgattcgtcagtctgcccaggccctgaatgtcaccgaggacattgttcagatgatcaccggcggcccagaagtcgggagcgtccttaccagcgatccccggatcggtgctgtcagtttcacaggttctgcagctgtcggacaccagattgcgcgggactgcgccccgcgcaaggtactacttgaactcggatccaatgctgcactgattgtggcaccggatgctgatctggatgcagcagccgacgccgtcatccgcggcggcttctacggtaacgggcaggcatgcatatcaatccaacgcattgttgctgacgaaagcatcatcactgatctttccaaacgggtggtggagcgaatgggagaggtggtagtcggggaccccagaaatgaacaaactcgggtagccaaactcatcaatgaagactcaacccggcgggtaacagaatggattgacgaagctgtcagcaacggtgccgagatcgccttcggcggcggaaccaaggatgggcttctcgaacccaccgtcctcgttgacgtcccgtccggcgtaaaggtttgggatgaggaaatcttcgggccagttgtgtgtattcgctccgcgcccgattttgatgcagccatagacctcgtcaacaaatcccgctacgggctgcaagcgagcgtttttacagcctcgcttgccaaggcctaccaggcaatagacgggctcgacgtcggcggggtgatcgtcaacgaggtccccggctaccggaatgacacgatgccctatggcggggtcaaggattcaggaacaggacgtgaaggcccccgcttcgcaatggaagaactgaccgtaacccgcatggccgttattcgccctgacaggagaaccgcaaagtgaactacagcaacctttttcgacttgatgaccgcaagtccttcgtactgggagccggaagcggcatcggccgtgaatcctcgctggcgttggccgcccatggcgcccacgttatctgcgccgatcgagacttagatgcggccaagcacacagcaaagttgatcgcgaacgaaggggggcacgcccaagcgtacgaactcgatgttctcgataccgatgccgtcttcgctgccgctgccgatcacccagatgtggaaacactgctcttcaccgcggctaccaacgtgcgcaagaggctgctcgactactcttctgaagagtacgaccgcgtcgtaaacctcaatgtccggtccagctttgaccttatccgcgcctttggcgccaacatggtccgccagcagaaggggagtatcatcgggttctcttcagtgcgccacgtggtggtcgaacccggacaaggcgtctacgccgccaccaaggcagcaacggtgcaactgctccggacagcggctgcagagtttggcccggccggcgtccgggcaaatgctgtagcgcccggatgtgttgacacgcctttgaccgattccatcaaggcaaaccctgaatggtacaacgcttatgccaccaagggggcgctggggcgctggtcccagccgagcgaactaacgggcgcagtcgtttacctggcctctgacgcgtccagctacgtgaccggaacggtactgtatgttgacggcggatggacagcagtggacggccggtttgatcccccaacctcatagggcagagtcccaagaccgggaggtctgagaaccaaggtggaaagaaaggaaggtgcggaagcgtgaacaccgagccatcgcagcccggccgcgcctatcaggtgatcgctggccgcgtagagagcgctattttgtcgggcgagttgaaacccggagaccggctccccagcgagcgggagctcgtggagcaatatggcgtcagccgcccaacggtcagggaagccctccggttgcttgaaagcaaccatctggtcaaatcgcgtctgggcgaccgccgcgggcccgtcgtccttccggccagttcccactccttacaaaaatcattgacgaggctcacttccggagacattgtccggttcgcttctttgctgcagttccgcatgattatcgagagcgctgcagttgtgctcgccgcaaccaatcgaagcgagtcggaactcctggaactggaacgcgcgaacgcacgcatgcgggcgagcattgagttaggttatgaggatttcagcgcggctgacttcgattttcaccgcatcgtggcgcgtgcaagcggcaaccctttgttggagctttccggggaggcagtccgtgaatccgtccttaacctcatccagcaacgcatcatcgattccggagacagccggggacagatgttggcttctatccggcatcatgacgaattactgcatgcgattcggcatcgagatggccgcctagcatcgtggctcacccgggatggcttgttttggtactactacgattacgtggaggaaaaggagcggcctgggcttcggtctctggccgatgaagttcgtccggcagagaacgccggcaactaaccggctgccctgcctgcccttgcaggactcctgccaggggatgccgcgagccgcgtattctcctgtccacttgctcagttcgcccgtcaggaatagcgagtggcaccgtcaaagacccctgcctgcgggcatgagtttgacgggtactcccaccctgaactagatagttgccagacctgattcccactgctgtagggatcgcaccaacggtgctgaggcgatgaagggaacaggcgtgaccactttaaggaaacccccaaaatgcaacagcacacatcacctagtgaggggcacatcaccgttcacgaaagttcctcttctctcgccgccgccgtagcccggcgtcgtgctgcaggtcggtcggtcgcgctggttacgaccatgggcgccctccacagcggtcatcaggaactaatacgccaagccggctccgacggtcggacttccgtggtggtgtcgatcttcgtcaatccgctgcagttcgggcctcatgaagacttcgcccgctacccccgtgatctggaggctgacgtcgccaaaagccgcgaggcgggtgctgatctcattttcgcacccagcgtggacgagatgtacccgtcaggtggtgcaggcgtagtgaccatcgttcctgggccgctcggcgacgatctggaaggtagaacccggccgggacatttcgcaggtgttctcaccgttgtggcaaagttcctaaacatcgtaaggccggaccgaatttacttcggcgagaaggactaccagcaattggtcttggtccgatcgatgtcttccgacctcaatatgggcgtagaagtggtaggcgtgcccactcggcgtgacgccgatgggttggccttgtcctcacgcaatcgctaccttactttcgagcagcgcaccgctgcactcgctctctcccaagccctgagagcggcagcagcagccgccggcggaggaccccgcgcctcgttggaagccgctcatgaagcgctggctgcgcaatcagaggtggttcccgattacgtggaactacgaacggccagcctcgctccgtacagcggcggtacggatgcccgactcctgatcgcagcgagagtcggcactactcgcctcatcgacaatgctcatctcagtttccctgagacctcctagccacgggcatttggaaaaggcaaagctgaatcttacggcttcatatcagctgtccgaaatctacgtggccgcccaacgccatcaacattgatcaacacaaccaaggacctatgagtaacgaaatccccgccaaagtatctgatgtcttcgatcccgctcagtggcgcgaggtctcgggtttcgattttcaggacatgacataccaccgccaggtgaaacgttccgcagacggcaccatcaaggacctgcccacggtccggatcgcgttcaaccgccccgaggtccgcaacgcgttccgccccgtcacagtggacgagctctaccgggcactggaccacgcccggatgacgccggatgtagccaccgtcctgctcaccgggaacggcccctcccccaaggacggcggccactccttctgtgcgggcggggaccagcgcatccggggccgcgacgggtaccgctatgccgacggcgagacccaggaaaccatcgaccccgcgagggccggccggcttcacatactggaagtccagcggctgatgcggaccatgcccaaggtggtcatcgcggtggtcaacggctgggcggccggcggcgggcactcgttgcacgtggttgcagacctcaccatcgcttcccggcagcacggtaagttcaagcagaccgacgccacggtgggaagctttgacgccggatacggctcggcgctgctcgcgcggcagatcgggcagaaggcggcccgaaaaatttttttcctggcccgtgagtattccactgaggacatggtccgcgtgggtgccgtgaacgaggccgtggaccacgaacggctcgaagaagtggccctggaatacgcggctgacatcgcccggcagtcaccgcaggccatccggatgctcaagttcgccttcaacctcgccgacgacggactggccggccaacaggtcttcgccggtgaagccaccaggctcgcctacatgacggacgaggcggtggaaggcaaggaggctttccttgagaaacgcgaccccgactggtcccgcttcccccactacttctaaggcaggcgacgtcttcgcaatgtagctgcatgccttgagccgggcggtgggagcgctctggtatgaagcgggtaaagggttgggaagatgtcagtccgcctcgctacctcaccgaggcccgcgggaaggtaacccaaaaagagctcgccaccgtttaggacttcaaaagatttcgtcgccgggtacgcatgcccttcgcaacaggcaccccgaaatccgggccggccccggcgacggatccattaagggcgctgcttcatttggaagcagtgaccccggcttgtctcccggcaatcgaaaatcgaataggccaggcaccacatcttagagagggcaataagtgacacgtattggcattgtggccgagttgggtcgcgagagccgggtggcggcgacgcccaccacggtgaagcagttgttggggttgggctacgaggttgtggtcgagaagggtgccggtgaggccgcgtccttccgagatgaggactacgccggagcaggtgccctgattgtgggggctgacgaggcgtggggatccggagtggtgttgcggatcaacccgcccaccgaggatgagatcggccgtctggctgcgggggcgacgctgatcgggtcgttgagcccgggcctgcggcccgagctggtcgaggccttggcggcccgtccgattacggcgctggcgttggatgctgtgccccggatttcgcgggcacagtcgatggacgtcctcagttcgatggcgaacattgccgggtaccgggccgtgatcgaagcagcccacgagttcggccggttcttcacgggccaggtgaccgcggcgggcaaggttccgccagcgaaggtcctggtcgccggcgcgggtgtggccggtttggcggcgattggtgccgcgtccagcctgggtgctattgtccgggcgacggatccgcggcctgaggtcgctgatcaggtgaagtcgatcggcgggacctatttgaaggttgaggtcgccgaggagatgaagtccaccgacgggtacgccaaggccacctcggaggcgtataacgcccgcgccgcagagatgtacacggagcaggctgccgatgtggacatcatcattaccacggccctgatcccgggccgtccagcgccaaaactcctcacggcggaggacgtggccgggatgaagccgggcagcgtgattgttgatatagctgctgggcagggcgggaacgtggaaggttccgtcgccggggaacggatcgtgacggaaaacggtgtggtgatcctcggctacacggatctcccggcccggttgccggcccaggcctcccagctgtacgggacgaacatgctgaacctcctcaaactcttgaccccggagaaggatggggtgctgcggattgatttcgaggatgtggtgcagcggtcggtgacggtggtgcgggagggggagaagacgtggccgccgcctccggtccaggtctccgcggcccctgccgcccagactcaggcccctgccgccgagagcactgcaccgaagaagaagcaagggccgagcgccgccggcaaggcagggctcttcgccgccggcatcgcggggctgtttgtcgtcaacgctgttgctccggcgccgctgccgcagcacttcacggtgctgatgctctcggtcgtggtcggcttctatgtcatcgggaaggtccatcacgctctgcacactccgctgatgtccgtcaccaatgccatctcggggatcatcgtcgttggtgcgctgctgcaggtcacctcggacaacatcgtgatgcaggtcctcgcggccgtcgcggttctgctggccagcattaacattttcggcggcttcgctgtcacccggcggatgctcgcgatgttctctcgcggtgagaaggcacattcatgagcgccgtcaccgcagccgcagccgcagtaattacgaggagctttaccgtgtctgacaccgtctccggtccgttgaccgctgattccctggcgggggcggcctacattgtcgcgggcctgctgttcatcctcagcctcgccggcctgagcaagcacgagaaagcccgtgccggggtcatctacggcatcaccgggatggtcatcgccctggccgcgacgatctggctgaccctgcaggacgcctggggtaccggccacgctctgaccgggctggtgctgctcgtggccgcggtgctggttggcggagccattggtctctggcgcgcccgggtcgtggagatgaccgggatgcccgaactcattgccctgctgcacagcttcgtgggcctcgccgcggtcctggtcggctggaacgggcacctcgaagccccggacctttccccggatctgacagcggtccaccatgccgaggtgttcatcggcgtgttcatcggcgcggtgaccttcaccggctcgatcgtggcgttcctgaaactttccgcccggatgaagtcctcaccgctgatgctgcccggcaaaaacggcatcaacctcggcgccctggccgcgttcatggccctgaccgtctggtacgtcaacgactcccagctctggctcctgatcgttgtcactgccctggccctgggcctgggctggcacctggtggcctccatcggcggcggcgacatgccggtcgtcgtgtccatgctcaacagctactccggctgggccgccgccgccgcgggcttcctgctgaacaatgacctcctgatcatcaccggcgccttggtgggctcctcgggtgcgtacctgtcctacatcatgtgcaaggccatgaaccggtccttcatctccgtgatcgccggcgggttcgggatcgcagccccggccgctaagggtgacgcggaccagggcgaacacaaagagatcaccgcccaggaaactgccaacatgctgatcaacgcctccaccgttgtcatcacccccggctacggcatggcagtggcccaggcccagtaccccgtcgctgaactcgccaaccagctccgcgaacgcggcgtcgacgtgaagttcggcatccaccccgtcgccggccgcctgcccgggcacatgaacgtgctcctcgccgaagcgaaagtcccctacgacatcgtcttggaaatggatgagatcaacgacgacctcgacggaacctccgtggtcctcgtgatcggcgcgaacgacaccgtcaacccagccgccgccgaggacccgtccagccccatcgccggcatgcctgtcctccgcgtctgggaagcagacaacgtcgtcgtgttcaaacggtccatggccgcgggctacgccggcgtccagaacccgctattctaccgcgagaactcccaaatgctcttcggcgacgccaagcaacgcgtcgaagacatcctcaaagccttctgacgattagtaccttttgagttcccccgtcgcccactgatggagatgataagaggtaatgcccagacaccatgttcccgtcaacggccctatccgaaacagtttccagtccgctgaaccgcaccagcctcctggtgaagaggacgcacctgcactcttgaagaaatccaacattgatgaccttgtagagtccccttggatagggcttcattaccggcatgagttcttgctccactacaagcacgagctattggagttgcatcataggaactgaatgtccgggctgaaccacgtcgaagtattgattcagcccttcaaagtcccgcatttgttatgtccgcgtcctgatgtctgcccaccttccgctggggcgaaggtaaatgccggcggaagggggcattcctaggaacgaatgcaatgctgggtcaaccgagtgtcagccgtgaagacaagaagacggtgaaccacgggcagcccggcaccctcatctcccatgcggccccgtcgtgccgaatgctgaaagactccgtacaagtgcggcttgcgctagccgatagccgcaccagcccaaagccagtaaatcagagctgaggaagacaaatgtccctttatccccaccgttcagccaccatccccctcccaggcaacgagacgatccgcggaacccggacgttgccgaattttcttgcagttaccgtcggtgatgacccacgaagccgggacagcaaactcagcgaggccgttcaccggctgatacctgccgcgttggaacgccgacacggcattctcgtaacggaacgcggaggcggtaactacaccgttgaagtcgatccagccgtgccctgcggcagaatccacgaaaagcgctgcacaacgaactagcctgcggcaaccaccgcagctagtaaccaccgttttccaggacttgccctaacagacctcgataaaccgaatggtttagacgccgagccgactggaatcgacacgtcggagacatgggaatcatgcttggaacacgggcacgtctcataggatgctccgatacgcgtcccatcatgaacacgcctggcgtcagttgcagaatgctgaccttggacaccgataccagggtgactcttacttcttttgatttctctaaatccatcaatgtggactacaccccaacctgacgtcagaagggctttgaaaaaacgtcaggttggagtccacttcgccttttgggcactcccccaccaggcagtctaagattccagtctgacggaggctcaagttcctaacaaaggttgctctacaacccaacgctgatagttggggctacctaaagcgtctcggtgtgtggccgaagcgctcctgcgcagttcgagcggacgtgccgagggcggcgccgataacctcccaggagtctccgttcgcgcgggcggcggtaacggcggcttccaactcggcctctgccttcgcggcagccgtacgggcagccgtgatccggcggaagtccagggcgtccctgtcagtgtgaggcgccgggctcaggcgaaggagcgtaccatccacccgcagcggcgcggctaggtgatcgatgtgcaggacgtaaccttcttcttcgggcccgcgctgtacgtagacggtgaggacggtctttccctcgccgtcctcaaagtccactttcccatagctctcactcgggccaacaggccatggacgcggcctcaaccgccccgaagcttcgtactgcgccagctcactctccccgaccctattctcgggagcttgtgcttcgcgtggggtcatcctgaccgttctccttcaagttgttttaccactgcaccccgacgctttcgcagcggcattcgggcgagcgctctagtacagataccagtacaagccactaccggttgaagcgcacgagtacttggtactcgatcctccccgcccgaggcacagtccgggacctagtcgacgaggatatggtcacaggcgcatctacgctggagtcctccagcgccgagtcagctgatgtagacgtccgggagaactttggagacgctgttactggcgtgtgtcaccgataaatggcccgggaactgtcgccgaacacgatccgcaatgggccggagcctgatggatgccgaaaccgagcgggatgatgccgtggcgccgtccgggccgacgtctcttggacagagtcggaagggcgcttggcatcagccgacagatgacccgagaatggcactcgcttcgaaccgcctccggaacaaagagaatattccacgaacgggttgaacaggttgcccgaaaaattgcccgatcgggcgagtcaactatggcgctggcagaccaagggattcgaccatccgttgccgggggcgtataccagctcgttctgctcaacgagcttgggagatacaacacgcccgacagaccggacgcgctccgggtttccatgcctctccctcagaaaagggtgagctgtccttcggagacatcccgccagtgcgccggccggtcacgtgccacccaggcgcactcgatggagcagaacttccgacccttcgctcctttccctcccggcagcgtgaaggtcttcgcgcagagcgggttcaggcaaaccttgtcgaccgttgtgctagtgcgcgatttgaacacgcactcctgcgagcagtacttacgcgtccgagccacgtgggctctgatcaaatccgtctttccgcactgcggacaggtccaatggacccgcggctggcgctcggtaacctcgtcgcgggcgctgccttcacgtggtgagggatgctggaagttggcccgaagcgactcggccggcaacggccaggcgcctcgtttcgtcgtgttgcacctcttgcagatggggcgaaggttggacaggcagtgggacccgcccttggagatgggtttgacgtgatcctgttcggtggcgtcggcgattccgcacatccagcagcgtccgccccagagtgcgaaccgtgctgctttctgggctggcgtgaagtcgatcatgatcccaccgggcgccgcctggtactggtagcggcgccgctgataagcgcccttgttttcctcgtagtaggcccgactgcagtccttgcagtcgtgggaaagcccgttgcggtgcttgcgttccttggtaaaccgctcggccggcagaatgtgtttacacctgcggcagaccgcgaaaagctcaccggtctcgcgggcgagctcctccagttgggaggtcagcgcacaccggtccgaacaatgagtgtcccccgccattctgcgttcttccggccggattttcgagcaaaccgcgcagccccactctgcgaacatgcacttgcggctgcagaagtggcggtccgctgcttcgctggctttcctgctgaaaaccattccgcagtgtttgcaggtgacgtcccggcggccggatgcggaccgacaggcaaccgagcagaaccgcgccttcttctgccgcgccacggtctggcgccccttcatggtgaactgctcgttgcagtgctcacatgccttgtagatgtatgtgtgcgccatggccgcccctccccctggattgaaagaaactaccacctgtcgaatgtctgacggcacccccccttcacaggagctgaattccaacggctgcatcccccgccagtattacctttcacaatcagcccgggcctacatcacggcttggctttgagggtgcttctcagctcagggtggataagttcgaggattcgacgggttccactttgaagttctgcttcgcactcatcaaggtcctcggaatccaggacacctgaaagctcaagctttgccgtatagcctattgcaagcccggccctgtcaatcgcttcctgtagccctcccagcaccgtatctcgcacccggatctggaaacgggcgaattgaatcgcccgccaggccttctctgggtcaagcatcccctcggagaaggtgttacgccctgcccagccgatggttctggttcgcatcagcacgtgatcgttgatcagctcaccatgtgctttgtagtcgaatccggaattgcgtccgtgctcccccgtaaggaaatcagttgccacgcttatttgactgctgacctcccgcagcagggaaatcattctcgatgaacgtcttgcccagggagacggaagcgatacaactacaagattcctcgaatcaagcggcgctgtagacctttgcgctggttcatctagaacttctgaatcgatggcataggcctggcgatacttcccaaatattttggagaccgagtctcggggcaagatgtgaattttgaaggcaattggcttaccgtcttctacaccgtccttgtagaagtattcgatttccaagtagagctttcctccgacgatgtcgaacgttgcaggaacgaggaattcacggaaggcttcggccagccttgcgtgcccataaagatgggccggtaacgcgttgacgacaagttcatggaccgcagggttcgcgggtactagggctaattggaagccctcatcaaatccccgcccatacggcaccgactttgccacatcttcaagaaaccagttcacatacatgccctccttgggcactgatcgtcgcccaataagtcgtgatccggagactgcatcaatgggtgccccgcggggtggccgtgcacttgttaggccttcgaaaaaatcatccccgtacattggactgtcctggttccggttctgagcgccgagtgctctccgagcgataccgaccgatttgcttttgtagtgatcaaccctgtgcccgatgtcggttccttcaggtaggtggccaactagatactcggcgataaaaagggtgtgaagatcgtcgtgtatcccgtaggcagatggaaccagggcagagacgatcgggcttggatgcggcggtttacgctttccagcaaagttgtcccagccatcctttcggatcccccgctgctcgaacagatcgttcaagaccgttgatctccggcttcgctctagtcctccggctgtcatagcgaacgattcgtcaataaggctggccgcggccatgagcatctcgggggcctgctcgttagtggcaaagaggttatcccagccttgcttgataaccggccatattcctctgccatcaacctcctgcatcagcagtgcataaccagagagttccatgcacccgataagtggttcagcggagtaggtaactcgagactgtgtatttagattctttaagtccgatatcagtcgtctacgggcatgctccatctcgaagaagcatgcctcataaagggcaatggcagcctcatcttgaccctcaagtatcgcgtcgaaggcgccattgaagacgaattggtacgcctggccgtagaggtcgggctcctgcgaatcgaattgattacggcgaagggcaggtatcgctatggctagttctcgcagtatgcggcggcggtccgaggcagggtcaagggaattcaccgtttgctcaggccactgttcgttatcggtattgaggttccggtagctcgccagcttttgctctgccgctcggactgctcctcgatgaacctcgattttgtggagcagctccagtgaagccattccgactacagcagcaaggtcttcgcggccttcagagcgaaattgcgccagccggtcgaaggtccgcgaatgaaccgcgtcgagcaaggcggtctcagtttgcagcagtgcttccgtcatgcttcgggctgcgtaatggcttgtccaccaacccggagttacgacgcgaccttctacgcgtttctcgcgtgcaatagcagcagcgaactgttcaagtaggtggcgagtggccgttgggagttgtcccttgtaaagggcagaaggatcatcaagcgccaagctccactcatgaggcaggtcgcgctgctgcagagcttcggccgcgtggacgaggccaagccacatgtgaattagcggaagcaccaagcgctcagcagctgccatctggttaagcttgactgtcgatcccgagatggcatcgccgccggcctcctgcgaagtagcgatgctagccacagctttgctccaagcgacttcgacagccaaggcctcctcgacttgcaaccgagcagttaggtttacgacaagggaaagaacggagtcagccgtggcaagggcatccgctccacctctggcacggaaagcagcccccagcgtaacctgcaataactccgcaatctttttctcgagccatagataatcgggctcagtttcaggatcaaacccggtggaagtccggatagctatatcaagtctggtgggatccatagtgagccagttgtgatgcttaggcacttgattccaccacttgctgtcagtaggaatggcatccttattcacggagtacgcggtcaggattgctagcagttgctgtgttatggccaagggtgctcgagcgtctcggagggtggaaccttcgattaggtgcacgatgtccacatatgttgccaggctcgtctttgcctcgtactgggcacgggtctggcggacgtcattgccccgtgatttggggtcagaagcggtacgcatcgcgtgcagtaactgaccagatagagcacgactgagaagtgagggatcgaaaaagccaaacagccgctgaccaagaatcatcagccacacggacgtcatgacggccaacgcagccatgccgagtagcgtcaatcccgtggcgttgtagccgagcgcacgcatcaccaggaggacaagcccgccagcgagggtgagtacgagggagcgtatatagatttcgccatttcgctccctgacgaagagatctcgtacttcgccagagacgtcccgatagatggtcgaggccacaacgccgaccgttgcatagtagaggccaagcagagtagcggcaatcgcaacgccggcccctacgaacgccgatacgtttccgtcgctcgatgaatcaagggcactaaggattggaagtttctgatcccctacgacgttacgaacgacacttgcagtgacttcgagtaaagcgatcccgccgcctaccagcaggagcgatcctaagctcgatacgaagagatgccgtacagcggtgaaagccttttttcgatcggccacccggtgcacaaactccgtccaataaatggcccttcgacgttttcgaccgattcgtcgtgcccgtcgcgaccaaaaagctggagtgttgaagcgccgtggacttactagtcggcgtattttcattctgcccattccaaggctgccacaatgtgtccttcatcggggagggcctgctgttcctctgcggggagcttgtcgtaggtgtatgcagcgattgccatgggtgacgtggagcgtccgaggctgtaccttacgctgcggtcgtttttcgtgccgcagatgagaatgccgatggtttcgttgtggtgttcgcggcggaggacgtcgtcgacgagggcgacgtagaagttgagtttgccggcgtattcaggttggaacttgccggtcttcagttcgatgacgacatagcccgttaaccgtactaataaggcctgcagcgaattggtatcttaggtcgacgcatggacggatgagcccaacgtctaggaactacaccaaacagcaagtggagccttgattgtcgtgttgaggtactcccttgtggaggccagaagatccagttgctgcgtggttgctttggaagccgacaaacccggttgaacgataaccatgtctagccgtgggcgaaggaggacggctctgtccctaaattcatacaacttatgcacgtcccccacctcaaatgggctcacgcccgtacgtttttgcttcttgttagctcggtccagaagcgtcgaaaagaaaggtgttaggtcgctgcggcgccacataaccgacttttgcgcctgtccgcaaacctcgtaaaggtctgccactcgggccccaggagtttcaccgtgcgaatatttgcagtgaacgaagcgaaccactagaccgctgtcgtcaattctcatcgccactacgtccgctatttcaccggcgccgtcatcgtcgaggatgatgtcccagggaacagcatcgctcttgagttcactgattgctttgaactgaatagagtcctgacgccgttgcgcggtctgcgactcgacattgagtagagtgccatcccagttaaggggtttgagtgtagatctatcgaaaggctccttttcccaggtcggccgatacagcaggttgccctcgatgatccggtcgtcattcagggtgaggagaagacctgcggaattaagccagtcgctgagtcgcacctcagagcgagccctaacaaccatgacttcctcatcgggatttgtggcgctgtaaacaaggcctcccttttccactgaagcttggtacccaaccttccaagcatcagtgctgacggtaaaacgaaaggggccggtcgtggagtccgtattagggaccagatcggtataggccatctcacaagatttgtcctgatagacaaggcggatgttgtcagctcgtcgcgtgtgtatctcccaaggccattcggcagcaaggagtacgccttcggggcgttcctttattggctcggggaggatgaactggccgatgactttttcgatgctgatggtgtcgtctagcaacttactgccgatgctgtcgcaccagtcgcgccagtgtttcaagctcctagcggtctcgtgggaccaaatgcgtcccttcagtgaagcgctgatgctgactctttcaccgtcccgaaagccactgcccgaaatatttgtttgcgacttcgttccggcctccgactgagaaaaactggccgtaacgtcagatccgacgtgcatagagaatcgacggaatctgtcgtgcgcatcgagcacgccgacgttggtaggaacgagcctctcaatgtcggccatgacgcggtagaccgtagaaccggtaaagcgcgaggcaccctggccgaggaccgcttcggctaggtcttcgaagaccccgtcgttagcggagttgttgatgtagagcatcctgctattcctgtcgaagtagaggatgtagagggcgtaggtgatttcctcaatggtcttcaattctccccaacggacatcattcctgctctcaactacgcaccaagccaccccggcgtccgcgttgagcccgatgggtaaggtcagcaactgagcttctccgaaaaactccacaaggttcaggggctcccactcgtttcgcggagctcggtaaacgactgtgctcattttgggcagaagactccggagggcgacgtcttccgggaggctggaaaacccatcctcgaagtcgctgacctcttgctgctcttctactgcctcctccgaaaggttccgcaggacaacgttccagttagagtcctccgcataaaggcttcgcaacctcttatcgacttcaaaatcctttcgggccacgaagacagacgcacctccgtactcgtctccagctgaggtgcgagcgaagcgaccaatgaattgaagagtgactcccaaactcttttgggggtcgtgaactgcagcgatcttaagggctggcaggtcgaagccctcaccgagcatatttacgcagatgatgattcgagactgacggtcacgaagtgcgttcagggcctcgcgctgttgcccttttgccatctggctgttgataatcattgggcgcatatcggcggcgatggtgtcgtaataaggtttgatctccttcgcccgccgtatgccgttaacccgaaccataagaacgtggtccaggccggcccccagatcgtcacggagccgtgccacgctttgctttgcgagggccttgtcgacgtccacaaaatcgatgactccggtgtagtcgatagtcgagaagtagccctgcgcttgggcctcgcgcaaggggaacgagtacaagatgcggccttgcagatgtctgccgtcctcgcgaaacggcgtcgcagtgaactgtacgacccgttttgcgtcgaaatgacttcgaattgcagcccacgtgttagcggctacgtggtgagcttcgtctatgaagaggtgcgaacatacgtcgagaattgcttctcggacttctgggctgctggcgtctagtgcatgtggagtggtgacaatgacattgcaagcgctagcaaattcttcagcagcactgactgtcgtaaaacgatgctgaatctggccgacgactgggcgtagggcggagctgctcacgattccgagtcgttgaagcacgccgagcgtctcgaacttgtcagctacttgtgtccgcaacgcatcggatggaaccaagacaagcagccgcgaaggctgagccgcaaccagaagtgcaagcatagtttctgtcttcccggttcctgttggcatcaccacagtcgcaggaattgtccggttagttgtccaatacccgagtaccgcatgcatcgcccccaattgcgggggacggagcccaggcgcgtcttcagtaccttcggtgaaactgatagcgctcctatagctggccaagacatccttggggctgaggcgaattagcgggttcgctttaacccattcggctcgttttagttggtcaccgggcttggaacctacgacaagcctcgcccatacttgctccgtatctagaggattctctccagccgccgctggccacctgccgtattcattagaaacctctaaggaaccctcacgtccttggacgtgcgtgaagcgaccggccggcactatcagctgcctcacaacgttgccttcgaactgctcaggcttggcccatacattcgtgcaatgccagctaggttgagtctttttatcagtgtcttccgcagacatcatgttcaggacgcgtccttcgttttccgttgcggatactccagctgcacccacatgtctcgaagactaaatgactattcgaagaaaatatgcaaactacacggcgagtgactactgagtcaggtgggcgtaccctgtcgtcgtggccagtattgtcactcgatcccgctgggatgggactacggcattctcaattcggtggcgggactataagacccatcaacaacgtcgcgtgactctggggtcagaggaggaagcccttagccttctgcggagcctcaatgagaacaggcagatgcaggagccgccttcgcccgccgatcatttaaggaagtcgggcgttcccaacgtggcggaagtagtccaggagcatatcgacctgctggttcgtccctctcccgggaccatccggacgtatcagcgaattctcgacctgcacattcggaacacgatcgggcacattccgattgacgaattcggctaccgggaggtaatgcgctggatcaaggggctttccgctgtgggtgtcgcgcctaagagtatccacaacatccacggtgttctgtcggctgcgatgaagaccgccgagttgctcgagtacatttcccgcaatccctgccgaagcgttcccctccccacggttgaaagggcaggggaggaagctatgttcctcacccatgccgagttcagcatgctcattgaaggcatgcatgagccgtataagactttggtgcaattcttggtcatgacaggggcaagatttggcgaagcgacagcgctcaaggtcaccgatatcgatctgctgtcgaagccagcgaccgcacgaatcaacaaggcgtggaaacgcgacggaaagtcccgttactacatcgggccgaccaagactggcgcaggaaagcgcaccctcgggctcaatcccgctttggtggatctgctaatccccctcgttgcaagccgcgtgggaaacgagctgctgttcgtcacggccgacggccgccgcatcgcgcataaaccgttctggcaacatcactgggtgccggcagtccacgccgcccgcgcccgcggtctaacaaagtcaccacggatccacgacctacggcatacccatgcctcatggctcatccaggacggcgcaatatcgcttttcgctatctcccgccgcttgggccatgcatccgtgaggacgactgagcaggtgtacgggcacctcatgccccaagcgcttcaagatggtgcggacgccacggaacggtccgtccggggatttctcacataggtttgggttttccgttttcagttctcgccaccggagtccggcaccgttccttgctccagggccgcagtaattgcctccggtgatggcagtgccgcccgttcctctggtggaagggagtcgtaggtgtaggaactaacggcgacgggctgggatgagccgtccaatgcgtagcggactgttggctcatgcttggagccacacaccagaatcccgactgtaggggccatccccggaaacttcaccaggtcgttgacggcggccacgtagaaattcagctgtcccaggtgctcgggcctgaatttgcctgacttcagctccacaacgacaaagcggttggtcggtacgtgtaccaggagaaggtcaatgtagaagtcctcaccttggacatctaggtggaactgccgcccatagaaggcaaaccctcggccgaactcagccaacgtctgggacattcgctgcgtcatggcctcctccatcgccagctcttcgacttccttggtcagtccgaggaagtcgaagaccaacggatccttggccacactgcgtgccaacgccgccccgtcctcggatagacgttcttcaaggttgtttggtgcagcacccgccctgcgatgcagccccgtggtgatctggtgctcaaggacttcaagtctccagttgtgctcgccggctcgctccgcataccagttacggatctcggggtctttcaatttgagcagttcgataatgtggccccaaggcagaccgccaacccgcgcctggtccacggggtcggacaggtcccaggctgctgcgaaggcccgcatgtagaagaggtttgaacgagagaatccacgcatgtggggaaacgctgatttcagatccgttgccagtcgctgcagtatcttggttccccagggctgggctgcctgacgttcgaggatcgtggacccgatttcccagtacattttgaccatggcattgcttgcggcctgctgagcgcgtaactgcgccgagctgacgagttccttgagggaaacgaggatgccggcatagccgttgggcagttcaggttctatctggggcacgcccccaccttagtcgttagagccgacagagcccctcgaacagcctgcgctgaatagtccaaagaactttggacaattcagaacccactcctgtctggcttcccatccttgcaacaaatagtccagagaactttggacaattgggcgacagacagcggatcagccggctttggcgagcagatggccgctcacccatgggttcgggcgcatggcggagtgtcgtgcggccggtggcctgcggttctgcaaggctcagttatggactggaccgattcccgtcaggagttccgttctccacgtgttctaccggacaccgccttgcccaagatcggccgcgtcacgaaaacggcggacagctcattgccatggcacgtcaccggcctgaccgccgatgccaaggaaatcgatgacttcttgctcacgctggccacgaatgactgcagcccgcagactcttcgttcctatgcattcgaccttctgcgctggtggaggttcctgtccgccatcgggatccgttgggacaccgcgacgcgggaggacgtgcgcgacctggtcctctggatgaggcagccacggcaggcaggcagtcgggcttacagtcccacctccatcaaccacatgctgtcggtactttttgtgttctacgagcatcacgcccggcgagggcaggggccggttgtgaatccggtacccagcgctgccctgggaacgcgtcgatacgagcatcacaacccgcaagccccttaccagccgcagaagcgggcgctttaccggcagcgcgtcgtcacagggacacccagggcgctctcccacgacctcgtaaaccgggtcttcacggccctgacctctacccgggacaaagcgctggtggccatgtacctggccacaggcgcccgggccagcgaactgctcggaatgaaggcccgggacgtcgactggggcaaccagataattgcggtcgtatccaaagggactcgcgcgtaccaatgggtgcccacgtcccccgactcattgacctggttgaggctttaccttggcgagatgcccttgaactcgcccgaggatgccctgtggcgtacccttcgtccgccttatcgcccactgcaatactctgctttgcgggcagtgctgatgcgagtaaacaaggccctgggaaccggcattacgctgcacgatttccgccatacctgcgcttcccggctggccaatgacccgtccatccctcttaccgacgtgcaagccgttctcaggcacaagcacctaaccacgacgtccaaatacatccacaccaacacccaggacatggtccaacgcgtcctgcagcaccacgaggcgcctccgaattcaacaccaacacccgcttggggatacgacccgtcagacatggccgagctcttcggtaccttgccatgacggccaccgtgaccgtccctgaggccgcgacctcttgggagtcgtgctccgcgcctgggggcgcccggtggagcctgaacgaaattactgcccgctccaccgagatgctcccaggcaccaggaaaagacaggtggaacgggcaaaaggtttggcctacctcttggaatggcttggtactttccccggcgataactggcagcagcgttggattgcggcaggttgtgaccaggccggcgcgtcatgggggcaacaggatctcattccgtataggaagtcgctgcagggcagtgccgtgatcgctctcgtcgttcttggcgtcgtgcggccgtccatgcattggctgcggaccgctaccccaccgcacatgttcatcacctacagaagcgttgtcgactccgaaacgtttgccctgttggatgagaagctcggcactttccgcctgtcgaaaacctccaaaatgttggctctgaacgcgatgaccctcttgaggatccgtataggtgtcccgttgctgagcgtcacggcatcacagttccttcgtgccgaagctgaatggaaagccttgaggagaacccggtcggtcggcgtggtctggcaagtcctccaggcttgcggggctctatcaggagagccagccgactaccgtgcactgcagctggagggacggcgtacggtcccacagctcgtcgacgcttacggagtaaacaactcgaggatccgttccttgctcatcgactaccttacggagagagctgccgctctcgattactcgtccttggccgggctgacccgcatgctggtccggaacttctggaccgacattgaatgccatcatcccgggcaggacaccatcaggctcccgcacgacaccgcgacagcttggaagcagcgccttcggtacctgtctggagggcgggaacgccgagactactttgcgcacctgaccgcggtgcgggcgttctacacggaccttgcccagtgggcgatcaccgagcccgagcggtgggcgctgtgggcctgtccgtcgccggtcagcgcggccgaaaccagcaacctagccaagcaaaaacaccaacggcagtcgctcatgcatcagcgcacccgaaccctcgcaccctggctaaatgccctcgtctcggcggctgcgaaggagcgcgccgaaacggccgctcttctccaagcagcatcccaggcagcggaaggtgaactcctgaccgttcacgggacgacctaccgccgcgttgtccgcggctactaccgggacaacgggtggccatcggttgagaacctggagacgggtgctgtcatacggctgcgtcgcgcggaagaaacggcgttctggagctgggcgattctcgaggtcctccgtctgaccggactgcgtgttgaggaactcgttgaactgacccatacctccatccggcgttacgatccgactgctggagaagcgacagtcctgctgcacgtcgctccatcgaaaaccgatagggaacggctcatcccagcctctccggaactggcctcagtcctggccacgattattcgcagggtgaagggaccagatgacacccttcccctcgtaagccgcttcgaccctctggaacgtagttggggagccaagcttcctcacctcttccagctcaggcttggcggagttccccgggtactttccacagccggtgcgcgaagcctcctcggcgcgttggccgccaaggcggactgcaaggacatcgacggaacaccgctaaccttcacccctcatgacctgcgccgcatcttcgcaacggagaccgtcaacagcggtctgcccgtccacattgcccaacacctactcggtcacctgaacctcaacacgacccagggctacatcgccgtctaccccgaacaggtcatcagaaactaccgcagcttcatcgacaaccgacgagtcttccgccccgcccaggagtaccgggatcccacctcggaagaatgggcggaattcgagaaccacttcactctccggagggttgccctcggaacatgccaccgcccctacggaacgccctgcattcatgagcatgcttgtgtgcgctgtcccatgctccaagtcgaccctgcccaactgcctaggcttcacgagctggagacgaacgcagtcacgcgacttgaagaggccaagcaaaagacgtggctcggcgaagtcgccgcgctcgaggaatcattgcgccacatccgggagaaacaagtgcaggcaacccaaatcagcgaccgggtcagcagtggcgccgagctatacaccggacactgagtcaggcagctaaagcgaactgctcccccagccggcgcaaacccttagtgcagttaaagcgggattgttcgatgtggaagaagagcaggtcgacgtagaaatcgtcaccatcgacatcgaagtggacttgcctgccgacgaaggcgaagcccgggcccagctcgcggagggtttcggtgattctgctggtgagggcgttttcaagatcccgctcggcgacttcgcctgagagaccgaggaattcaaagctgtaggggtccttggctacctgctgggcgagctctgagtccggtccaaaaaggcgttggacaaagtttgagggcgcggcacctgtgcgttccagagtcttgttcatgatcatgttcatgaggacgttgcgggaccagccatgctgcacggcagcggcggcgtacgagtcccttgcctcctcgtcgagccctttgtcgaggatggtgcggatgtggccccacggcaaatgtcccacaggctgtgggacattgggatcgaatgccggccaggcgtcggcgaagctgcgcatgtactgcaggttcgaccgtgacaggcccttcatgtcgggaaactcagctcccaggtcttcggccagtctgccgatgaccccactcccccacccttcaacagcttgccgctcaaggatcgttttcccgatggaccagtacagtgcaatgagctgggtgttgacggtgcggatcgcctgggtacgggcagcccgcacccgattcttgagctcgctgaggaggtcggtgtagccgttgggcagggcgaggtcgcgggcttcagtcatgggttcgatcctatcgagggcaccgacatggcccggccgttccctctcagagccggcttaccggccgggcccgcctttacctcgttctgcccctagcgatgctcccgtgcgggtctttctggctttggctgcgcctttgcccatggtcacggctgcactggggtgtgtgccttcgctgcgttccgcggctgcccgaccgcggacctgggcttcgctcgcgccggtagtggccagggaggcggcgaatgcttcctgccgctccgctgatccgtagtccgcggcgattgtactttcagccttcaagccttggtcttgcggccagctgctgtcgttgccggtgacgcggtattcaatctcgcggccgacgccttcgaggcgggcgaagagctcctcttcggcccgctcataccgctgttccagcgatgagaactgggagcctttgaatccgccctcggcgaggagcttggcttcgtgcatttccttggctgctttgacgaactcgggatctttgaagtgggagtcgttggtgccgttgatgttggcggtggtttctttgcgcagctggtcaaggtcgggaccgttgacaccgtccttgccaatcaggaacaagcgttccttgatgtccgcgtcggcggcggcaactgccttcggggttttggcgttgtgtgctctctccaatgcgtgtgccagctcggggttggccaggtactcgaccgggacctggtggcgctccatttccggggccagtttctgtgcctgggcgcggagttcttctgcccgtgccgctgagagcagctgcatggccctttcatgttcggcggttgccttgcgtgtctcttcctggctcagtgccagcgcttccagccgggccttctcttctgtgatggtttggatgccggactcgagataggcggcgtcggcgccgacgtcgtgtgtgtcaattccgtagcgggtcaggacttcgtgccggattcgctccgcggccgccaatgccgcggggtcatggtctttccagccttccgcgagagcatgggcggtggcgatgtcatggggctgtgctttgtcccaccactgatccttctgcaccggcgtaagcgccgcgcgagcggcgctgcgttgggcagccaggtgtgcctgcgcttcgtgcgctgcctggtcgtcctgctgttcctgttgccgcatcaattcctgccaacggcgggccagggtttcggcaatccgcgaggcgatcaacagtgactggcgcattccgctgtccaggacatcatcgattccatctgattcactcatggtgttcccccttgcacttggtgtgattctttatcggtcgagcacagggcctggttcacgccccgtgtgttggtgggttttcgcaggtgtcggagtggttggcactgccgaacctgggcggatgggagccatgccgcgaagaccaagttccacggacttcggcacaggcgtcttctccggcgtaccttgttccggtgcgcccacggtgaccggcataggcatggtcgctgcgaagggtttcagttgttcggttaccacggcgcggatccgttgtgcttccctggtgcgcccggattgttggtgcatctcgtggatggcaaaagcggtgttgaccagctgcagcatgagggccgcttgggctgccgttttgtccttgcttgacgccgccatgaacaacatggctgtcccggcaatcgacgggagtgcggcgggtttgctgtgctggcgaggtgcgcgcagctgggctgtgcgggacagttcggcagcggtcgctgccaatggtccgggcgtcggttccaagcgatgtgaccatgccgcgaatgcccctgatacttcccgtgccgccttcgcccaggtggcgtggtcatccttaggcaggacccgcagcttttcaaccagcgctgtggcgttgcgggtgtactgaacccacacacctgctgacggcgttgcgttctcgggaccggtcctggagaccttgcgcttgttgcgtgccgcggcgttccattccgctgcggcctctgtagccaggtgcggagagtccggccagtcttcacgcagggcgccgagcttcaagtcggaagcaagagtgccgccgccgaaccagatcggccgctcgccacgtgcggggcgttcagctacggagtagccaacaatgacctcggtggtgttcttcgcgtagcgcggccggaccagcattcctgtgtccctggctctccgaacaaactctgcttctgtcgctgacgcactcgcgctggcgcgcactttccgtgccaaagcactgcggtgcatttcgcgctcgtcacggacggccgtcgccttctcggcccggtcgtaaccgcgggtggcgtgcacggaagagagctcttcgagcccgtacttggtttccagttcccggcacgtctgctgcgcgcgtttgtagtcgccgtgtgtggaggccttggtgccgtcctcgcggaccagagacacggcgatgtggatgtggtggttgccgttttcgctcgtgccgtgattgatagcgacccacctgcactgcgcctttccgctggcctcggtgaagcccatcgcgtccacgaagtcgttcgcgatgtcgccccactgctggtccgttagggcgccctcttccgcgcggagactcaacgagcaatgccacacgtcagcgtgcttatgcccgttcggcacgcgttccttcttgaccgggtcccaccggtaatccttctgcaacacctcaacgccgaacgccttgcgcggctggtccaaatgcttcgcaagcgcaaccgcatcatcggcatctaggacgccgtcgtcgtaccaggccatgatcgccgcgtccccggcgacaaggtgcgggtcggtgtgcgcattcttcgtcttatccgcatcggtcgacgccaggtacaggatcagcccggccatccgggacccgcgcgtgatgttcggaatcatcccctacatcagcccctcaatcgtccggtcaatccgcatcgccacctcgcgcacatacgccaacgctgctttcgcgtcctgggggaattcgtcgccggcgttcgcgtgccgggcgatctggttgacattgttcgacacccgcgccagcaaggtatggatcgccatgagttcagccatcgcagccttccgctccgtcggcgtctccgacgcttccgacaaagcagcggtcagcagcagattcgggaccgttaccttctccctggcagccctcgcgaccagggctgcttcctcttcggcggtcacccacacatcacggcgcttcttggtccccgccggggaattcgaacggcgccgcttcgaaaggcgggaacgcggcacactctcctcagacacgcactccccccatccctcaaacggcccagcgcagcgaccccgacactcggggacctacaagccagtgtgccaagcgaacaaccacaggaccgtgagcgacacgccatttacacccgtgtaaacgtatagcttgctccgcagaagtcggcggctgctctttccccgcctttagtggattgttggatgggaagtggcacgccgctgcgcgccgatgcccgaaaagcgggtcggcctgtggttacggtgggtgcatgccaaccatcgatattgaacagacacgcaatcaggcccgcgctctcctggactcccgcatcgagtccgtcacgaacctggtcaagaccaggcagcgcattacggacctgcgtgagcagctcgccgacgccgaacgtgaagacaagcgcgcctacgtgcgcgccaccagagacggctggagccccgaggagctgaagaaactcgggcttgaatccggcgcagcagcgcgacgccggaagccggccagcacccggaccacggacgagggttccccgtcctccgccggtggagataccgcggctgagtaagcctgcccctcgcacacatgggtacggcaaaagctgaaacctccgggcttttcccgcacccatgtgcacgacgggacccacctgaccggctgcacacaagcgccaggacaccataagcacgaacatcaccaccggtaccggcgaatgtgcacagcctgggaacacaacgggtcgtcaacggacgccttccccatgggccaagacagacgctgccggcaaacccgctgcgggggtcgggtccttctcagcagggacgacacacaccgtctagccgggccgacttcgggcagcgacggaaccgcgatcagtgagaggtttctaaggcgctcagggggcttccagcctggtcaccggcggtgacaaccacaagctgctgggcgtgcgttcatcaccaccaagtaccgtaggcccgcgtgatccaagcaatggcaccaaccgcacagaacgtcataataaacacccgtcaccacgaagaaggccggcacccgatatgaactggtccccgaaagttggactctcgaatttgtgagatcttcactttagcgggcagtgatcgcctcttcacggaaaggctccgtcccaagtgggacggagcctttctcagtgggaacctagccaccactaagggacgctttcgccgagcatgatgactgacgctgtcgtgtacgtgttcctactgacggactgataagaaaacagcggctccgacaaggaggcaggccagtccaagggcacttaagccaagaaacgctgtccgctgcgcgcccagcggttcacctttccgccgcggattgttgaaggcatatatggccgtcggcatcccaagcaagacgccagtaattataagtatcagagccgtctgcatgggctcatgatactggccatggaatgcagaacgattcgccttcggaaagccaagcccccgcgatctccgggagaccaaggcaattactcacggggtagttttgctcaacgacctaggccaccagggccttagcgcggtattgaacggggctcagacccctgagctttgtggagattctttcggtgttgtaccagtggatgtagtcgtgcagcgcggctgtgagtgcttcggtgttgaggaatcggacgcggttgaagagctcttctttgaggtggccgaagaaattctctatgacggcgttgtcgtagcagttggctttgcgggacatggattggaccgcgccggcgttctgcaggagtaggcgccatgaggtgtgctggtattggaatccctggtcagagtgcacgagtggtttctgcccttcctccagggtggcgaaggcgccgcgcaatgaggagttggccagctccaggttgggcgaggttccaatggcgtaggagatgatctgccggtcgaaaaggtccatgaccggtgagaggtagagtttcctgtcatcgacgctgaattcggtcacatcggtcacccatttctggttcggcgcatccgcttcgaactggcgtttcaacaggtttggggccacgatgccctgctcgcctcggtaggagttgtagcgattcttccgccggaccttgcagaccaggcgcagtagacgcatcagcttcagcacggtctttttcgcgatcgtccagccttgcttgaccagttcggtgtggacgcggcggtggccgtatcgggcctggctcttcttgaagatacccgtgattgcggctttgaggtcggcttgcgggtcaggggcaaggagtcgagcttggtgatagaagaacgtggaccggggcagctcggcgacgtccagaagaacttccaaccggtgttcggccttgagagcgatgacagcgcggaccttcagcgctgttcctcgtccctcaaggcgtttacttttcccaggaaggccacctctgcccgcaagtgctcgttctcgcggcgcaaccgctgcagctccgactctggctccgtcggcgccttgggaggtgagatcggccggccacgtccttttgggcgcaagccatctgcgccctcgttgcggtatatccgcgcccacttcttgaccagatccggggaggacagctcaagctccttcgccagggcgacctggctctctccggcttggaaccggcggaccgcggcgagtttgaactcgaacgtgaactgccgatgggttgatttggtcactagcgccgtacctccgcgaactctccacaggttgtggatgcggatgacaggttttgaacggacccctaggctcgtcgccgctgccttcgcgccccaaccattctcgaacaacgctatcgcggcttcgcgctgttcctcagataacgaactactgtcctgcataaaactgctccccgaaagtaagaactgatttctcagtccaactttcggggagcagttcaataggtgccggccttcttgctgctttgggactgaatcttctaaccgtcggcggggatatcgccgtcagggatctgacctgacgcgatgcgctccgcggtcttctcgtaggccgcatcaatgtaggcttccaagtcatcttgccgtacccgccagataccccggccgccgaattgcgcggccctcagctcaccgcttttgaccagtgcatagaccagtggtttgccgaggttcaggatctcctggacctcgtccagggtcagcatccttgggaacggtgcagccgtgggcgcggtcgtcttgttcatttcttcggtccacttcgccacgattactttccctcgtcccggtgtcgtacttcatccatcgttctctgccccttgcgcagctcccccgcctgcaccggaggccacggcttaccgccgttgtacttacgctgcaggcgcttcacctcacgcatgctggccctgacaataaagtccgacacgctcgcatcaccctcttccggctggccggcttccaggaaagcagcacggacctgttccgcctgctcctctgtgtaatagggcgtgaaggcagcaatcttctttggcttcaccatcaccgcacccttggcttactgcaccgcacgcaacacccgtggccacgggtgcaggctgtccaagtaacccttccccaatgacatggaaccgtcctcgctgatgcagacatcggagtgctgatggctaccgccggcatgcgcgatcgcggccagcaccaagtccaagttctcccgatccagccccgacacgaagtcaccaagggtgaccggaacatcctcggccagtgacgcggccagcagcaggaaacgccgctccccaccagagagcacaccagcctccttcgggatggaagcgaagtcaatccacgcgctcacctgcccgggcccctgcggctcggcgctcgtgtgaacccaaggattgccgggggcagcaaacttcccaccgaagccccggatcagcaactccgtggccgcctccatcgtgtacatgccccttgcccaggcgcggaggtcatctgtgtgcgtcatggctgtgtttcctttgctcgtgctcgtcgtcggaacatcgttctacccctcctggttggatctaggagtggaggcgaaggtcaaaagcgattgactccgcgttccactccggacctcggggatcagatttcggattctgcaggaagtcctccagcgccgtttcaacgggaccaaggttgtggacgtactgcgaggggatgaagccatttatccggcccattggaacgtccactgactcatcggaaccatgtcctgtttgggacaggactgcccaagaaaagtcgctgtcggcatccgggttccggtggcagaccagtttcgatggcagggatccggcgacttcgaagcgtgctgtgccgtgctccacgaccacacgctcatgcttgttgccgtccagtgagtgcagtgcttcggtggctgcctcacgagcctcggtcaggctgtcgacaccctgaccgttcacaatccatttggacttcacttcggtcttagcgaccgccagccgccaagccactccgaattgagcgcctgcgatgtatccgcccatccacataagccctggttgccccaacaccatgcccacgacaaggaacgatgcaaggaacaggaagttcagccacctccagggcaggccaaagcggaagacataggtgctcagaaccaacccggcaagcagagggccgatgtcattggacacccgggagtttttgccaaacagcatgagcgcaacagttccgaccaagacaaccaccccgaagatggagtagtaccagatctcattccgggtttttctccccgccacaatgttccttttcaaggttcctattttccgtgcttatcggggccagcgtatctgctgaccccgacagggtgtactgcttagaacgggggtccggagtccgggccgttgccccagccactgccggcgttgctcgtcgccgggatgccccacgggtcatcctgcggggctgactgcgagccctggtcgccgctcccctggctgccgaaacccccagcagcctgtccgccctggttgctgcgctgggtgcggttgaccttggcattcgcgtaccgcagggacgggccgatctcatccacctcgagctcgatcacggtgcgcttctcgccttccttggtttcgtaggaacgcgacttcagccggcccgtgacgatgacgcgcatgcccttggtcagggactcggccacgttctcagcagcttcccgccagacactggcccggaggaaaagtgtctcgccgtccttccactcgttggactgacggtcgaaggtcctgggcgttgacgcgatcgtgaagttcgccaccgcggatcccgacggagtgaatctcagctctggatctgatgtcaggtttccaatgacggtaatggtggtttcgccggccatgatggttccttttcctcgtgtgctggtgatgttgtcggtgtctggcgtgggttcgttctgaatttcggtctcacccggttcgtcgtgggtgaggtcgttgggttggtactggttcgcagtgttggcgtcccatagaccgccgtccccgacgggggcgcggttgatcgcttcaaggtaatggtcgtcccctgctttgtctgggacggggtagaagccctcgtacaggtcctcatcgatgggctccacaatggcgggttctacaacatagggatccacaacgtcggggttgagcctgccgctggggttgacctgccggaacaggtccacctccaaggggatccgtgggctgaggttgaacccgacgaccgggcgcggtctctccacggtgctcacgctgccttgtgaatcatggccgcttggacgagcttgtcgcggcgcaggccggaccagtggtcctggtcatcggagttattcacgacgacgggcgcctgggagtagccgagttcggcggtgatgtactccagcgctgccgggacttcggtgatgtccacggccgtgtaggtgatgcccttggagtcgaagtagtccttcgtcttctcgcagttggggcaggcgggcttggtgtagaccgtgtaagcggtgagtgaagcagtcattttcagcacctggtttcgtatcaaataagtttcgttcgtctggctgacttgctacctcaattctaccaatcattcaactgaatgaataggggttttgcctctgattctagggatttttttgcagaaaagcagtcgggattaggtgcacaattcttgcccgagttgagcccgcgaccccgtccgttgtgcgcgctgccgtggcagccagtccggcttagtcctctcctgcaagcacggcgcagatgtctgccagtatctcgccgtccagggagtacgcagtgatcttgttggtgtcgaggtcgagtgtgaaggtctggtgtccggcgacactgtaggtctgagtctccgttacggggcctgccggtccgatgtcgccggggtagaacccgataaagtaccggccatcgaccgtgaagtggagatcgttggtcgcctcgtcgtacgtcgtgaccaaagcgtatcgggaccgttgtgtgaacgtgtggtcgaactctgcagtggtccaaatgccggtgccaacgttgtgctcccagaatcggtcgccgggcagaatcttgtccgagccctttaccgtgatactcccatatacagtgaagtccgggcagaattcgcccgccggatactccacttcaaattcatcggcattggcacttgaaacaggtcctagtagtccgagcgacaagatcgatgccgaggcgatggcgcggcgtagcagaacggacatggcggcctccaatggcttggtgatgggcacgctacgcccaggcgtcagcggccacaaggggtagtgccaaggccgtgaacccgctgtcagatgcagcgggaactgatggtgagtcccgccgccggcgactgtggtcatccccgcaggttcgccaggtccgcagcccccatgtgcctgaaaagccgctccggaccggggtgagatgcccagcaaacgtgcactcgcccattgagttggtgtcgtccctgctgaaagaagcacaaccccggaggatggcgcgtcgggggcgttgggattggaccatgggagacctggcccgggattggcacggcagtattgcggcgtggctgcttgaaaggtaagcatgctttctattagttttgttgcagcttctccgcctggcccccatcaggcggagtggttgtcagggaggccccgccagtgctcgtgctgcggggcttttcgctgtctgcgctgtgcgcggcagttgtcagttagtccggaacggcagagggagtatgcaatggctcagggtgacattgagacgtactacgaggacggccaatggaagaacaagcgcaagggtactgaccgcgcgttcggtgccggctacagcaccaaggcagaagcggaagctgcaggccgggaagctgcccaggcggacaaggtcgagcacgtgatcaagaaccaggacggccagatcggttccaagaacagttacggtaacgatccccggaatgttccgggctgattgattagctacacccttggcactcagttgtcctggggacacaagaagggccggctcataagagccggcccttctgcgttctcctcggcaatggaaatctacggattcagccctagctaaatgttgtcggtgatgcctgcagctgccatgtggacgtcgttgtcgctgggtagcgcggcacctggtcatgcgtgtggtgggtgcgttgatcggcggtccgccgctggtgattggttgctgtggttcgccctgggcggcggaccgcccgacttctggaaggttcccggccctttggtggtgagtgggcgggggtcttgccgggcggggtttccgcccggcaagggtgtttatgcggcggcggcgtcgtcctcggctggcttctggccgtcgaggatgatgctctcgacttcgctgggggtgtatccccacgtgaccagctggttcaggtagtcccggtgcgtttggcttggggaccgccacgagtccttggcgatggtcttctcataccctgcgcagaccagcgctatcaatgagaactcgggccgtgcctcggttttggcgacgtggtcccggagcgggttccatccccaccggttggattcttcgaccttggcaccgaccatttcagcggcgacctccccgtcgtagccgctggcggtttcggagtggtgggtgatggcatggacggtgaagtactgccagcccttgggtgcctgcttgcgggccagcagggttttgacgaactcgcggcggaccttggtcgcttctctgcactttgcaagtgcaatggctggcagaacttaacatgcctggtcaccggcgaggggccgccggtccgcgccggtagcgcgagcaccgtttcgcgccggttctttattcgaagcgcgtcgcggctattgcggtattcgcgcggataaggctgaatgtcgcggtgaccgctccgagggccaggagcaggctgaggcccagggctgtgaagtagtcgggcgccggccaggtcatccgataggtgtcgttgatgcctgtgaccatcagccaggctacgaggaatccgaggccgaccgagagcagcagcacggtcaggagcgggacggctgcttcacgggtgatgatccggcgcaggacggagaccggcattcccatcagtcgcatcaggccgagaactctcttccggtccaggacggcggaggccgtggcgacggccagggataggccggcgattgcgatcgcgacgaacatgccgaggtaggagagcacggccaggccctgaatcaggcgggtaggtgattgcagtcctgtgtccatgggggaggtggtggcgggatgcgcagtgacgcctgaactattcaagagggtccgggcgcgatccatggcctcgggggtcccgtccgtgccgagcacaatcaccaccggtaccattccgtccaggttggcggcgggcaccggggtcagtgctcgtggctgcgttgtccagaagtagaggaacgacgtatcaaccgtgacgatctctgttgctggaatatcctggaaacccagggcgggtgcatccgcggcacgaaggtagatttcagggctggcgtccctgtcggagagggctgccgggccgtaaccgacggtggcgctccgaattccgcgcatttccttagcatggcggacggcctcggacatctgggccggagtgtgtccggcgtccacagtggcgtggaggctggtgggctggagcagaccgggcgtggttggaggtgcctcagtggattcaatgatgctggatgctccggcgaagacggagacgacgaacacggcgacgaccaggccggagacggagcggaaggccgccaccgggtttctttggatccggctcgcggcaatgactgccgccgcgctgcgcgcctgacgcagccctagccggctcaccaggcgggtcagccaggggcccacgaccacgatgcccaccaggatcagcgcgaagccgccgatgagcagcggcatttcgagcaacggtgagcgcaggtgcggggtgcgggtgacggcgatggcggtagtcatggaggccagtcctgccagcaagggaacgctccgccacatggtgggtgttttttcgtgaaccgccctcgtcacgcccagggggccaatgccggcacgtgccgtgcgccgcgcggccacgagcgccgaggccgcgaccaccacggcgacgacggcggcggccgccgcccagccggtggtcaggtcggcggcgaacatccgggtgccgttgaccgggatctgcgcgacagccggcctcagcaggagggccagcccgacgcccagcactgccccgatcagactgggaacagcggtttcggcggcggcgatccgggagacaacctgtggggatgcgccaatgaggcgcagcgtcgcgaagcgttcccggctctgggcagcccccaggccggtgacaatgctgatcagcagcagtaccgggaagaacaccgcgatggccccgatggacagcaccgtgttgtagggggccgcgctgcccccgtaagggttggtcgtgaagtctgacaccagggctgctcccccgctctgccggagttcggcctccgtcgctcccgtgacaacaatcagcgaatcaggtccgggcaacgcggcgtcgtcaatcgtgccggcaaacgtcccgaaacggtcgcccagctcatcccgcggcgttgactcgatcagacgctgcagcgccggggatgcatagtactggcccggttccggaggggtgccgattccggggatcttgacggtcgtcgaggctagggctgcgaaatcgcggcggctaatcagttggtcgcggaagacctccgccgggttggtctccatgagcgcagtgtccgagcccagcggcaccggcgttgccggtcccgaaccggacggatcgccggcggccctcggaacggacaccgatgggctgccggtttcgcgcagccacgcaccgcggtcatcacgtgcgctcaggccgttggcgccgccccacagcagcaacaacaggcacaccccgacggcaaccccaccggcaatgccggcgagcctgccgtaggcggaccggctgccgacgactgccagtttgagcaacccgggattcacgcggacacccggtagccggcaccgatggcgccgtcgcgaacgatgacttcccggtccgcatacgcggcggtgcgcgcatcatgggtgatcatcaccaccgtcgtgcccgcttcgcggacaagctcaagcatcagcgtcagcacgttctctgacgcgagggaatccaaagaacccgtcggctcgtcggcgaacaacacggcaggggacgtcaccagcgcacgggcaacggcgacgcgctgggcctgacctccggacagttcaccgggcagcttggcacccatcccgtccagaccgaggcggtccaacagatccgtggaccggcgcagcgcttccggccgcctagtcccggccaggagcagcgggatgctgacgttatccaccgccgtcagctccggcagcagctggccgaactgaaagacgaacccgaaatcggtcagcctcagccgggcccgtttcggctctcccagggcactgatctccagcggggcccgcccggcgggacagtgggtcaccgaaccgccgtcggggacaagcaccccggccagacagtgcagcaacgtcgacttgcccgatccggatggacccatgacagctaatacttcccctgggtggacgtcgaggtcgacaccccgcaatgcctcggtctgcccgaaggagtggtgcaggccgcgggcactgaggatgggtgcagtggtgtcatggttgctcatgcgctctggagctccttcttgagtcgggtcaggcgggcgctggtgaggtcgatccagcgcaggtcggcttcgatgtggaacaggccgtggtcgcacatcaggacccgcagcaggtcggcatccttcttcagccgggtcagctcccgcatcctggccatgtgttccccgcgctgcacatcgagcagccggtcggcgtcgtcatcgagcaacaaggcgatcaccgtcttggcaaagagctcgctttgcagggactccgagggaacgtcgggagtgaatagccactcgcgcaccctgtcctggccggcgacggtgatctcatattttttgcggtccggaccgccgccggtctcctcgcccagggcccggatcagctcgtcgcggaccatgcgggccagggtggaatacacctgcccaaaggccaaagccttcccggctccgaagtagcggtcataagagtgcttgaggtcgtagccatagctcggctcgcggctcaggaggcccagcagggtgagggagttgttcacacctctagctatacactcagtttatagtttccgccagttcgactcacgggatgaacccgtgcggttgcggagtttcttgcccttcctcgggacggaaagcgggcatgccgaggttggttgggccaagcctgacgagtcgttgtgcgtcggcgcgcttgtcctggaggaattggagggtgaggtcgataccttcgagttcgccgagccagccttttgtttgggcgagctcgcgtcgggcgatgaggtcggtgttgatctcgtcgaggcggccgatcatgaccgggtccacctggagcagggggcatcggatgcaggcatgttcgtgctcgcagggggtggcgtagggtcgcccgcagttgccgagctcgactttgcgcttatcgaagtgctcttcgaattcggcccattccgtggtggtcggggtccggtattcccgggcggcccgggccgcccggcggccggcgaggtgggtctggtagtggcggatgacgtcttcctggaagacggtgacgtagccgtgggtggtctgcacatccagatgtccaaggagcgctgccccgatgtgaatgggcaggccgtggttgacgaggtctgtcgcgaacaggcggcggaaatcatgcggagtgaaccggcagccggccagctccgggtgctcggcagctactgcatcgctgagtctggccagttcatcccgcagcgatccggggttgatcacctcggtgcgctgtccgatggtgcgctgaaacaagaagggttgaggttcgctggtgatccgctcataggggtcaaagcgcgtcgctaacggcacgtcccggcggttccgggtaaggcggcggatgatcgttgcgatgacatggaacaaatccgctgtcatcgggatgacgcgttcgcggtcactcttggacggggcaacaaccagcagcgccacgacttcagcgttaggccggatgtactgccgaatgctcacttgggacagttccaggagttcttcgcagcgcagcccggtgtgccgcaaggtctctactgcggcccattgccagaacgtggcatcttcggtgaacgtgacattgaccttcttgccggtcgactcatccagtaccctgatgttcgcccgaccatggatatgggcatgccgggcgtcgccggcggtgaacagccgccggtagcgcttcattccgacggtcaattcctggttcggcgcggcgtccgtggctgccttcaaaaggtcacggaagtggtcccggcgggcggtgaccgcggcgacgaaggctggaagggctggctgaagccggcgtatccgggcgtccatgcgttctttggctcgccggttcgctttcgcccgcgaccgggtttccctgccaccaatagggcacggtgccacccaccgggcccaacgttccggttcctgggccgcccagccttggatgtcgaggtagaaggccctgatgttcgtcatgaccgcgtgcgcgctcagacgcggtcgaccagctcgcctgacctccagaacagcccgccactttccatagtcttccggcgtgagcgcaagatccttctgggctggattgaccttgagaagcgccgcccagaactttccgcagaggtctcctgcgagatcccgcagcgtcgtgtaatcgacgtcatggcttcggcgggtcaggtaggcaacgaaaagtgcgtggatgtcctggtcggcgatgttgtgccggtcaacaagctccgtgggagtcatggccggcgcccgcatcgcaccccgcaacgtagcagggacatgcttggggaagtgaccggattctgccatgagccgccaggcgaggtgaccgacataggactcgtagccgccgccccagccaccttcgcgggtggcgatcgcgtaatgaagcagcccttccggagttaaatcagcgaaagcaatgccctgggtcgtcaacgccgcggcgacgtcgaagcgggcacaacgtttgaaatggccagaggtgtcgtgattgtccaccaatgtcaggaaccgcttcagatccgggtcgttctgggcggcttcaaaatgttcgtggtagcgcacgaagctgttgacccggaaagctgccaaggacggcctgatcacacgaaggcagcacaggatcaggagcgaatggcccagttccccgtccaccttctgattcccggttctcagctcgcggatccggcgtttcccgtcgttcaggcctgaagcgacccatcgttcctgccacgtcacgccggggtgcccttcgagatggccgagcacccaccgtaagccagcgcggcgtagagagcacctgggctgagaccgcggccagatctgatcggccagcccgttgatcgtctccaatgttgcggtgtcgaggtcaccctgcggtcgtggcaggaccgtcggtggacttgccggagcgggggtaatgatgctgcgggaccgcgtcctgccagcagatgcgggctcgagctgccgctgctcggggtgacggagcgccctaaccaccgaacacgaccgagaaatcatcggcgtcataaccaggcgtcaacgtaggttccagccggggtgcagcaaagtgctcctgcaccttttcgaagacttcatctatccgaggccgcaggtagggtgccagggacgacacgcgccggtggcgggtcacggccatcacttcgggcaacgtcaggttcggatccgacaccattcggtcgatcgtggtgtgccgcagatcgtgcaatgaccagtccgtaccaaggacggcattcgcacgctgcaggattcgccgggccgcgtgataattcagcggccgcggctttccgtgcagggcccgccaaatcagctccccgggtcccggggttccacgctcatgaaagtacgctgccaaatgctgaaaagactccggcgaggccggaaccggttcaagcgcccgggacccttttgaaacaacccagacacgctgcccggcccagtccacctggtcaccgtggactccgaggagttcgctcgcccgggcacccgatgataagtagaggctcacgagcgccctgtcacggctggtcctaagtgcaccaatcagctcatcaacaagatcatctggaatggatcggggcgccagtactgccggcttctgccgcaaaggcgcacggcgcagccccggcatctcctccatcgggctacggtgtgccaaccgcgctcggcggctcgggctttccgggactgggttcattaccggtccacgcccgaaccgggcatggaaagcataaaaggaggcgaggacggccaatgcgtgattgatcgtcgccggtgcatacccctcagccagcggccgtttcccggtccgcggattcatcacccgcgccccgctcccccgccgctgaggattcaccgccgaccgcatccacccgaccaagacctcgacctccagacggcccacttgatcccatggaagaccgagcagttgcagcacccgccaccagcgcaacaggtcattcccatatgaacgcaccgtcaacgcgctcatatcggtcaacacgaggtcgcctagaaatgccgaaaacacctcgatctcatggcccacgtcatcgacgacgacgtacggcaacaggcctgccgcatttcgacggaccgcgccgatgcgtggcaacccgatctttccttcgatcaacttcagccgcatttcgtccacgatgacctcctcctttggaggctgcagctcagcctcaaagttcagtcaacaggactgattccatggccttgttgttggcgatcagggttttccgctcggccttttgttcctcggtcatcgggcctttttgggcctgctgcccgccgccgttgtagcgttcgtactttggggcgaagcccagttccttccagtcgcaaatgacaggctcggcccggtgttcaccccggtagttggtgctgatcacgtaggcgttggcgtcctcgtcggtggccggttccccgtcggcccgcttggccgctgagacatacaggttctcctcgtcggcgtagtgccctgcgtcttcgacgatggccttcccctgggcgataagttcctcgattagcgcagcaagctgggccttggattcccggtcgtcccggagcttctgggcgatgtggtcaaagtactgcggctcgtcccggatcacggattcgagttcctcgatggcgtcctggtctccctcgaactcggtcatcaccaaggccatgtccagggtgtagccgctctcgagggccttggtcctggtggtggaagccttggctttgagcgcgttttcgaccttgtccttggtccggccggtcttcttggcgatcgcggccgccgagacgccgatcagggacagctggtggtaggcatcggcctcgtccgcttcggtcagttcggcgcgctggatgttctccacgacctgcgtcacgatgcgctcggcttcctcgggcgagtcgatgagcaggaccggaatgaggggccgttcggcttcgacggccgcgcgggtgcggcgctggcccatcaggacgtgcaccgtgccgtcgtccttgtggtgggcgatcaccggttccatcacgccgtgttccttgatgctggcgacgaagtcagcggtcagggcggcgtccttgcggacgttaatgtccacggtcagggtggccgggtcgagcatttcaagcgtgggtgttgcgttcatggtgttgctccttcttgccgagaagttggtgggtggggcgaccaaaggtgaccggccagctcccctctccccccgacgcttctatgtctgtcaagcgggcggaaacggatgcgggccagttgctttgccggtgtcggggcggttttggtgaccggccagcgtcccctctcccccgttgttttggctgctggcgaagcttgcggagctgtggccgacggaggcctgtctacccgcagggcaaggggcgggggtgtcagattgtttgtgtaggtggactgtagtcgctgggtgattggagaatcattgtggctatgacaaaaccccgtgaagagatggcggaggatctggcccgtcgtgccgcggcggccggcagtatggaggcgttgaaggcttcgggtgcgtttgatgagttgatggcgcagatcgattccggccagctggagcttgatggcaaggatggtttcattcagcagctgatcaaggcttcattggaacgcggattgcaggctgagctctctgggcatttgggttatgacaagggcgatccggtcggccgtttcctgcccaattcccgcaacgggtcgtatccgaagacgcttgggagctccgccggggatgtggatctggccgttccgagggatcgcgacgggtcgttcaccccgcgcctggtcccgaaaggcgcacgccgcaccgggggcttggatgacatgatcatcagcctttacgccggcgggatgacggtgcgggatattgcccatcatctggaatcgacgctcgggaccgagctttcacacgagacgatttccaagatcaccgacgcggttctggatgaggtcatggaatggcagaaacggcctctggagccgctgtatccgatcctgtatctggacgcgatcgtcatcaaggtccgggacggacaccaggtgcagaaccgtgccgcgcacatcgctgtgggcgtggacatggacggcatcaagcatgtcctgggcatctgggtcgaggctaccgagggcgcgaagttctgggccggggtctgcgccgaactgtccaaccgcggcgtgaaggacgtgctgattgtctgctgcgacgggctcaccggcttccccgaggccatagccgcaacgtggccggccgcgaccgtccagacgtgcgtcgtgcacctgatccgggcctcgatgcgcttcatcggctatcaggaccgcaggaaggtcgcatcggcgctgcggccggtttacaccgccccgacggccgaggccgcacaggacgccctggacgcgttcgaggcctcggaccttggcaggaagtatccagcgactgtccgaacctggcgcaatggctgggagaaattcattccgttcctggccttcccaccaccggtgaggcgcatcatctacaccacgaacgcgatcgagtcgctgaactaccagctgcgcaagatcatcaagaaccgcggccactttcccaacgaccaggctgccgtgaagctgctctggctggccatttgcaacatcgaagacaaacgcgctagcgaccgggccaagctcgaaggcaaggcccgggagaaccgttccaagaccgtcaacaaactcatcgaaggaaccaccacgcaaggctgcgccgaagcccttggcgtcctcgtcctgaactaccccgacagactcggaccctacctcaaccgataaactccacctcacttacacaaacaacttgacaggctcagggggcgggaaattcccggaggaaatcagcgacgaaggagcgccgcagggacatttcctgcaccgcaggcaccgacgaaggaggggctagacgggccggagcggacacgtacaatccgaaggaatctcaatgatgttgtcaacggattcctgcaggtcggttagggggcggtcctctcccgatcggtgcttctgggtagggctcgcgggacttttgttggctcatggttgtgttccttccaagtggtggggcggctcgtggtgaccggccagcttcccttctcccccgacgcttctatgtctgtcaagcgggtggaaacgggtgcgggcgcggaccaaggtttgccggtcgcggggcggtttaggtgaccggccagcttcccctctccccccgttgttttggctgctggcgaagcttgcggagctgtggccgacggaggcctgtctacccgtaagggcaaggggcgggaaattcccggaggaaatcagcgacgaaggagcgccgcagggacattttctgaaccgcaggccccgacgaaggaggggctagacgggccggagcggacacgtacaatccgtcaggacagcagccaaaacgtcgtagacagaacaaggccaggggcggcggagccctgcggagccggcaatggccccacagccggccgcgccagcggacgcccttttccttgttcgccctgcgaaccctccatcagcacccgggtctttttcggcgtccctgactttggcggccgcgcgccccccgtccccggcactgggtgtgcgaatggcggtccgccgcagccgacccaccgcgcaagccggccacgacggcggaccgccaccgatgaccgcgccggcaaagggacggtcacctggagggattaggctgcgaggagttcggccagttcggccgcatcggacaccagcactgccgcgccttctttcaggagcctgtggcatcctgcggagttggcgctgtgcacgctcccggggacggccgcgacatgccgggcaatggtttcggcgtggtgtgcggtgttcagcgcccctgagcgccagcgggcttcaacgacacaggtcacccccgcgagggcggcgatgatgcggtttctctgcaggaacctgtgccgggtcgaggcggaaccgggcgggagctctgagagggtcaggccgttgccgcggatcgcggccgcgaggtcagcattacctgacgggtagtcccggtcaaggcctccggccagtaccgcaagggtcgccggttcttctccctggcttccggccaacgcggcccggtgcgcgtgcgcatcgatgccataggccagccctgagatcacgcagattccacgttgggccaacccgtatgccatatcccctgttacggaggcgccgtagctggtggagtcccgtgaaccggtaagggccacacatttcgaaggcgctgggatgccgttgtcgatgttgccccggtaccagagcccgtaaggggcgtcgggcagatcgtccaggccttcgggccagtgttcatcccccgggatgaggaacccgccgcccaggcgttcgatggtggcgaggtccttctccgcgtcgacctccggaacccgcgacgcccaccgtctcaacgcttctgagagttcttcggccgtggcctccggaatggcgtgtacgggctgcgcgccggtggcaagcctaaacgcggcgtacgcgccgagcctgtctacgagggttcgaccgacacggtcgccgggttcgaagagtcgggtcagggctgcgcgtgcaatgcgatcgttcatggtttctctcgtcctttgctgaggatccggtgggtggggcggctttggtgaccggccagctttccctctcccccggttgtttttgcctgctggcggagcagcgcgtagctgtgcccgacggagccggggcaacccgcagggcaagcagcggatgggttgtcggaggaaataagcgaagcgccgacacagggcatcggctgcgcagccgtccgcaggacggttgagccggtggagcgggcacgtacgatccgtaggacagcagcaaaaacagaaaaacgcctctacagcccgagcgaagcgaggtcggtgcagtagacctgggcgctagctaagcgaggccggtaaccggagtctccaggcagcccgtggtttccggctacgttgtggtgctctcgcgagcagcacgggcttgctggtggcggtagagcgttgcgcggctcccgccaacgagacgcgcggcatcttcggcggtacgccccttggcgcgggcgtcctgggcgatcgcgagtttgtctgcgatgacggccgggtcggacaccggccggccgaagcgtgtgccgttttgtcgtgctgcggagatgccggcgttgacccgctcgacgatcagctcgcgctcatattcggcgagggtggcgagcatgttcagcatcagcctgcccgtcgaggtcgcggggtcgataccatccgagatagaccggacttggacgccgcggttgcgcagcagggtcacggtgttgagcacgtcgattagggaccggcccaagcggtcgacacgccacacaacgacggtgtcgccttcctcggcgtactcgaggagttttttcattcccgggcgctcgatcgccgtcttgctgccggaggtcacgtcggcgaagacgtcgcgtttctgcactccggcggcgaccaacgcatccagctgaagctgggcatcctggctggaagtactgacgcgggtgtagcccagttgtctcacggtgccattttgactcgaaaagtccccgctgcgcctccgatgagatgaatcgtggtgggacgagtttccgagacgcaggcagccttgccattccgcctagtcgaccggctcctccaggccgtggggcgatgtcttgaaaagctgttgtttttcaagacgctaggcgacgccgctcacctgtctcataactaacgatgagtactcggcgaattccagtggtgcctgcaacaccggatttagttgactgggttcgagactagctcggcgaggacttctgcgggcgttcggtagccgtgtcgtttgcgtggccggcggttgagttccgcggcgacgttctcgaggattccaggcccatggaaagacaggtcggtgcttttcgggaagtactgacgaaggagtggatggtccctagatgttggactgctaattaaacgttacgcgctggcgaggttgtgagcgaggtattcgtcggggctgaggtagccgagtctccgttggattcgggtgctgttccaccaacgcagatactcggttagaccggtgtggaactcctcgatggtcctgggttgctggattcggaaccattcctctttgaggtggctgaagaacccttccatggaggcgttatccaagcaggtgcccttacgtgacatcgattgagtcagcccggcttcacggagcgtgtcctgccagagcggatgccggtattgaaacccctgatctgagtggacaaggggttgctcgtttggagcgagaccgctgatcgcagcgcgaaggccatcggtgaccattttgacgctcggagacggacctgccatgactgagacgatccggttgtcatggagatcaaggaccggtgagacgtaaaccttggaggtgcccaccgtgaactcggtgacatcggtggcccacttggtgtgtttgacggcggtctcgaacttgcggttcaacacgttctcagccgtcttaccgacctcgccgcggaaggagttgtatctgcgccggcgacggaccgggctttgcaatccgagcccgcgcatgagcttcagcacggtcttcttcgacactgtccatccctgtcgcaggagcatggctaggacacgtcgatgcccgtaagcgcttcgcgcctgcgtgaagacctcacgaatggcttctttgagttccgcctgccgatccggccgggtgagccggttgcggtggtcgtagaacgtggaccggggaatctttgccagatgcaacagcagctgcaaccggtggtgggccttgaggtcattgatcgcttgaactttcagcgtcgttcctgtgccctcaaggcccgcaattttcccaggtacgccacctccgcacgcaaccgctcgttctcccttcggagttgctcgacctcgctctcgggaactggattctcgcgactgaccggtggccggccccgtctcttcgggcgtaagccgtcttcaccctcgcgccggtaaattctcgtccagttcgtgacggtgccgggagagggaaggtcgtattccttggccaggacgcgtccggacacgccctgaagatgacgtcgcacgatcaagagcttaatttcgatgtcgtactgcttacggtctcttgtcatcagcgcacccgatcctcgtacctgccatcgttgatacaacatttggacagggttaggtgctaaatcaagagtcagcgcgacggacttcgcagtcagcccttgctcgaacaattcgatagccgacactgcatcggagtgactcaacgtgcttttcaagtacatctgactactcctggaagaaagatcctaaactgggtgtccaacttccggggaccactccaggaggccgttggtgttttcgttgctgccgcgctgccagggtgaatgtggctcacagaaatagatcggcataccggtagccatagtgatctcctgatgccgcgacatctccgctccttgatcccaggtcgtcgaacggcgcagctgctcggggagggtattcatcgcggtgatcatggcggcggcgacggtgcgggcggtgtggtcctcagccagatacagcaacatcacgtatccgctagtgcgttcaacgagggtcccgatcgcggatttcgatgccgttgaaccgatgattaagtccccttcccaatggccgggaacggcgcggtcctcgacctcggctggccggtcagagatcatcaccatttcctggaaccgttgcgggcgaggaccttccggcctttgcggccgccgacgcacccgtccggaccggagcgccgtcgcaacttccaggcacaaggatccgcggccctggacgtagagggcctgatagatcgtttcgtgtgacacctgcatctccggattctccggatgctccaccttcagccggccagcgacctgttccgggctgaaccggtcggtgagcatcgtggtgacctggtcccgtaaggctaacccgtccagcttccgcggcttcggcctgcgggcacgagccccacgtttgctcctgtgcgagcgatggcgaataccggtcactgacgcggttcctcgcgatctcccggctgattgtggacggagcccggcccagaatggcggcgatatgacggactccatggccctgggcgagctggaagccgatctcttcccgttcacgcaacgacaaaagccctgcacggggcacactgaaattcggaacgggcgatggcaacaccttctgatggtcgctcaaccaccggtatgcggtcggacgcgacacccccgcggcctgcgccgccacggctaccgacagcccggcatccagcccttcccagaacgctagtcgaacacttaacggcgaccacggcctacccatcgacgataccccagagaattcagggtgttgcactcaccacctgaactcgccgcatttgggttatgagacacatggctccagtccggagataggttcaaatgcccgtatggggatcggtttacgggcaccaggtgccagaggtgactgccccaactaggaaactaagatgaccgcacccgaatcgccataggtctgcctacgtacgacgccatcgcgggggttccatgaagccgacttgaatccttcaatttttaaagccggatgttcctcaaactgcatctttgcgatggtcacgtcaccttcacagattagttcccttccatcttcaatctcgattttgagcccatgtggtaggtccactgcggacgtgagagtgaaaagggaatcgaaaggcctcccgtaccaaccatccggtagcaccaggccggcccgcccatgcttcgcgaagaaacgcacaactacatgggcaggcgaaccaagaatcggccacggattacgcgtcatgggtcgatcctaccgacgggtttcctccaccgaacctatccttccgctcgcgatgttcatcgcgacgccatatggggttgtctcaatcgcccacactgatgcccctaagccggtggtcgaacgtgcaccaaatgaccaccgtgaagcaagtggtgggtggacgtcagtttgtggtcggtaagaccggttgccgaaggtttaagcggaagaacgcgacttccttgcccatcgcgtacccggccgccgatgtagggatgggcacgaaggccagcccccgccagggatggggcagcaggaaaagtacagccaatccggtgaagatcagagcgtagatcggccagtgcgggccgcgaatgccggtcaagaatccgatggcgccgccgatcaagagcgcagccccggtgatcaacagtgcaggcggaagcgcatcaagtgacacggaggtgaagagaaagacgagcaacccggcgaagagcacggcgggaatcgtaatgcgaagccagaaatctcggacgatccgccgtcgatccagcacatgtttgtccacaatgtcccccaattcgtcctctacctagcttaccgagcgcgcagcgagacgtcggtgccgccaaccagacaacgcagaacgcgcaaaccctcagaatcgccagcgccatcgcgctggccgtcatcctctttctctcgtactactgcggcggatacgtcgctggccgcatggcgcgcttcgacggactcaagcaaggactcgccgtccggttgtggggaatcatcatcgcgatcctcgtcgcaatcctcgccgcagtggccggaaaccgattcaacatcctcgacaacctcggcggcacacccaggattcccctggatggaagcgccctgaccgccggcggcctgatcggcctcgccaccgccttcctgatccccctcctcggaggcaaagccggaatgcgcttccaccgaaaagtcgaccaggcaggcatcaaccaccaagcaggaatcaccgactaacaaagttttcccaccaaacccgggaaccttggaagggtgcagctccacaaagagctgcacccttcaacgcgtcagccatagcagccagcccataagtcgaatcaaaaccctagggtttcgaaacactgaggctatgagacacccagatgggttcagagaaggagtcgacgcccgctggctggctcatctatcgcatcagctggtcatttgccagccctgaatactatcgagtcgaagacggcacgtgcctcgctcgtcagctccggattgatcgatatgtggaattggaccacccagatcacaccccgctggccgttcaagtcgaccacgcggtaggtttcgcgctcagcggcgctcgagtaccagcgtgtgcattcgtttgagaggtctgagtggatgcaaaacttgccgcggtcgcaggccttgatgtccacgtcgccttcaacggagtggtcgaactcgaagccggagtaatcgcccaacatgacctcgacgggaggagtgctcgccgttgacgtctgcgccgtcatcgtgtcgacgaaaacctcaggcgacgggccgacctcgacaagcgcgtcctgccacgcgcaggcgtccgtcggcacatatttggcgggccaccaacccacgaagaccccccattcatcagggtcatccgggtcatccttggccagaccttcgccgtcggtgctcgaccagccgtctgggacggtgatctcgaaaggcacggcgaagccggtggcggggacgaggtatgtgccggcagcgatgtcgccattctccggcagcagtggcaccgtgccggtgtcgccgccgtccggcagcggtgggaccgtgcgggcctccgtagtgggaagactggcggacggcggcgggacgtccttggactcatactcgcatccgccgagacatccaattagtgcaatagccagcagggacaggatatggcgcgaccgctgagcggtctttccggggggtgttaaggagctcatcgatccgccaggccgctaccgggtactgtgaggccccgcagccaggtggccccgcgggcggcccgagataggatgccgtcgccttaagtctcctccggcacagaacccgtgacaatgacgagttgtacgaagatcggttccgattctcctttctatcgatgatgtccatcagcaggcggcggttcaccgggtcaaagcccttcgtgggttcgtccaaaatgagcagctccgggtcgttcataatggtcacgcccagctggaccttctgctgctgaccgccggaaagcttgtccagccgggccgtggccttgtcggcaaggccgacgcgctccaggtagtccagggaccatgtcttggctgcacaagcggctccgccgcgtcccccaacgtcatcgtgccagcctatctgtcccccggaatggtccgtcccctacgggcaacgtaggctgtcactcccgccggcggctacctcaggcgtcccttaccgaccggctcttcatgcgcccttaggtgaatctcaaaaaaatcctttactaaaggcgcagctcgtcagagggtaattggcaccgttggtgattctcaactgctgcagcacgctgttgatttctgtccatggagcgttgccaggtttggccccggatgccaagctacgtaggtgggcgcagttacggtgtccggcctcaaaatcacgtaccgggttgcgggatcaggtgatcccctcgttcttcttcatggcggctttgggtttgacagccgatcgtggggcccgcagttcgaagccctcgatgacgagttcactgttgtcgcctgggacgctcctggctgcggcggatctgatgatccgcccgagtccttttgcatggaagattacgctgacagcctggccgaatttgtgagagcactcggcctgactcgccctcatatacttgggctgtcgttcggggccgcgctggccctggcgctctattcacgacaccggaccctgcccagaagcctgatcctggcaggagcgtacgccggctgggccggctccctgccagccgacgaggtgcggcggcgcgttcagcggatcagcaaggaagttacgcagcctcccgaggactggttgcccaaatacctgcccggcatgctcaccgagtctgcatcccgagaaatggccgaacagacactcgcgctgatgtccgatatccacccgcgggccagtttgacgatgctccgagcgatggcgaatgccgatcttcgcggcatcctccctgacatcgacgtcccgacgctggtgctgcatggcgaattagacgcccgatcaccgctggcggtcgggaaggaactgcatgcgacaatccccgcatcgcagctcgtcgtactcccaggcgtcgggcacttgagcaatatagaggccgccgaggcctttaatttcgaggtaaggatgttccttcgttcgctcagcccccgcgagacactctggcgctagaaagcggtctttgggccctacgcgaacttagtgatatctgtcatgttgtcgtctatggccttccttcttgaatacgcaaccgaccacggtgctggtcggttcgttattgagggtgcgagttttagtgacgcgatggctaaggcaaggagggccctccatggttttgactgcattcgtgccatcttgcggcacacccctggcccacgctcccccttcggtgaaggcgcgatcctcgctgagtacacggcggccgaaggctggatcatccaagaggcggcgtcgggaatggcatagttctccggttttccctcatccgcgggctgtgtcatctatggatcctttatcaagatcggaggagctgctcgccaacatttctccaacccctgtctttagcggttcagacagcagtgagtcgtctcaagaatgtgtctcacccgggctattctcaacaaaagaagaatgaggcctttgatgagctagcaaggagtcgggctggggagtatcggtgtcattttcaagagtcatctgcacggaatgtcagaagtcgtctgcactcctatcccgcgtacctaaaggcgaacaacgatggcggtccgtttacgggccggctgtcctcagacttcaagttgccgccacagatgcgcttctccggccccgctggttcctcaggactaggacttccgttcgatgggcggaaactctggacaccacgaccgcgcggacggaacggccgcgctacccatgcctctcctgtggcaaacagtaatagtgcgcctccgagcgatggggcgggccaaacctctccagtagtgttttgaatcgcacctccttgaccgcccaaggaagcgacttggcaaagcatcttcaggaggaatttcatgtatccactcccgccggatcgtcttgatcgcaagtacctccaacccttctgggacatgatgcgggagcgtgccgcgatcttgggcaaagacggcggtagtcgggaagaccacaagaacgacatcgcggaatgggcctggaagatgattgacgggctctatccccagccgacccatatgcctcctgagccaaaaaagcccggggttttcggatccgtcaagaaatacacgcagaacatgcgacggtactacgaaacctacgatccagagtatttcgtgcgccgagacgtaggcctgtggctaatgcagtgctcagaaggactcctggaaagtgcttcttgggagctgaggcaacccgctgcaaccctgccagtagcctcggccaccgttgaccggggcggtttacagtgggacccgcagggagacaggcctgagccgatggccgcgtgctctccccggcaggcagagtaccttgcaaaggcttggatggagtacctcggcgccacaggatgcaaagtttcgcaggcgacgcgggacggtggggttgacgtggaaagcgagcattttgtcggagaagtaaagcatcatgccgaaccagtctcccctggaatcgtccgccagatcgttggggttgcctccatcgaaggcaagatacccgtggtcttctctctgaacgggtattcagcggcggccctggaagtgggccggagaggcggagccgccctcttcacctacagcttcgagcatgggacgctacgggccgcttccccacatggggacaaggcgctaaagctgggacttctcagcctaaccatttaggactcctggcacacgctgctgtgcagtgcgtggaccctccacgcggctatcggaaacgaacgaagattccaggagtccgatgaatcgaggttagagcttgctgctccccctagcagccatgcccccacacatgggatgaggatatgtcgaagtaccatgagccgtggctgaaactgggataggcggagatgacgttgggcaggactattaccttttgggagcaggcttctcgcgagccataagccggcacatgccgactctctttgatctgcaaccagccgttctccaggaactggacattcttcccgagtcgctccatccctttggcgacaatttagaggaatggatgtcctacttatccatcgagcaaccatgggtaagcgaccaggacaacacccggaacgccgcaatgttccaggacgtgagcaccgcggttgacaggtgtattcaagaagcagaagctcgagcactagtagagggaccgccggagtggttgacccgattggtctggcactggtgcgacacatcctcagcgattgcaacctttaactatgatttgttggttgagagaaccgcgacttatttgcgacgggcaggacactggtctgacctctatgcgatgccgctaacagagaggtggccggccggctcaagcagagcaatctcggcatcgactccacttgaccccgttttcaacatgttcaaattgcatggctcaaccaattgggcttacggcggtccgaaggcccccgtcagtgatcggatcgttctaaaacaaccaggcggttcctgggggcccgcttccacggtaagggagcatacgactgggagatacacgtctctcttcgatgacctcgttcctcttatcattccgccgaccagctccaaaagcagtttctacagcaacctttcgctgcgtgcgcaatggaggcaagcagcgaataccctcaggaaggccaggagcctaacgattatcggatattcattcccccctagtgacctgggggcccgtcatttcgtctcggcatcactgcagtcagtcccggtaacgatcgttgactacagcgcccagatagcggaccgcacagaacagtttttaggcgaggaacgagacatcgaaaagttttcaggcgaggaagcagttaggaattttgtggataagagatgcgggcaactcgttaaatggggcatccgatatgggccggaggcttggcagccctatgttgaagtcaacgggaaggacgcgttggggcacctgccagaaccagcagtaacaccgaacctggccgtggaagataaacacgccctccaatgggctgaatcggaagtattgcgccggtggccgacagctctcaagcacgccaagagagaccacggagcggatcacgcccttgctcacctggcgtacatcacagactgaccgaaactctgcgggtttgagccgctgagggcaaacgggagttgccgaagtggactcgaccccaggggacatgcagtaagacgtttctcggtaacgaaggattccgagaaagaaccaaatcgagaatgtcgggtcggtcactcaagccgcacttggttctcacaaatagttctcgaatctgtaagtcgaactgagaagtcgaaccgagttttgagaagagaaaacccatgacaacgcaccgcatcggctacgcccgggtttccacccgggaccagaacctagacctgcagcgtgacgccctgcagaaggccggatgcgacaagatctacaaagacacgatcagcggaaccaagtcccaacgcccaggcctcgaccaggcgctggacaacctgcgcgagggtgacaccctggtggtgcggaaactggaccggctgggccggagcgtgaaagacctcttggacttcgccggcggactgaatgaccgcggcgtagggttcgtcagcctcaccgatgcaatcgacaccacaacggtctccggacgcttcttcttcaacgtcatggcgtccctggctcagatggaacgggaactcatggtcgaacggacccaggccggcctacgggccgcacgccaacaaggacgggtcggcggccgcaaacgcatcatgacagatgccaaaatccgctcagcccgcaaactcctcaaacaaggaacaccgccccgggaggtcgccgacaccttaggagtctccgtacccaccctttaccgatgggtcccggctgcaggcacgaccgaggtaccaaagaagtaggtcgtgctggttcgtgtaagggatttctgaaaaaatgactattggtgcagaggactattgagcagaatgcttttccgtgcagggcacttctgacatttcaatgtccatactcgtcagcactaccccggagttccgcgggcaccagttcagacgagttctgaaaatgacactggaggcttgccgaacaccggtcataaacggtcgttattgaccttccccagcatgcacaaggtgagacgtgtttccaagatgtgcatcaccctcgctttctcattccttgttcgcttggtcggcgaccggataagtgtctcgatagctttagttttttagggcattccattcggccccggttgactgatcagcatgcttactaatacgttgtgattggtagagctgatgtaatcgcactgtcagaaagtccagcagcgggcccgggcagatggttccgcccaagttctgatatggggcccggggcgccgggtttgcagcgacgtcccaccccatgtcaggcaggtccaatgtagacgcaatgggatgtgcacgtgtgacgttcacttcgcgggaaagtgaaccctgtgcccatggactggggctcgccggtggttcatgccatccggcaaggctgcatacttagacccagacgcgtccgccggtagagggagaacccatgttcaccgccgtctcagtcgtcgtctttgacgtgaacgaaacactgtcggatatgtcccccatgggtgagcgcttccgcgaggtcggggcgtcgaatgaactggtgaggctctggttcgcgatcctgctgcgtgacggcttcgcgctggccgccagcggagacaacggttcctttgctgccatcggcgccgacgtcctacggggactgttgagtggcgtggagctcgaccggccccttgacgcggctgtcgaccatgtcatgggcggcatgcaagacctcggagtgcacccggatgtccccgaagggatcagagccctcacggccgcggggttccggcttgtgacactcagcaacggctcagcccagatcgccggaaagttgttcggcgatgccgggatccgagacgaatttgagtcgctgctgtcggtcgaggatgcacccgcgtggaagcctgcccgcagctcctatgcgtatgcagccaccagcaccggaaccgacccaggcggtatgctcctcgtggccgtccatccctgggacatccacggggccgcccgcgccgggctgaagacggcatggctgaacaggaccggcgacagctacccggcctactttgaagccccggaattcaccatttccgcgttgaccgcgctgccaccggccttggcggcagacgcccaaaacaagaccccccactagcagcctggccagccggcagggaatttaatggccgaaccgggtcttgccgctaatacggcccttctacaaacgcccatgccaggaacaatccccgagacgtcaaggacactttcatgcccaatctcgatcccctctggacctctcttcgtatcggctccaccgaactacccaaccgggtggcattggccccgatgacccgtgtcagcgccaccgaggacggccacgccaccgagcggatggcctcctattactcccggttcgcggccggcgacttcggcttgctcatcaccgaaggcatctacaccgacaccgtccacagccagggctacctgttccagccgggcctggccaccgccgaacaagctgagtcctgggtcaaggtcgtggacgccgtccacgcccgcggcgcacggattttcgctcaactgatgcatgccggcgcccaatcccaaggcaaccgcttcgttaactcctccctcggcccctccactgtcgcccccaagggagaacagctgggcttctaccgcggcgaaggaccctaccgggaaccgcaagaggccacggcggcacagctcgacgaggtgcgcgaaggctttgtgaacgcggcactgaacgcgaaagccgccggcttcgacggcgtcgaaatccacggcgccaacggctacctgctggaccagttcctcgctgactacctgaaccagcgcaccgaccaatacggcggcaccaccgaaaaccgggtccggcttgccgctgaggtgagccgcgccgtccgcgacgccgttggccccgacatgagcgtcggtatccgcatctcccagggcaaggtcagcgaccacacccacaaatgggccggcggggctgacgaagcaaaggccatcttcaccgccctggctgcgaccggaatcgactacatccacacgaccgaataccgtgccgaggccccggccttcggcgaagagggcgactccctcgccgccttggccaagcagcacaccggcttgacggtcatcgccaacggcagcctcgatgaaccggaagcagcggccgcactgatcgctgatgggcaggccgacgtcatcgccctgggcaaagccgctctcgccacccgcgactggccccgccgggcccgcagcaacgacagcctggacgaactcgacggcagcgtgttcgcgcccgtggccgacgtcaaagactgggaactcgaacaaaccgcctaacccgccctatcaatctttcaccgccggaaggtaaccatgacgcttattcctacacagaccgcacccagcctcgacctgcccctggtaggcgggggaaccaccgatactttggggctgggcgccggagacagtggccgcttcagcctggtcgtcttcttccggggcctgcactgcccgatctgccgcaagcaactggccgagatcgacaagcggatcaaggacctgaatgccgccggcatcggtcaggttgtcgccgtcagcatggaaacgctcgaacgcagcacccggatcgctgatgaatggcacctggccaacctcccggtcgcctacggcctgggtgaggaagctgcacgggcctggggcctgaacctctcccacgcgatcaaggacggtgagccggacctgttcaacgaaccaggcatcttcatcttcgatgaggacggcacgctgttctggtccagcacggccaccatgccatttggccggccgtccctggatgacgtgatcgccggggtccgctacgcccaggagcacgactacccggcccgcggcgccgcctaaaacggcatcatgagcatcttctgaagggcgcgctccgaaagcagttcagaacggagcgcgtccttctcgtaccgccaggtcaatcgggcatatgcttggctgccagatcgggggactcttcagtgtccggtctcagttgtaccggtcccgcgccgctaagactcgcccggattttcaagcagccatgcaatggccttgtcccgagaagtgaagtacctcattgggaattcggccggcaatagggacagtcgaaacatggcgatcatgcggtcaacaggggatgagcctaaaagtgcgatgcgggagatattgactgggtcgggaaagagctttcgggctgccgcggagtgggttactccttggatttcgaccagcatcggcagtctagcgccctggcacagggcagagatggctgcgaggccagccctggctacgtcgattcctatgtatgcccctggtttccagcgcatgtaaatgacaccgtcggacaactccatcgtgcccttgcctttgatgtctaccttgctcatgtgtcctttgtcctacaggtcgaattcaacgttgaccggagcggaaatgacctcaccttgacgctggatctggaggagatggccaaccaaaggatccgagtggtacgaggttccagctcatggtcagccgggaaccactccaacagattcgccacggcagtccggtcgtcaaccggccactgcagcggcgcagcgaatggccccgcgatttgggggaaacgcgggacccttctggcggcttcgaagctagggtggtccgaagcaaccgagaagcaaacctactggcaagtacaaatttcggcaacatgcatttttgcaggtaaagcacgcatcggtgcagatccagagccgtctgcctaagcggcgtgtcccgtcatagtcatccggggctcgggcgagtatcccgggtgcaaaaaacgcgcaccggtcacccgggcgccagcaggcagcgaatcgaaggtggcaacaggagctggcggcgacggtgttcgccggagaccatgaacgcctcccccagccgtcgtcagctccgaaaaaccaagaattggcgtcgtccaattctgcgctggccttgcaggaagattgggccacagctgggttcctttgccattgcgccaccaccgcttccagaagtggttgttgttgttgttgagtggagccttgctgttgctgatcgccggcttccttttatgctcggcaagctccgtcggttgtcctggccgccgtccatagcagtcaagatgtagtgtcaagcgctggaagcacaagcaacagcaccgtcaggcggcccggtgggcgaagaaaattgtcttggcccgcgtgctaccgtccggaataaccgcgtgagctcaacgggtggcgagattcgaagaaccgaccttccgctggcggcgttccccctgcatcgcccatccgtttctatgtttctttgggaaagcgcgagataccgcgccatgccagacggtagataagctcactggccctgtccgggctcaggacagcgctgccgtagccagcttttgtctccatccagtaacgtgcgcttacctgggccaaacccgtcaaagctctacccagcagttccgcttcgacaaggggcagttcagcttcctcgctgatgatccgggcgattgcgtcggcaaagccctttcggaatgcttccagacgggcgcttacatcagggtcattgttcagcccgcattcgaagacaagacgatatgcaccatcgtcacgggcaacgtagccgtaatatgcccggatagcatcatgtacccgctccttgttgtgctttgtggagcggatggagtcattcaaaacatcggccagcgtcctgaggttgatatccaacagctcgatgtacagctcacgcttggatgcgaagtgctggtacagaaccggcttgctcacatgggccgcccgggcaatgtcctccatgctggccccgtgataaccattgccaacgaaggctgcctgggcggcctgcaggagctgcaaccgccgctcaccctgcgccatcctcttgggtgcctgctccgccgcctgggggctgttccgcgcgtcacccgtctgtgagtagaccaaccgacgcccgcctttctcctggatggcctccactgtactcccggcgggaacaagacccatcccgcctcagaagccccggccatctgcggtgcgacgaccgtacacgagcctagtcatcgtcaggattcaaccctccgcccgcgccccgggtgatgacacgtgggacggccgctcaagatcgacacaaggtataccgaagattggccaattcgcttccgcgccgccgtccgggtttttagagtgttcccacaagcagcaacaactacgtcggggggacgtacgaacatgagtgggacccaagcctcaagaacccgaaccgtacaggcagttccatcgccgcccagcaaccggctggctcggccgcggccgataccccagcttcctgcacgaaaggggcaggaacacgaggtacggcgcctgatccgcgatctcgccgacctagcagccacacgtcaagggagaacggcacaaccactggcgtcgatacgtccttcggctacccacggcgacacgcccgactgaccttggtggcggggtggtgatgcattcctctaatagtgcgcgcccgcctactcctcaacctggaccagccaggatatggcctcactgcgggaggtgaaatagcgagtgggacacgggagtgtccgccgtgccatagcaaaattcgcaatgacacgattaaccgggcttgagccaagaagggcaatccgggaagcggcgcacttgacgctgaagacggacttggcctgacgggtcaccgcctgtgttcgccatatcgatcaacatcgggtactcggcgccggcggcgagctgattgacctttgccatcgcggcacggacatccgcggcctccagaatagtcccccgcttccataaaggtgaagaactccctcggcactgagttccaccgtgcccttgccgccgtcaacagtgatcggttccatcgttgctcccccagtactcttgtggccaaagactaacccgcaagcctttgacctgcggaaacaacaggtcaaagctggagattccatgccgatgatgctcgtgcgaggatctacacacagaacccgtctcacaactctcgcgtctcaagacgttagccatgtgagccaattggtcgccgggagcacgacactcagcgatcacagacaccgccaggtatccgaaagtcgcattttcggaggcgtgccgggaacgggtcaaaaacggtcgttattgatgtgtctccacaggaatttcacatttcaatccacctctagaacgatcgttatcgaacaatccgtattccacgttcaaacagtccgagaaagagggatcaattagccccctccccttgtggccgccgaggactgcgcccaccaactccggcaaacccggcaagccttcctgccatccgccatgcgttcatgcatgaatgaatgcactcatgcatgcatgcgagctagcatgcctgcaggccgggcaggcacggcggcacgcatgctggcaggggcgccggccccgctcctccctcacaagcatggacgacaccgtaggtcacggtacgcggttcaccagaggccgccgattaccgggccggagcccgaccaggcacgggcgggaggaaggggtgacggcagcaaaggggtaaatggcttcccgcgccagacagcaagcattccttccttgatacgtaaatgcgctcccgctttctttcaggaatatgagctccgcctgggatgtcggcttgcgatgtgccattcgttctttcatgcatgaatgaaagcaagacagaagaagccagtccggcgccgcgaacaggcattcattcaatgcctgaaagattgacgaagttgccgacgctctaacaggctggcttgcctgcattcatgcatgagattcgaagccgcgacagttcatggacctcctgagttaactaatcccagatctcgaagatcacatgagcggctatgaaaggaatgcattcattcatgcatgaaagagccttgtgggaaatgaagccaaggctaggccgaacagcgctgcctcaagcaagccagctggccagccagcttgagcgcatgcgtgcaaacccgcaggccagcgtgcatgccttccggcgttaacgcaagccagcatggaagcaggcatcctcgccagcttgcatgcatgaatgcattgttggcagtacagaaaggagcgggcatatagctcaatcctgcccaccaagtcgtcggctccaggcccggctagactcccgttcaatcatcctgccaggtggcgttcttgcaatcgtgcatgcatgaatgcattcacgaaggacccccggcagggccggaagacgccggccagcaagggaaccggccctgaccctggtgggggaggggcgtggtcggcgtgcccgtggcgccgacaacgaccggcaggaaaagaacgcagaatgcgtgcgtgcatcctttctttcatgcatgaatgaatgaaagaaatctgtcatgccagtttgatcacagcgggggcgcggtcggcgtggctacttgtaacgcacatgtgcgcccgggaagcttgaacccatgcaaacaatcatggtttacagcgagtcaggtggcgccaccaagacgacgtcggctgtctctctcgccgctgtaactgccgcctcgggacgcaaggttgtcctcgttgatctggacccgcgtgccgccgcaaccaaatggatcggggtggcaccgaaggagtctggcctccacgtcggtgccatcctgggcgacccggacccggagggttgggctgaagacctagccgtagagtccaactggttccccaacctccgcgtcgttccgtctgcccgcagcgtctccaaccgtgaagcagaccgagccgatcacgcagagctccgcctgaagacatccctggtgggaatcgacgctgacgtcgtcatcatcgactgcccgaaccgtcagggtgggccgctcactctctccgcgctcaacgcagcggacaccatcgtgtacgccgccggcgccacggtggacggtgtcgatggggtagcgggtgcccgccgcagcgttgaacagttccgcacctcacgcaagcgcatcggtgcgcccgacaacctccatgaagccggcatcatcgtcggcgccgtcgcctccaccgtcatgtccagaatcgcggtcgccagcatcgaggaactgcgtgaaaccgggatgctgctcaccccgctggtcccgcaccgtaccatcgtccaagagatgcgcatgacccaggagtggtacggggagtaccgcaaaggcctgccagtagtggaggcctacaccgagctgatgaaagagatcgtccgatgaccgaggcaagcgtaatcaaagaccgacccgcacagctgcgccgcaggccccgaccggccccggatgagacggtggaccctgtcgactacaacccggcaacacataccccggtagctccgtccgccgccccggtccaggatggagccacccccgtcagtgggggaggggagaaggagccggccgaggaagcagcgccagctgcggttcctgctccagcgactgagcccgtctcagcgccagaggctgcagtagagtcgtcgctccaggcagcacctgcccaagctgcccctgcagcggtcgcggttgccttcgagtcactgccaccagctcctgctcgccaggcctccagagggtcaaaagccaaggcgactacgaacaagaagtcccagcgccgcgaggtcacctttccgctgagcacccgcgtctcccaggagatcctggatctgctctacgacgcccaggaaaacgagggcgtcaccctgcgagacgcgatcgagcagggtgtccgaatgcgctggggatccaaccgctaacccgcatttccccggtcaggctttcgtgcattcattcatgcatgaaagcctgactttccctttacctaggggtcaggccgattgtctgaaggccatgtcggacagtgaccactcgtcgggcggtccctcgaacatctcccacgggtagtcctcaccaggggagaggagctcgacgacagtgttgacgttcttggccagccactcccgccagatgatccggtctgtccggtacctctgcacctgcgccgccactccctccaggactccgaactgttcagcgagctgactcaatgacgtcgtggtgacgaccgaccaggccctgccgtcatcgcgggcgaccaggttccatgccgtaagaacttcgagggcctcgtgcactgcggacctagagaggcgcgtggcacggacaatttccgatgtcggcatggggggagagtgctccagggcctcgtagacgaaggctgccggcagccccagctcccggaacaccgggcgcagggcgtggacctttcccttccgccacgtcgcatcttcggcggcaatcttaagctcttcgggcacggtcagcatgtacagatcacctttagttccacgagcttcttccaccagcgcgaccaggggatccttctcagcacgcagctccctcaggtggagaccgacagtggtgtggtcaaggccggtggccacggcgatggaccggacgccgaattctatgaaccgtgaagctgtcatgtgagctgcctcgcccagtgcccgtagcaccattcggcgtgccattcccgtcctggattcctgatacctcgcctccctgatcctaagtgcactgcgccaggtccggatgaaccgatgctctgcatcgatatttgaatttgaggatgagctctttatccccgccgcctgtgtatttggtcggcttgtgggggatctgcggacattgttgttcggggcgtttttggccttgtttttgctgagatagctaagggcgctcgtccagtcacggcgtagggacgggagccggtgacgggctgcgtaccgggcgtagaaggaagcgagcccgggccaggttccctggagcatacggcgttcaacatcgaccagctcgaggcctgctgccgccgcggacacgatgacggcctggcgtgcgtcggagtccgaggcgtactggttggtgtcgtacagtccggtctgggcgagcacctgcattgcccgggacatgcgtccgacgggctggtcgatgaccggtgcgttcgcggctgcgggggtgaaggtttcttcctgccggagggcccggacagccttgatctctgcggctatgtctttagtcatggcggtccagacggcggcgctgttgggccggcgcgctatgtcgtaggccatggaaaggctcattgccagctgctggtggccgccccgcttgtgcggtgagccgggggttcgcatacagccgtggagcaggttttggtgcggggtcttgtccagggtccggtaccgtgtgcccagcgcctcgacaagatcacgcgcttcggagaaggtgacccgctgcgccagcgggatgtagacatggcggccaccgttgggggagtagtcctcaatccatcgcgccccgaccgagtgcagccaggtctggacggcccggacatcggcctgaacccagtccactccggctacagaggagtcgaagtcgaggaagatcgcggcacaggttccgtctttgccgaagatccgaacggcggcgggaaaagacgggagtgtctcggtgaggttccgttcatatctctgcggataggtttttccggagtccttggaaagccggaccctgggctgacccgcgagaacaggagcaagggctgcccacgcttcggctggcgagtatgacgaggagaggttgcgcgacacgccagactcagatatggctggcgacgcacatgggtgtccatgtacgatgagaacaatcctttcggggagagttgctgacaggcaatgaaaagggccgatcttggcggatcggttttgttacacaaatgaagccctgtaaaggacttccaaacgattcgcggactgttcgccggcaagcatcccagttcgtgaatcagaagcttcgaaggcccgcctcgtgcgggccttcaacttttaagaggctaagcggccgagtggcagctcgtcctgctggtgaattgcgtgaagcctggtgttggcaaggcgctcctcaaccacgtcagacagccagtcgctgacgtactggtacccctccgcttttgcaatttcctccattgcatcggccttgggagtagcgatgcggaaaccgacgaatttgcgatcgcctttggagcgcctgcccgtacgagtagttggagccatcatccctgtcctttgaactacggcagccggggctgcctttacttcaatagagtggtcgagccaagtactcagcggccctaaaggagtgaaatgctggaccttccagctcctctgaaactgaaactaccaccgacgacttccgccctccggcattgaaacagaaacagcctcggcgtgttgaatcggaaacagccgcatatttcagcctgctgcaacaggtccgagcgcatcagtatgagctggcgacaaaggctcgatgccggtgcgccgcgcgtacgtggcattggtgtttcccttccgttcgtgacaagcgactgtcgtgccctcttggtaaggtaggcccgatttgccttggtcattgtttggccatttagcaaaacacgtctgaaacatgtttcagactagcctagtcgatacaaccatgtgaaggaacttgtagtgacgcaagctctgcgttccttgtcaataactaagtctgagcaagcgttctgtgatgcctccgaggctttcgagagcctaaatctttcgtctggtcttacgcttgagcagatcgtaagtgccgtcgaagaaatccgtggccgtcggattcgtatcaaggcaaccgacagattgcttggcaccgccatctgcggtctctgggttcctggaaggagtcaggaatgggtgtttcatcctccgactccttgggagttgcagcggcagcaattcatccttcatgagctcgcccacatggtcttggggcatgatgcgaattccgcagcccgcgtgttgctattagaaggtctgcaaagcttgtcacccgagcttgtacgtcgagcgctcatgcgaacagaattccgcacagtggaggaggccacggccgagtatctggcggatttgatggcagaagcgctcaggggaactccaacagagccaggagctttcgaggaggtcttcggatagtgcaaatcttcacggcagcgctgatgatcaccctcagcgtggttgtcgtagtgacccggcggcccggaaaggacacaagcatcctctgggcgtcggtcctcatctcgatctccttgctcttcaacgtcgattgcgtttatgtggtcgttgatcagctcttgtatggacgaaactatgccgacctcggtgcaaatctcctgctcttggttggtgtctacttcctggcaagagccattcacagggctgtccgcccccttcctgtactgggacattccaagtcgccccgtgtgctaggtaagttcggcgtcatggtagccgcgtccgctgcagctgcttttttcagcctgatcgatgcccccatcacttccacagcctttatgatgcagtacggggttcagcctgccgctgccctatattcggcggtccaatacgtatacattggtgcagtgatggccgcggcaggttggacctgcctacgcttccgcaagtcttggagcactggcaattacaagacggcgttcgcgctggtaggtatgggttgcttgtcagctgtcctactagtggtcaacgtactagcgcttgacactctgcatgtcttgggcgagctgcaggcgatggccacgctcagtgggctgtatggggtacttaacgcaacaacttttactctgctctgcaccggactggctctcccgccagcacgacgcaaaattctctccatatacgaggcctcacggattaattccatgctcgctgaattagacccagtctggaaggtggccatcgccggaaatgccggggtgacactagatttcgcggtcgtacccgaacgtccgcaccgacgccgacgggagctgcaccgcatgattgtggagatccaggattctcttgtccgggatcccggatcgaggaaacggatcggtagcgacggacttgacaagctggctagggcaacccgatacctcgagcggcaatcgtggcgctcgagatgactgctgctatggccaaattagtggttgctgcaacgtgcgccacactgatgacgcttgcatgggcggcacggaaggccgtttctcccacccacagaccccgctatgacatcattcccctagcgataaatgacgatgaaatcgagcttcgggccaccaagcgcacgcttgcaccagggacctttggactaaaaatcgctgggcaagatgacccagctgttctaggacccgtgcttgctaccacaaacggggcggttcggcgtcgccttctttatcggcccatagcattgtcattgcagtcgcgttgcaggtggagcggcatcgtagccgtcacaccgtctgcctctttccttgaaactgaggtgcccaccggactaggtccggctcctgcatggatcgtcgataagggaaacgacctgtgggcaattcacgtacacggccaggggagtgaccgtcgacagacacttcgaggcgtggaaagcgcaagtgctctaggtctgacctcactgatcgtttcctaccgcaacgatggtgaggggccgagatcgcgggatggccgctctcacttgggcgagtctgagtggcacgaccttgaagacgcgctcaaggtcgttaaagaacggggaggaaacagctgcatcatattcggctggtcccttggggcgaccattgctctcaatgctctccaccgttcagagctggcaaatatgatcaaaggtgtcgtgatggtgtctccggtactgaactgggaggcggtcttccgtgcgaacgcccaccaccaaggctggccccggttcctcggttccgtgattacctccttaatttcctcaactcagttgtgccggctggctggcctcaaccagccactggacatcaggagagcggacgcgaacagattcggccgcaggcccaacgtcccaatgttgatactgcacaacaaaaacgactggtccgtccccatcgaagattctgtccgcttcgccgcggcccacaaaggacaagtaaaactggtcggattcgagtgctcaggccacacacaggagtggaatgcagacccggtagggtgggatttggcagttcgttgttggtttggaaaatttttccagccggaccgggctgaggctcaagctgcaacgtcagctggtgaactttcggatgaggtaggaaatggctggcagtgagaccgcccgggatcggctggcaaaggcggagactcttgctcgcaaggtgaatcttctgcttgacgtagtagtggccgaaggtggcaagccgtatgaattctcggacatacaggccggcgtccgccagcacggatacgaattgtccaggacgcggtggtggcgcatccggtctggtgaatcgctggaggttgtgcccacggaggcgctggttgcactcgccaagtttttcgagattgacccggtatacctgacagatgaaaccggtgaacttccagaacgcattgaacgggagcttcagcttctgaagaagatgcgacgaaaccagctgaagaatatcgcggctcgaactcttggcgacattgacatcaagaccctggacgccatcaacgctcttctcgatgaagtcgatgcccttgaaagaattgaaccggaacaccctgaataatgttcgaaacatgtttcgcccctgttagggtggtggcatggctgtcaagagcaaggcgtcgggatcagcgtccctcgatatagtcaaagtatgcgcgcgccaagtttcggaccctggctggtcgcacagcataggtgacatcccggccttggcgtacaccgcgcggaggatcagtttcgatcaaaccatcatcttcgagagcgtccagatgccggttcaggctcggtctgcctatgtccagctcagcctggagttgcccgatcgtcgagggacccacaatagccaattgcctcaagactttcgcttgagccctgttgcccatgaatctaactgcggcttcaacatctggaggaagattcggacggatcagtcggggcatgcgtccatactgcccgacttttcattaaatcatcacgggtatgcatgccgtactctattgctaaataaaagagtgcgtgccgcggcactctttatgtggggtcgccaaggcagctgcccgcagcgtctttgcctcatctccggtgtcactcgtgcttgcaccaccgacctggcgacgaaaacggacgccacgggccccttgttagtcggaccacacgggagtctgggctgatgcggggcaggtcatctgctctggttacgctcatcgccaccccgatactgttttttggcctgatactcagcatgctcgtgctgctcaccccttcgaaatctaccgcggcgacctgtggcccggccgtttctgccgtcatcgatgtgaacttcaaagtccatggctacaccggggagcagttgaagaacgcagcagcgatcatgcgggccggtaaggccctggacctgtcgttgaggggacagatgatcagcgtcatggtgtctctgggggagtcgggcctgcgtgtccttgactatggcgacgggccgggcccggactcgcgcgggttgttccagcagcgcgacaatggcgcgtggggctcctacgcggaccgcatggacccaaccatcagcgccatgaacttcattaaggccctgcagaaggtcgagggctgggagttgctggagccgacccttgccgggaacaaggtccagcgcaacgctgacccgtaccactacgagaagtactggcccgaggcggtcaagctcgtgcaggcactctcggacggaaagttctcgctggaaggcagcgactgcctcattccggggaagtccggtgccggggatgattacccgtggaaagtgtctcccacctggatgcaggtcggggcaggagcagccgccgcatcaccgttgggcatgttctaccgggagtgcgtggacttcgccctgtggcgggtgaaccagcagatggggtccaccggtgaaccgttcaagttcctcaacggcaacttccgccccgacggccagggcctgggctcggctctgacgtggaaagccggctgggacgccaaaggatggcctaccggttccgttccccgtgttggggcagtcgtctggtatgcgcccggtaccgggggagcggacccgactttcggtcacgtcgccgtggtgaaggaagtcaaggacgacgggacctacgtcgaagagggctataacggcaacccgcctccggatgaccacaactactacacccgcactgtcagcagcgatgtcccgtcagcgttcctgtacctgcccacccaagaggagaagtaatgaagaagcccctggccctcatggcagtggccttgctctgcgccgcatgcgcaccggcagcgaacaccacgccggcaccggccgaacccacgactgcaacgccttccgcgccggtttcgctgagcgccagcagcggtccacaagctcccggaggcacggtcccggccacgatcggcatcatctgggaccaggccagcaagaccgcggccggagacgtcgctgagaaggccatggctgactttgcccgccccggtgtggaggaaaagcaatgggccaacgatcttgcccgctggctgacaccacaggccactgccgactattcggccgtggacccggccaacatccctgcagaccgtgtcaccggcccagccgcgctgagcgtcgatgaaaccaacggctacggggtcgtggcctcaattccgaccaacgccgggacctacacggtgcagctgctccgcacgggcaaggaagccccgtggaaggtcagccgcttcacaccaccctcgtcctaagcgccggaactcccccaactcacacacgtaaggaagaagcccatgagcaccacatcaaccgaggtcctggcctttccaaacatcagggccatcgtccgtgacaacgggaccgccgaggtcgtcgtcgccggcaactcccgtatcgtccctgccgggaaatccctgcaggatcttcgtaacaacgccctggccctcgtcgtcggggaggcccagacgttgaaccgtcccgtcagggtccagatcgaggatcccgaaggacacggtgaattgatcgtgcacccggacaacaggatcgcatccgtctcctacgaggcacgccccgcccgccgcagggcagaaaccgcggaacccacgccccagacgccatctcccaccgtcattgacaccgtcccggtccctgcacctgaacctgctgcagcgcctgcagaacctacggctgccacagttgccgcggtggaccgccagccgtggccgcccaacccggtcgcgtcggagacgacgtcagcgccggcagttgccatggaggaagcaccggtgacccggcgcagcttgaaggaaacttcgttcctggtcagcgcaccggtcctggagccggccacgcagggttggcggggtgtgctcacgcgccttggcttccggatggacccgtccgcggaagaactctccgagcgggaggatatccggacggtcagccagcactggcctggtccccggaccattgccgtggtcaaccgcaagggcggggcgaacaagacccccactgtggtcatgctctcggccatccttgcccgctacagcggggccgcgaccgtcgcgtgggacaacaacgagtcccaaggcaccctgggctggcggaccgaaaagggcgcccatgacggtagcgttctggacctgatcgattcctcgaccgagctgctttccccgtcaacgaacgccgctgagatcgccaagtttgtgcaccaccagaccgccgacaagttcgacgtcctgcgctcagatgagaacgaggaaggcgaccacgaagtcactgctgaggaagtggacattgcccacgaggtcctcacccgctactaccggctcgtggtcatgactcgggcaataccgctcgcgcagcgaactggcgcaggatgatccaccacacgaaccagctcgtcgtcccggtgacggccatcgaggaccgcgcagaagccgcccggctgacgctgcagaccctcgaatcccgtggcggccacgacgccgaactggcccgcaacgcggtcgtgatcgtctccgaatccaccgacgccaagcggaccatgtccggggatgccttgaagcgggccaaagacgaggcccagcggatcgcggacggcttcgaaccgttcgtcagggccgtcgtgaggattccctacgaccctgccctgatcaacggccccatccgctacgaagccctccagccagccacccagcgggcatggctggccgccgcagccgccgtcgccaaaggcttctaaaccacccacagctgacttccgaaaggaggaacccatgcaccagtccctgaacccctggattaccagccccggcaccgaaacgccggaggaggaaacactagatacgtacatgcccccggaggcggtcatcagtgccccactaaagggcatggtcgaacccgacgcagcggaccgcctggctagccgcactttgaccggctccgcagccttgtgggtcataggcgctcacgggggagccggcgagagcagaatcgctgacctcctcgatgcacgcgccacagggcactgctggccgatcctccaggacggaagcaaaccacgggccctgctggtctgccgcgcagacatgcgcggcctgacagccgccaggagtgcgctgacccaatgggcatcaggagccgcaccgaaagttgagttgctcggcctcgccgttcttgccgacgcaccggggagaactcccaaagcactccgggacttcaccgccatcgtcggcgggggagcgccccggctgtggaccctgccctgggtagaagcctggcggcacggcgacaccacggcgcagccgtcccgcgaataccaacgcttcatcaccgacatggccgcgctggccaccacatcaaccacccactgaaaggtttcaccatgaactacttctccgcacttgcaaccggcgtcatccccaaccccactccgaccatcccggcagaggcagacgggctgctcctggtcctgaactgggcctccggcatcggcctggtcctcggcgttctcggcgtgatcattgtcggcatcggcatggtcatccagctccagcgcggtgaaggcgcgcaggccatcggcaagctcggctgggttctcctcggctgcatcatcatcaccggtgccgccggcatcgtccgcgccttcgtctaagccagcaccaacaacgggaggttcaccatgagccagtcaacagagaacaccaccgaaagcaatccgttcaccaaacccgggttcatcattgcggccgcgctggtggtcgcgttgatcgcagcaaccatcgtgatcttcctgctccccaaaggacagggcaacgcccagtcagccccagccccagcagaatccagcagcacagccgctgccattcctagcgctgcagctgaggcaggcaacagcgtatgtggactacccgctacatcggagacggctttgggaactgccccggaaacgaaatgggaactcgtgggaagcatggctgccccaaccgaccccaaggttggtcccggcaaggtagacgatcagggcatccgatcctgcttcgctcatacacctactggcgcgctgtacgcggctgttaacctctgggcgttgggcagtgacccatccaaagaaccagctattgccgagcagcttgcagctaaaggacctggtcgtgatgccgggatgaaagcgcctccaacatcagccccggcctcgaccttgaaggtccaagtcgcgggattcaacgtgtcgtacacggccaaccaggccgttgtggaactggcgttcaaggcgaacaacggaggccttgcgtcggtgcggacaacgttgctttggcaggacggtgactggaagggcgtggttgccgacagcggcaaacccttggaagagccccgccaaatccgtgacctttcaggatttatcttgtggagtggggcatgaggccgacttggaacatcgtcggagactggttttccgggctcgccgatgacgctatgggcaacatggcgaaagccattcttgagggcatgagccagatggtcacaaccctttctaccttctgggtttccacacccacggtaaacctgaccagcgaggatggaacgacagcaagtcctatcgtctccatggtgaacgacgagttgatggcctggacggtgacgctggcggttcttgccgttatcctcggcgggatccggatgatctgggaacagcgaggggcaccgctcaaggacctgctccgctcgctgctcaccctcaccctggtgtccggccttggactgggtgtcatctcgattctggtaattgctgctgacgccttctcggccgccatcattgagcggtctacggacggcaagggattcgcggaggcgatgaacatcctcgtcgtgaccggacagacgggtgttggagtgttcattctgattgttctggggctaatcgggttgatcgcttccctcgttcagattgtcctgatggtagtgcgcagcggaatgctggtgatcttggctgggatcctgccaaccactgccgctttcacgaacacggagatgggcaggcagtggttccagaaagcagttggctggaccattgctttcattctttacaagcccgcggcagccatcgtgtactcggtcgcgttcctcttgatgggcgacagcagcggtcaggacgccctggtcggttcgatcacgggtttcacgctgatgatcgtcgccttgttcgcacttccggcgttgatgcgtttcgtcacgccgatggttggcgccgtcgccgctggcagcggtgccgcggctggagccgccgttggtgcgatggcgaccggtgcagtgtctctgggccggggcggcagcggaaggggcaatgccgcgccaatccccgcgaccacaagcagcagcaccagtacgcaaagcacgcacgccggcagttcgccgaagggcagtgacggagcgcctggtccgcggggcgggggaggccagcccaccccgggtgttaccggcccggggggagccgctggcgcagccgccgcaggcaaagcaggctccgcaggagcagcggctggcgcaagcggcggggcagccgcagccggcccggccggtatggctctagccaccggggcacaggtggctaccaagacgtcgcaggcaatcgaaaagaccgcgcaggattcaacgggggagggccccagtggcagcaattaacaccgaatacaaggaaccgtcctacggcaactggcgtgtgccgcgctccgccggcttgggcaacctcggtgccattggcaccgcgatcgttatagccgggctgttgatgggcatcaccaccttcgctatctggggcctgtttccaggcctggctgtcctcgccgtggcgggggccagcgccctgttgctgacggttaaggacaagcacggccagtccgttgtagaccgtttcggcacccgaatgaccttccggctctccaagtccactggaacgaacctttaccgttccggacctctgggagtgaccgagtggggcatgtaccagctccccggtctggccgcgaagtcgaccctgtacgaggccaccgactcctataagcgcccgttcgccatgctgcacgtgccggccacgagccacttcaccgtgatcttctccaccgaacccgatggagcctccctggtggaccctgagcaggtcgacgcctgggtcgccaactggggtggctggctcgccggccttgccgacgaagcaggactggacgccgcggccgttaccgtggagaccgctcccgactccgggtatcggctccggaacgaggtcgaaatgaacattgaccccaaggcgccggagttcgcccaggcgatcctgcgcgaggtcgtggacacgtacccggagggatcagccacggtccgcgcctgggtgtctttgacctttaacgcctccctgcggtcgggatcgaagaagcgcacccccgaagatgtggcccgggacctcgcctcccggataccgggactgtcagcccggctgcagtccaccggtgccggtatcgcccgcccgatgtcggcgcaggaactctgcgaagtcgtccgcgtcgcctatgacccgcccgctgcgctgatcattgacgaagcccacgccgccggttcccctgttgccctgacctggagtgaggtcggccccaccgccacccaggctaattgggacggctaccgccacgattccgcattctctgtctcctggaccatgaccggcgcaccccgcgggtccgtgaactcttcggtactgtcccggctgctggccccgcacggcgacattgaccgcaaacgcgtctccctgctttaccgtccgatggattcggcgaaggctgccgctgtggtcgagcgggaccaaaacaatgccaacgtccgcatcacctccggaacccggcccaccgcccgcgccctggtcgatgcccgctccgctgtgcagaccgcccaggaagaagcccgcggtgccggccttgtgaacttcggcatggtcgtcaccgccacagtgaccgacagggaccggtttccggatgccgtggccgccatcgagcagacttccgggactgcgagggtgctcctgcgccgcgcctacggcgcgcaggacaccgcgttcgccgcgtccctgccgctgggactggtgctgcccaagcacagcatggtgccctccgaaatcaaggatgccctctaatggcactcaaggaccttttgacagcaatgacagtaaagccagtaaagaaggcaaaaggcactcccaagaaggctggcccaggtgctcgtggttgggacggacgtggcggcggcatggcgcagctcgtcccgtcggtgaaggagtatcggggaaccacggttcaggtctgtggactgtggccgttctcctccggtgcgtcctcgcccatgatcggtgtcccgctcggacgccacgaggaaacccaggccacggtctgctgcgacccgatcagctggttccagcgcgcccgcctcatctccaacccttccgccttcatcctcggcaaacccgggctgggcaaatccaccctggtccgccgcatgttcctgggccttgccgcccagggcgtcaacccactggttctcggggacctgaaaggcgagcacgtcaaagccgtcgaagccctcggcgggcaggtcatcaagctcggccgtggcgtcggatacctgaacatcctcgatcccggccaggccgtcgaggtcgcccagctcctcgaggaacacggccaccacgaagcagccacccgggtacgggccgacgcgcacggccgccgcctgaacatggtcgtctccctcatcaccatcagccggaacaacccgcccaccgaccaggaacaaaccatcctggaccgggcgctgcgggttcttgatgaccggttcgacgggatcccggtattggaggacctcctcgatgtcatcgtctccgccccggatgagctgcgccaggtcgcgctggaccgtggcgacatgaccgtctacctgcaggagacacgggcgctggaagcaaccctgctgggcctgaccgggggagggaagctgggagaaatcttctcccggcagaccaccaacccaatgaagcgggaccgcgccgtggtcttcgacgtctccagcatcgacgaaaccgaaaccgatctgcaggccgccgtgctgctcgcctgctggacctacggattcggaaccgtgaacgtcgccaacgccctcgccgacgccgggcttgaaccacgccggaactacttcgtggtcctggacgagctgtggcgggcactgcgctccggcaagggcatggtcgaccgggtggacgccctgacccgtttgaaccggtccgtcggcgttgggcagattatgatttcccacaccatgtccgacctgctggcactgccggcagaagaggaccggatgaaagcccgcggcttcgtcgaacgctccggcatggtgatctgcggcggcctgcccgcctcggaaatgccgctgctgacctccgcgattccactgtcccggcaggagcagcaaaagctcatttcctggcaggacccgcccgcctgggactcacgcggcctcgacgtcgatcccccgggccggggaaagttcctcatcaaggtaggcggccgcccaggcatccccgtccagatcgggctgacctcgatcgagaagaacgacggcctgaacgacaccgacacccgctggcacccagacagtgagaagttcgtgtgaattttgacgcttctggcttgaacttgagcatgctcgcgggctgtagaccttctgcgtgcttaggtttggggaacccgttggccctcgggggtaaggtcggggtgctcaagggtgttgagatagcgggtggcgccttcaacgctgagtccgaacaggtcgcagacgcggcggatgtcaccgccggttgcgtggatctcgtgcaggatgcggtcctctcgcaggactcgcggccgcagcgtcaagccggaccaggggaactggctgctgacggggaggagcctgggtgcggtgcgccggttgatgagcaggtgcgggttggcggtattgggccaggtccggttgcggtggttgagccaggccgtcaggcgggtgcgcacgggtccggccagcgggatgtatcggtcagccagtacgaggtgcccgtccctgatgtcggtcagttgcagttctctgacttgctgtcctgtcagggcgtggaaggcgaccagggcaaccgcgagggcgactaccgggtccggggagttcagctcgccactgatcaccgcggcatccagggcgagcggagtggtggtggttttcgggaacgctttcattccgcgggtcgggttggcgaagatgagccggcggcctttgagggtcgtgaagagcgatttgagcccgttcccggcgatgtggcggcgggccttcgtttgatccagtgcggctgtgatgtcggcgcgggtgacctcggcgaaagactggaagcccgcctcggcccaggcatggatgatgggttcgatgcccaggatatgcacgatgatggtcttcgggtctctcggaatttgccgtggcggctggtgggcaccgttgatcaggacttccagccacacctcaagctggtccttcatggccggcggcagggtgctggtctttgcggcgaagtagcgttcgactcgggtcggccggtcctcgatgaggaggccggccgcggccagaacgtcgatggtggagatgacgttgccggagtattggcgcagttggaggacgtcggtagcgcggaccttcgcggtcggggttggccgcagaccctgcagcatccgcagcgagcgggtcacatcgttgcgttgccgcttgctccaaccggccctcgcggcgtgttcacggacgatggcggcgcagtagcgggtcaggtcgttgtcttcgaggcggacacgcactgtgacgaccctcgggtcgggcgcgatatcgaacaacgtcatctgtatgccgaggtccgcggcgggttgggtgccgggcaggtagttcttgttccgcagtttccatggcgcgcgttggtccgggctcaacgctggtgctccacggcggtgaaagctcatgttagcgaagaagagctggtggccatccctattcgcgccgggcaggtccaggccatgtcctggcatctggaccattcgggcctgctccagacacagccggcaggcccggcgctccccgatgcgggcggtgcggccgcaaaagtcgcagactccttccgggtagtgagcattccaccaacggcaaggccagcacgtccagttatatcggcggtagactccccaggccaggcagcctttgcacgagcctgggtgttgcgggctgccgggatggcagctggcgcacaggccctggctgaagtagtccgtggtggtaccgcatttggagcacgggggcggcctgaacgggccgccgggaaggcagtcgtagcagaacgccacctgcggataggtccaggcggcccggttgatctggcagagggggcacatcgcgggtggccgcaacggcgccgccgggcccggagccggactcacagcgccgcctataggggttgcaagtcatgccttgtacgctacggaggacaaccttgtcggattcccttctggaaaatttggggtagcagacggggaggctcccaattctattgtcgccaacgagttcaaacccaaggacagccaccgcatcgtccgcaacatgttcgtagtcccgtggttcattgcaggttccgttgtattgttcatcaccgctgccactaacaacggttgggcgtttctggtagggcaggtggccagggttgtcgcgttcacgtacttcatgttcttctttatcgtccccctactgttggcactggttgtggagctgattctgaagaaatttgttgcatcggtcattacagttcaggcaacagagggcgacaatgaggtgcacctgcacttcaccttccggggagcctcggctctgctcgccaaggatcgactcctaaagtcctttgaatcccctgttcttccggcgaaataccacactcctgcaatggcgcagaccgcccaggctgccccagcgagcgtcgcagcgtgactggcgcgagcagggaaaccatcgagaccgtcgcttctgacgttggtgacatcaaacgggatgtcgagcaaattctcccctcgcttgtggatgccttgaagcggaacaggtacttcgatgagatggaaaaacggctaaggcgcgcggaacgggttgcggaagcatggcgtgacttgcccctccttgtcggtgtccacgatgtaattctcgcgatgcgcgcgacacccaaccatgaccctgtgttcgtcgagcagctctccgacgtcctctatcgatctgcgggcgtggaggagttcggacttattggagaagagatcgatccgaccatgttggaaatctacagttcggagggcaccggcccaagaattatcatccgtgaggttcagcgaccaggtttgcggatcggtcacagcccaattcgcaaagcaattgtgtctgttacaaggcagggagatcagcaatgacggttatagggattgacctcggtacgaccaattcagctgtcgccactaccgacgcgaacggtataaccacgacaatcgccgatcgcgatggatcccgcgttattccatcagtcgtgtatttcgcgccagacggctctgcggtggtaggggaccgagctaaggcaatggctgtcctggagccggaacgggtggccatgctcttcaaaagagggatgggtgcgcccacgttcctcttcgatgagagcgagttctcggtcgacggaaaggtatggcggccagaagaactctcgagcctagtattgaaaaagctcaagcagatggctgaggaacaacttggctcggtatccggggcaatcgttacggtgcctgcctactttggcgagctggagcgcgcggctactcgcgaagcggcagaactggctggacttccaattctacgcattctcaacgagcccacagcagcggccatcgcgcatggaattgatgccagctcccgcggaaagaccataatggtcttcgacctgggcggcgggactttcgacgtcacggtaatgcgcgtcgatagcgaaggcgagatgcaagtcctatcgacaggcggaaatcaccgcctaggcggtgctgatttcgacaacgaaattatgcaaatgatcgctgcacgtgctcaagcagaagcgaatgtcgacatcttcgcagaaccatgggcctttcaggatgcccgcgagaaggctgaagaccttaagaaggaactctcaacccttgacacggctacgcgccccatctccaccggaggccgtccattgatgttttccatgacgcgcgccgagttcgaggcatcaatcgcggacacagtggaagatgtcagcgacatgattgagatcacccttggcgaggccgaagttgacgcagccgatgtggacacggtgctcatggttggaggctcgtcgcgtatccccgcgttttcaactctccttcgcgacatgttcggcaaggaacccaccttttcgcgcaatctggatgaggacgttgctagaggggcttctgttctagcagccaagatcggtggtcagatagatccgcggtcggagctagccgatctcgctattcccaaggatgtcgcatcccacggactaggtatgaccgtcaacgattcagatgacagggaaatcaacgggattgtggtgaaaccaggtcaaggtgtcccgtccaagggcactcagactttctacgcagccgccgacggccaaacgcaagtcctgctccgaatcaacgaaggcgacgaggaagaccttgcttatgtacggcagatcggtgaaggaatggcacacttcggccgtcctgtcccagctggacatccaatacggatcgacatcgcctatacggcagagcagattgtcgaggtttatgcctacgacggcgaaaacaacaaactaattggtgaagtgagacttgaaagaaccgggtcactgtcgggagatgagaaacggcaagcccttgctgccatcgcaggaacaggagtgcagtgatgacatccgccgcgcccgagcaggaatgggtacaactaactgagccggccagcctcagccaagatgacattttcaagttctttgggatcccgccgtcaccgcacgacaaacttgaaaaaaacatcaaagctaagcgtcaattttggactaaacgcgcaaacggtcccggtggccgcgagctcgcggcaaaggtcaaacagaacattcaaaacctctcgaaggtcttggaagagggcgcagtccctgagcgaatcgtcccaactggggacggtaagtatcaagtccttggtgatgctgcctcgccacaggagttggctgatcaactcgagatgttcctacgagcgggggactgggccaacgtcgtagcgacggcccgtttcggcttggagaagtggccagaaaacaccgaagtcatcgtggctattgcattagcgctttccgaactcgctcgtgacctaccacacatctcccaagacgtgcggactcttgctgcttcatctactaatcgagctctggaagctgcccctggcaacccggatgtttggctagcaaaagcccgcgttgtgcttgcatacgggaccatcgaggaggtcgaagccctggaaaggcatgccacggcgcaggaggtgtcgcttccggctgagctgtactgcatcgtcgcgacggcttcgttccgcgccggagacgtcactggtggaatccatcggctcgtgcgagctgtcgagtcgagcaacggcgaccctgggatgcgcagcgtggcaaccgactcgatgattcgggaggtgctcattcccttgctgcctctcacgaatcgaaaggcggcacaagcattcggtgaagcagtccaggtcgccgcgtggattgcggaaggagtgcccgaatcggaggcagaacttctcaagttccgaatttgggcgaccgagtcgcagtcgcgggtctttatcggggatttggctctcaagtccttcctcggagtactgacaggcttcgtcgcgcttccgctctacagcaaaattgcctcccggccgggctggcgcgttctcaatgacggaccaaccaacaaaaactcttggttgcaatggactgatgttgctgagggcgagttcatcgaagagctccaccagttgtcgccgaggccgttcgcgtggcaaggagccgcaggtgagaagtggcccactcgggagcaggttgtccaggcactgacaaccggaacgcagtgaaggttcccgaagggtccgaatcggtcgaagagtccgatggtagggccgttgctgagaaagtttgcgcgcggtgtgggcgagtggtacatacgcttcgctgcctcacctgcggaggaccgcctataaccggtcctcgcgattcagggcctctggacgccgaaggacggtcgagcccgccgaatgtcggccgcggggagccaatttccccgtcgcgaggaagacaagaagcgcctgaaaagccagcggagaatggacaggggccgcatattcccccaaacgatccacgtccctctaaggacgttcgcttggttgaggccggagaccgtattgccaagcagcaagaaaagctcggtcacctcgaacggcgacttacagctgcaactgaggaactgggcttcgagcttggcgttctgcgcgcagacgtcgatgctgccgtttccagcatcgaccaagcgttagcctcgaacctcaacttgattgctgcggaacgacagagtgttctcgcacaactcgaccgcgatgaactaagtcgacaggcccaactgacgtctgcgcttgttgccaccggaaagaaggctcgcgacgctgctactgaactaggcctgctcagcccagctgtcgcgcacatcgggctgcagcactccgacctctgtcccgcgttgagtgtacggccaatggccaaccttggtacggtcaatttttccggggcagcgaccctcaaacatcaaattcccaccctgcccgcattggttccattgatcaaccaaggccacgtggtcgttgaaggaccttcgggtgatccacaagtcgaggccatgttgaaccacttggtcgcgcaggcctttgcttccgcaccgggcggacagatggttgtgacggtcttcgatccaaagatgaagtccacgttggccggctttcaggcacacggcgcctcgacggaggcaaagattttggttaacgtgcacccctctcaagacgccctcgaaaaaatcctgggtgaacatctcggctacatgatcgcagtgggtgcttctaccgccaagcaatacgccagtatgggcgacttggttgcctcaacaggtcaacacgaacatcagtaccataccctggtgattttggatgcgccggccttttggtcggaaagggctgcgaacgaccttcaaaggattgttgatcaaggcgcttcagccggaatttccgtgatccttcacagcgatcccactgaaccgagccctcgtgatatcgacctcggcaaggtcacagctggcgcagcgcatgtgcgcactgatcgaggtacttggacggtcgcaatccccggcgtcaaggtcatcccgaaatttatccccgccgccgggccctcgttggcggcacaacagcggcttatggagttagttgtcgcctcggctaaagagggagttctaccaaaagttccattttcagaacttgctgatggacaaccatggtgggtcgccgacggctcgccgcgaaccagcacgaacggtgtcaagatcactctggggcgcaaaggcaaccagacggtgtctttcaccttgggtgacacggtcagcaacctgcacaacgtgttggttggcggtcgggccggttccggtaagacggttctcctgaaggcgatgatctactcgatggcggcaaggtactcgcctgacgagctccgcctcttcctcctcgattacaaagaaggcgtcgagttccagcagtttattgctactcctgaagcgggcaatccgctgccgcatgctgatgttgtgtccatcgagagcgatgctcagtttggacttgcgacacttacgcatttcctgcaggagctaaaaagacggtccgaagagttcaagcggattggtaatgtccaaaatattgccgaataccgaaagcgcaccggtgcagtcatgccccgctgggtcctgcttatcgatgagttccaaggaatgttcgcaggacctggatacgtagacgcaacggctgcgctggaagatcttgtccgccgtggccgctcattcgggctccacgtggtgcttgccagccagaccctcagcggcatccgatttgacggtgacaaagacaaagccatctttgaaaatgtccctgccaggattgtcttgcaactcggtccagacgaagccaccaaattcctccagtcgggcaatgacggcgccatgcaactccgctaccgaggccaggcgatcctcaacacacagggcggcgctccaggcgacaaccaacagttcgtggttgcctttggtgatcaagagtacttcgacctacaagatgcactgtccgcagcagcgaaaggccttggcccagggtcaaagcggaagctccgggtctatcacggcgaccaatatgtctcggcccgcgagctggtcaccacgaatgatcgtccagatgaggttgaggaagaagcgctgccgatttggttcggccaggaaagcaccgttgctgcacccgcggcatgcgccgagctgtcgccgaccagcggaagcaacctgctggtcctaggaagccttgacgtccccgcagccattgccaccgtacaaacggccgtcctgagtgcggccgttgctgcaggaggcctgcgagttatcatcttcgactcaatgctgcggaagttccgcgaaatagctggcattgagcaatggttgaacaccctccaccgtctgggatgcaccgtcgaccgataccgggccggggacgaagagcagttcctcgaagaactcaagtccgcggcgaacggggaacagcgtgccatagctgtgctcctcggcccagaaaactcagacttcaaaaacgtcgcagagtacgactgggaacagttaatccgagagcttccccgcaggcagttaaacgtcatcgggcaatggagcgacctccgcgatatccctggagacgcgtacaaccttcgaaacgactacaagacaatactcttcgtcggaggtgatgagcagctgatcgagcaggcatccggcagatcccgccatgacattccaccgctcaagagggccaggacagtggtcttctccgcggcatcgtcgcagcaaggactcgcgaccgtggcaaccatcaggccactcgaccgggatgatctcgaagcatgggagtcattggcatgaagatcggtgagttgtatgacgcctatgccgcaatggagcagttgccggtggacgcaagggcggccgcagcaattgccgcaaagcagcgctccgacgcgctagcgcgggtcgacaaaagggcttcaaatgccaagcaaacggcagaggcggcaaaggctaagctgcaagcagagctacgcgccgaagcacaggcagcctcctcgaggggtgctataccaaagagcgggacagaagcatccggactgcagcccaatttcagtaaagtgcggtcgatacgccaaaaggttgatggcctgattgttgacaaaacgcgtgccgacaaggacctcaatcggtttcgctccgacctgcacgctttggagcaacagatcgaagacgaactcagagccaaaggagcatgggcacgcggacaacgagcggacgcgatcacctactgggtcggaggactgggtgtacttctatcgatcatctgtggacccgcactgttgggggttacgatcttggtcgtggttctagccatagttgcctgccgactttggggtccgtcagcgatgatgatgcgtgctacccagaagcgccctgcgctagggtcgcaccgcaagtctcgtctcggctacatcctcagctcctgtggctgggccggcatcgcttcgctaattcttaatctcatgctttccagggtcttgagcccacctggagctggcctcggctttgaagaatcaagcgggcagggtttggaccctctttgggtcgcgggcatgttgtgtgtaatcgcagcagtagttgtaggcaatcgtttacggcgaggaatgtgatgaccgcagatgacttggcgcgtgcgcttgcggatctcatgactcaagtgaatacaactaggggactcgttggtaacgagaaaagcttcactgagggaaaaaaacgaaaagtagactcgattgttggttccgcacatgggaccggcaacatccaacacctgcgagctacggctgtcgagtatcgaaaggcatccgaccaggctggtgtcgcgcatgattcactgagaatggcgacggacgccctcctggcatacttgtcggcaaatttccgccaaagcggtggcggcggtaacggatctgcagccgaatggtcagctatcaacccactaggctttgtacacacagagttgtccacgcgtgcgcaaaaaagggctgcaatcaagcatgctcttttcgttacagcaaaggcctctattgctgcagtcaaggtcgggacctttgccggcgctatccttgcaggagcgccattgctaactgcttttggccttgtcgctggcatcactgcagcaggtatagctctagaagccccggcactcgcagcttcgatgtacaaacacgtgcatgagttgagggaaaaatgggttaaaggttctatcacacgtgatgagatgaaaaaacaaattgtttcacgcgcaataagcgagggcagtgaattcggcgctggcaagatacctttgcttggagaaccaataggactagcgctggacatcaaaacgttagttaatcttgtcaaagatttacgagaggtaccatagtgacaaatgaaggtcccgatgaaattgagcaattggtcttgatggctattagcgctgtccagtcaggaaaccaggcggatatcttgactgcctttgaagctctggccccgcttgaaacgggagatgtcatatcagagttgtttttgtgggttgacgatctcacctcaggggtagctgaggactctctgttgcaggctgccgagttgcccgttccaccgcgtacaaccgaaatgttgaaggcggtgacggaccgggacttaggtgggctccaagctgcagtcggttccgaccaacttgagcaggttttcgcttcgctgttggtacttgtggcagcgttaagggatgctcgcagcagattatgaccgcctgctgcgaggtcgttggccaattgtccctaggagttgctgttgagtaaggtcctcccgagtcgcacccaagtccgagcgtggcacgacggccagcctcggggtgccggtggggcaggtccttgctgcaaggaggttcgacatgaaccaggactatgtcgattccgtctgcgtgacagggagctaatccttgtcacgttgtcggaaacgcaaaagatgaccgaccttataggccgccctcggcgaggggtgaggtgagcggcttgctgaacttcttttctgggtgctttttggacaggagtttccggttgaacttggtgacgccaacaagagttttgttcaggaagagcactgcagagtcgtcgttgtagacgatgtagtaccgggaaccgccgacgggccacgatttaaggctgtcaaattcggtagccctagccaacccagaacttagagcattcgcgtgggctaactggccgcggatctcctcagagacgtcgggcgtgactaagcttgcaatgagatcttcaacttgtggaattgtctgaacgcatcctttcagacgtccctgacatttaggagttccgccgctcctgattgcagttcggtcccgaggtagctgatcggacacatcagaccagcagcagcggtccctttctgatgacagcacagctaacggctaagaccttttgcgcctggttgccagacgcagcccgatctttcgggcctcagcgctggttcagcagcccgcccgcctaccaggctcacgccctgttccttggcctgcgcgagcaaccgctccgcaagcttcttctggtcgatgatgtctcccgtcacaggatcgatcatcacccccgtcatctcggtcgtggactctgacacggccgtctcctttcggatcgggccggacccacacaccgttattcagacagtcccttacagtcctgtgggcacccgtggtctgtccctgtcctggtgagtgagtgcaccggagggctggtcggtgcgtccctaggaacgagcgagagaccgccatgatcagctttggtttctgggctgccaggctcgaccatgaaggcttggagttaagagcggtgagtccaagataggaccgggtcttccgttgatactttcgttgttgtgatgggcattcgcgccccggtcgcccataggtgggttggtgtgtgggacggcacgggaagggcctgagggttatccagggtgagtttgcgcctcccggatggcaccgtggcttttctaatgaaggcacggcggtggcagtagatgagggctgcgcatcttgcctgccaggtattcagtatggcgatggccgcttcgtggatcttgtcgcggtcttcgatgagacgcacgacttcgatagcgagtgcatcttcgcgggtggccgttgcggcgttttccgagaggagtttgtctctatggcgcagcgattcctggccttgcggggtgttcgcttcttcagactttggcgggtgggagttgattttctgcaggacggattgcttgttctcctcgaaccggcgaatttgtgcttcgagtcggactatttcgttgtcgattggccgcagcgctgagatgagggaatcgtggattcgggcctcgacgtgatcaacgtgtgtttggaggtttcgggtgagcggatggtgaccggttgaatcgggaggggtggtgctggcgtctgtgcgtcctttccagctggtgagccagttttcgatcgtgacatcgagcccggagcgtttggcgaagtggggtgcgttgggtagttcttttgaggcgtgtttcttatcctctttcacggtttggctccttgtggctggcgggtggttttggggctgtccttgttaccggtgtgagcgtcagttcgtgacccagtagagatggcatgcagagcagatatatcccagacggcaggtggtgcagtttgcttgtttccagtcaccttcgcagttgctgcaaaggtggagatctcccgtgcaggcggggcagatgagtggcgcgggttgccgggtagggctgcgcgagatgaaccattcgcggattcttttaagcatgtgggcttcggccttctgcgctcggttcccattcggagggtacggtccactcggatccggggccgcgggtatcgtcggttgagctctcggtgggatttgccggggcgaaggcgggttccgggctgattttggtgcggatgatcccgtcgctttccacccgccagtggcttatgcggctgctggatgcgggttcgttcacccgggtgatgtagtcggagatgacttgtttggcgtaggtgctgtatcgctgggcgaaagcgtgggcgttgtcttggaggtgtgcggtgatggtcgggtcaccggtggcacgggccaccccgtggatgtagcagtgcaggccttccgcgatcatggggacgagggcgcggaggtaatgcttggtttgttcgggaattcggcggtaatcgtgttcagcgtctgctgcctgctggtgggtcaacagggtgattttttccaggaattggatttcttcggtgaggtttgactgctcgtgacggaggtgccgtagttcggtgatgagcggttgtttgttgtgaaggacttccatgaagatcagcagggccaggcagagtggtaaggcgacgttgaggacgatcagcatcgtcgaccccagcgggtccagatggactggtggcgggcctccggctatgacttggccggtctgctgggctgcggtgagtgcggtttcgacggcgtctttcatgtaggtgtagcggatccaggcgaacccggcgacgacgagggcgaggaatccgagagccgcccaggcgattgcttttccgatggtgtgcttgcccttggccaggagcgctggagcggcttggagggggatggcaaccgtgatgaaggtgaccagtccggccaggagccaggttttccattcttcttcgcccaagatgtatccggccaggacgttgactgcgaactctccgatagcaccgaggattacatatatcagtagtttgatgttccagggacgggtggtccgaggtttgccctggtccgggctggccggggttgtttggaggaggatgtttgggacatagccctctttggtgggatcggtcatgtccccgagccgcccggtgacttggttgtcgacagcagttccggcagtgcgcaccttttcgaggcgggcggctgcgtgagttgcttcggcgcgtgcacggctgaccaggtgcatggcggcccgctcgtctttccactgtcggatgagggcgccctcggcgtacttttccagccagagctggatcttgtgttcgaagagaagcggccggtcggggtgaaatgagtgtttgtcgtagagtcctttagcggcgtcttggacgccttcctgctcgcaggcgtcgttgatctgagcctgcgtggcgcggtcgtcgatgtccgggccctggacgagattcagtgtgtccaggtcggggtcccgtgggtgcgtgggggccatgttgtactccttgcctattgggcgggggtttcttgttgggctgttgaggtaatgagaaccttgcggttcagtgcggcgttttccgtcagaaggccgttggcgttgaggtctgagattcttcccgggcagtgtggcccgtagccttcgacatggagggcggacgttgcgccaagttcccgcaggagcttggcggttgcttcggccctggcccgggacacggtcttcatgttggcggcggtggcggccggatccagggcagtgcagccggtgatccagatatgcgggtgatcgtttatgttcagcgccggtgcgatggcagccagagctgccttggccttctccacatctgcgaacgatgccacattctcctggaagtgaagccgtgtttcgggcagggtaagcgagagaggttcgactggtgtgtcggtaaaatcgaccggcgtgacgtgcgggagttgcggtgaggccgggtcgccgggtgtgagctgttcgtgattgaaaaccaccgttcctccgcctgcagtgatgacagcttcccagagttgttgaagcttggtgcgcgcccagatgggaagggcgggttggggagcggtgacctggccgaggccccaccagatgaaacgggttccgttgaagtgtggttggttacccgaagcttccagttggcggatgaggctgttgacgtccgttttggaagacaggagaccggtctggagcgcgagcggcccggtggtggaaacgccgctgtccacgatgaacacggtttttccagcacgaccggcgacatcaattgccgccagggtgttggtttcggtgacagaggcgcgggcggaagctatcaggccagccgcggacgatacgtttgaggcgatcgagtcggatctggtcttggggttcttgtcgatgactgtcagggtggcggactgcgaagctgcaggtactccatcggcagggattacggtgacggtggcgttggaggagagcttttcgtggaggctgttcccgagggagggaaggttcagtacttgctggttttgcccgctgctctcccggcttgagaaaagcgccggttggttctggcgggcgccggcgacgatggcgagcgtatccgtggaggagtcaggattgactgttgcggccggggagggaactccgctgcaaccggtgagcgtgaggatgaggacgaaaacggcagtgatgccggcgcgtaggtggataacggagggcatgagtcacttctttcgaatcggattaggatgccgccggatggcggaccggatcccggtccgccatccggcggtgtgcttagttgaaccagaactggccgtgcttgccgcccgtatcgcacacgtagccgctgttgcggcagtgcttgcattgcttcccgttggctttgcagtagctgcattcgctgagcagcgagtggcacttcgtgcatttcttaccgaatttattccccatttttgcttctcctggttggtggccatttttatgggacgttgactactaccggtcagtgcgggctgttgtgacagcctgcactgaccaagggtgctgatgcaggtgttagggctgtgaggtcaggtgccatgccttgcagtggggacactgatagctgcgggtctcgcggcggtggtccgccagaattccgtcccgcttgtccagtgctatgttgcgcagcatgaaatcggccgcgatccggtcccggaactggcgctttccggtgacgaggcaggttgtccacagatttacgtcgaagcgttcccgggttcctgaccggtagggcctgaagctggtggtcgacatcatttcctcctgcatgaagtggtgcagttagtaccggcagaggggtggtctgcgtgacaggaaaaaatagtttccggaatctgtcacgacctccgtccaagggcggtagtaggagatggttgggcgctgtgagcacggactgatcccactccctcgatgaggggactgtggagttcaagccctaggcacaggacttttgtgcgcctagccgtacaagaagtgacgccgcggaactacagcaccggcgatcgcggtataaaccaggaaaggaggacattcttgaaacgagcagcgtgtacgggtgcgccgcatggtgtcatgttgaaagtttttcctgatctccagtccctttgccaatgtcatgatgcagaattcaacgcacatgcgataagaaaaagggggagtgcggtggaacaggaaccgctcgatccggctaaagagccggtggtgacgacggcagccgatgaagctgatcaggacggacttcagggcaaccaggacggccatcgtgccaaagcggcagcactcgagtacgaacaggccgggcggaacccggtcttcgaacactttctcgatgagcaataccgcaacatcaatgggaagctgatcggtaagctgtccaaggaaatgggctacgacgctgcctgcgaagtagcggctgaaacctggacaaaggcatgccgttccatccaccgctttgacccaaacaaagggtcattcaacggctggctctggcggattgcggataattgcaggattaactattggcaaaaattccaccgacagcaacgcaatgagctcggcgatgacatctccgacgtctgggatgaatccccccgcgacggcttcttccactactcacccaacccggagaccatagccgttcgtgaggatctggaagtaacgctaagcgagttgggtgattatctaaggctagaccgcacccagcaagaaatactcaccttcctcctctattctcccgagggcgaggactcggctgtatcagagtccgaccggcagcgtcacagtcggctgaggaaaaaagtcgaaaagctgacgggcctggacccggaggaaaaagaagcagttcggcttgtgcgccgccaccggagctaccggaacgtcctctccgtcgaagctctgaatcaggagcagttcaaaaaaacgtatcgccgggcgtgcgagaaactgctcagacttcttactaaggaaatagaaggaaacgaactcctatgactgacttcccagccgcatcggcagttatcgaagtaaggccggtagaaacagccgattccaacccgctgcacatgattctcgcccgcaaggtatggatcgatcacccccgcatcctgttctcctatgacgcgactgaagacaccctgatcctccgggtggtggaactgcccagcatctattcgatgtcttccgaggaatccgtgttcgtcggctttgattcactcggcgaagccgcttggcccacgaccatcgccatcagctcggcgtcccgtacattcttcgaaaacaaccatgagctggccgtcgtcagggagctcattggcgaagcagtctacgaggccgtgaaaccagtactgacatccggagagtcccgatcttctaccgtggatctgacagctgagcaggggcgagcactgcacacgcggtggaacggcacgaccacagtgcctgaggcaaccactgctgaagaaatgaccgacgatattctcgaaacagtcctgctgtcctgggccgttgaactggctccggcgctcctccgtgacagcactaccttcgacactatcgactctaccgagctgcccgatacgatccgacgatcagccgcagtagcggatgaaggtctattccagctcatcgtgggacgcaaacgccggaccatcgagccatggccggtcgcccgtctcgacctcgaccgcaaaggtgaagattacctcgtgtccgtggtcgtccctctgccgcaggaaccgccgacaggcatcaccatatcggcgaatgtcaccataaacggacaagtctggagcatctcgcttgaaaaagaccaggctcaggacagagctttgtcgcggaaactggtcggttgccgactcattcccgccgacgccctcatcgctcatcaggcgaaacagaccactatgagactgcaaatcaaggcgatcccgagggagcaggcatgactactcaagcacaggaatgggcgcacttcctcatcaaaatcaaaacgctggaggacccggaacagaagcttaaccgccttgtggaaacgtgcctggcctacacccaagtcaccagagcccatgccttcggcgcacggtcgggtggttgccctgcgggcagaccaacacgggaaaccgtgagggaagcgggcagcgtcctgacggcacttaccgaaaactcgtcggatccgtccgacattgctggccacatcattgggagcatatcgtcaaacatcatgcccgaatggacgggcgatccctccaatccggggctggaaatggatcgggcaatcgcagcgggcttggcggcaatcgacacagctgaatccatcggggacaacgatctgcgtgcatgggcgctctctgaagtttcggcgttagcgcgacgcggaggtgattttcgaggcgcgcttcagctggctgaaagggctcgaaaagcggccttcgccgctttggaatcagcatcagggccttggtctcttatggctgcagcaggtgaaccggagtggatggaagagggagatgtctaccgtcactccattgccgtcgtcatctccaaacaggtcggaatgaacagttccacgttgggcgactacacgaaatggaaggaagccctcgaggaccggcacaagatggcagcagtgatacgttccgaacgtcccgtccactacgcgcagtcttttgccggattcgctgcgttcgcaaggtctgtcggtgaccggcgcgcaatcctccgaagcgaaaaggaactcgaagacttcatcggccacgatgggccgaataatctaaagcgcgttttgctcgcctgcaaagctgccagtgcccaagtaatgcgggactggacagccatgtatgttctaaaccaggaacggctgcaatccgtgctcttggcagtcaaagagcaaacgactgaggcgggcttaccggatccaggatcggacgttgaccatgttctcgaattcctgaaaggccgtggagagcgcgcactgtcggcagggctcggcaacgcctgcttgggtcaagcaactgctctgtataggagaggcgataccagaaccagccaggaagcgtatgccgaggccttacatctgttggacgttgctaacaaggcatacgagggatacggcagcaacggcttcgcgtcgacacaacttactcgtacaaggatcctccaggcggcgccggggggcgacggcatatcagccgccgccgctgtcgcggcgtacctacgacttagtcgtgttgggctggaagccggtgtccgcaggaactccgtattggacgccgctgcaattgctgtccccggggacccggcagtaatcgagaggatccgcgagttgcgggcggagactcaagtagctcatcccaaactacaagcggtcgaggcgctctggttttaccggggtgcggcagcggaactacctggttttgactgggcggaagcggagagactgacagtaggggcagcggaggcacttgtcgttaaagagcgcccggttgacccgttactcgcggtagattgctggctcgctgccatcgaggcacatgaacatattcacggtgaaaccggactggacgttcgtcttccgcgaatgatgcgcgccgtctcgtcgcttgccatgcatctcgtgacggtaacttatgcctctgagcgggcccgcgccgcccagcaatattctaaggttttcgttgctgccgctgatgccgccgcaagtctgggggactctacttccgctgaaataattatggaagcggcaagacgggaccgagttggaatcctgctcggcgagctttcccgaaatccgcaggtgcacgacaccatccgtctggcagcccagcaacttgtcgtcgctaacgcggcagtcccggatatccccgatgacattggcgcgcgctcgttccagcaatggaccacgcggtcggtcgtggatataaaaacaaaccaggcaacagctgcagccgaagctggaaaggtgatcgggccggcatcgactctggccgatttcaacgagtttcccaaaatccgctccggtcacatcgccgatgaaaccattgaccaggaacgaccgggggtggtcctgcaactgttcagacccagcgttggaacggaaagtgacgggcaaacactgtactgggttctcactgtctccgcggcaaagggaaagagtgaatcacactgcggaaaaaccaggttgcccatggatccggacaaccttccgcctgcgaatgaccctaccttctggaccgagctctaccagctctcggaatacctacttccccgccccctgcgggagcttctgattgatatgcacagtcatgggccggtgacactgaccatcgttccgacagggttgctcaacgttccctttgattcccttgctgtggacgaggaaggagggctgatgctcatcgactgcgccacggtaatcctcaccggatccctcgccgtaacccactcgataggtgttagtgaatcggaggggcccactggatcatggctcggtgtctacgatacgaatcgactcgtgtacgccaagaaggaaaaagcagcaatgctgcgtagccatacggcggtggccaccgcggaatcagccgatgaactgcacaccaccttcggcgccagggccgaaggtggtgtggacgtccttaccttggccgttcacggatcggctgacacttccggttggggacaggccaaactcatgcctgacggatcgattcttcgagcagtcgacgtccttcggtggaacgccccgcaatactgcgtgctctcctcctgccattcttccctagcggcgaatgaaagcacggagctcagcggatttcccattgcattgattctccgcggtgcaagcaccgtgattggttccctgcatgaaattgatgacgcttcgacagcggagatcatgtcggattattgggccagagtaggcggacgaacacgtgcagcgaaagcattggctgaagcaaagcgcggctggcttgcacagcacccggaaagcaagggccaaccctggctatgggccgggctggtcgcctacggtcggccctaaagctcagagcgagaggtgttgtccacccgccgccaaagcttgggcggtccggcatttacagacgatgttttgatcaacctgcgcgaaaagaggcgaaggcccctgggaagcaggccgtcacaagtttcccaacactccggtaatagaccatgtacgcatccgatgccgacatctctggaaggagatacgcacatgggactattggacaggatcttcggatcttcaagccaacaatttccgggaaatccacccacccgaagccagaaaacggaagacgccttcgagaaaaggcgcatattccgctcaccgtacgatccgtcaacgatcgcgcaactaatcacagcgacatacgatctagaggttctccccgaagcgcccatcatcgagactgtttactacagcgagaaaaccgagaaccgcatcgtcttcaccggcggcaaccggttaaccacgcactggaacatcatcatggaagtggaaccagaaggaactggcacgaggggtactctgtacgtcgaccggcccaaatccgatgtcaacaaatggctgggaaacgtcattcagatcattccgaaccttcatatgaccctagcctcagccggcactacgttcgagaactgggacgcgaccgacatcttccgctgacccttcaggcaacaaagttcgaggccggccaagcgggaccacgaacaggttagacagcagctgcgccgcttggcacggcccacaccggcgcagctgcttataccaatgcggggacaaccttccgcctaaacactaaacgtttatacggtcgaacgtaagcgccggattggggctgggagagggctgcggccggcgcgcctgtccggtttgaatcaaagactctgcagcgggacatgtgcaggagctgccttccgaccctactctgacggtctttaccttgctgcctgacgtcaggttggggtgtagcttttctgacatctcgtgtgatcttccagttagagggagcaaacaacttcccagaaggttctgtatggaaaagggattgcggagccctgcagtctgacccacgttaggaagcgaccacagcagggacatgcggaaccggcccgccggctgttcacacgtaacttgctgtacgtcgccgttgatggggcggttgagttgccaggggttaggttttcgagacgtataggacgaagtagcgggcgatggcccccggtgagtgtcgcgagggccatcgtctcgagtcagcttgccgcgcgggccttcgtgtcgtcgtatgtcgggtagtcggtgtaaccgaccgtcccctcggcgtagagcgtcgagaagtcgagctcgttctcctcgagttcctcgcgccagcggcgaacgaggtcggggttcgcgatgacggcgcgccccaccacgaccgcgtcggtcagggagccagccatcatggcgaccgcttcgccgcgggtggtgggttcagcgaacccggtattcacgaggaatggaccgccgaatcgactacggagtccttgcaccagggcgccggcgggttctgggtgcaggacgctgacgaacgccagcccgagcggggcgagggcgtccatgaggccaccgtagaccgcttcgacgtctaccgggtcatcctcgatcaggccttgaatgttgcgttccggcgagatgcggagtccaacgcggccagcgccgagctgggcgacgacggcccggacgacctcgacgacgaaccggatgcggttctccggcgttccgccgtaggcgtcggtgcgcatgttcgaggtggtgccgaggaactcgtgcagcaggtacccgttggcggcatgcagttcaacgccgtcgaagccggcgtccacggcattctgggagctgcgcacgaaggtttcgacgatttcggggagctcgtcggtctcgagtgcacgcggaagagggtaggccaccttagttccgcctgcacgggtctcgccgtcgatggcgagtgcgctcggtgcttcgacggggaacccggagatgtcggggtgggtggcgcgtccggcgtgcatgacctgggcgacgatcagtcccccctccgcgtgcaccgcgtcggtgaccttccgccagccagcgagctgtgcgggggtgacgaggccgggctggccgtcgaaagccttcccggggaggctttggaaggtgccctcgctgatgatgaggccgacgcttgcccgctgggcgtagtgttcggccatgatttcagtgggtactccgtcagcgcctgcgcgcgagcgggtcagaggtgccatgacgatgcgattggccagggacaggtcaccggcgaggagaggggagaagaggtctgtcacgttgaatccgttcgttgaattgttgttgggaggatgatcgccgtcgagcatcactttcgtgaactcggcggtggttgtcttggtccggcccgcctactcgtccatgggggtgcgtgacgtcagtccgtcaaattctcggtcgcccactgtcgcagtgagatcgaggggcgaccggtgacgaactccacgtcgtcgcggactgttccgatgtaacccatccggccgtcgatgacctgccggttgaactccacgcccgcgtcggcataccaggactccaccgtgatgttgcggtctgcgatcgatgctttgaagtcctccggaccgcggacgttgcaacggatctctcgacccaggacatcggaaaagatggttgctgcttcggggcctgaggctacttcggtcgacagccagtactccttgccgccgtgcctggctggcccctgcttcagcaccgtcgcggcgaccgcggcgatgtcgcgcgccgcgatccatccgacgcggcgatcatcccagtagacggaaaaggcatcgtcgccggccgcaatctccgaagccaacccgtccatgaacacgttggggtgcaggtgcgtccacttcaggccgcttccttcgatgtagcgttcgatcatctggtgccagacgaagtgcgggtcggtgacatcccaattggcgaacaccccctggtgcacgatgtggctgacacctgctttgacggcggcgtcgaccagagtcttgctttgggccagcatggcgacggtgtagccggtgaggagatagacccggtccacgccgtgcagtgcgtgggcgaaggtgctcgggtcgtccaggtcgaggagcaccgcgtcccgtcctgctgcgcgtagttcctccacttgctcgggtttacgcgcggcgtagcggacccgaacattcccagtgtcgtggtcgaactcgtcgacgatgagcctgccgacctggccggtcgttccgatgacgagcacgatagggtgcgtcgaatcgagctctgcagcatgagttgtcacggtgtcatttctcttttcctattgcgttctgttgatccacgatttgagcagccctccggccacagcacatcgggtgagccgctggcgatagccggtcgttggctcgtcgtggtccgtggttcagtcaggcctaattcagtcccggttcagtcctcggttgtggtgtgcgtgtgccgtggaaggaataccgtggcgatgagggcgatgactgccaggccggtgccgacggtgaaggcagcgcgtgcaccatcggcgatggaggtcgcgtcggtacctccggcgttcgagctgaagaccgcgatgagtactgccaggccggcggcgccgccgagctgctggatggtgttcagtgcggcgctgccatgcgagacgagtgcgctgggcagggatcccagcgacatggtgaagagagcgacccaggcgaatgcttgtccggcgcagatgaacacgtacgtggccaggaccacccacatcgaggtgttctcggtgaaggtcgtcatgaaccaccagccgacaccgacaaccaccgctcccggaatggcgagcccgcgggctccgatgcggtcgtagtaacggccgacgaggagggacacgatgccgatcgtcgcgccgccgggcaccatgagcagtccggtctccaacgaaccgagtccaagggactcctgcatgaccagggggagcagggtggcgagagcgaaggcacccatgaccaggaacgtgaaaacgatgacgggtcgcgcgaacccgacgtaggtgaagatccgcatgtccaggacggccgcgtcgcggcgctgcagccggagctgacgcaccacgaatgctgcgatacccgctacaccaagcgagatggcggcccagaacgatgctgagaagtgcccatcactggattccccggcactggccatcccgtacaccaacgcgccgaacccgatcgcggagagcaccagcgacagcatgtcgaatccgacgcgcctcggcgtggtcaggttcggcatcttgatcgccccgatgagcaggccaaggatcgacaacggcaggatgatgatgaacagccaccgccaggtcagctgcgacatcacgaggccggagaacgcgggaccgagggcgggcgcgacggcagacaccgccgtgactaacgccatcatctgtccacgacgagacggcgcgacgagacctatcgacgtcgtcatcagcagcggaaccagtaccgccgtacccagtgcctgcacgatccggccggtgagcagcagcgcgaagccgggtgcgacagctgcgatcagggtgccgagagtgaacaatccgacgctgacgatgaagatcgtccgaagctgaaaccgctgcatgatgtacccggtggtcgggatgatgaccgccagggtgagggcgtagccggtggtcagccattgcccggtcgtagccgtgatgttcaggtcgtccatgatctgcggcagcgccacgccgacgaccatctcggacaggaacgccacgaacgccgagaagaccaggacggagatcgtcagaacctcccccggcgacaaccgcttcgtcggtgccgggctggtcgcgatcgggtggggggtcgctccttgagggtcggcaatcatgccgatgggccctgttgcgggggcgaggtgcgtgtcattactcatgagatgttggttccagtgctcggtagttacgccagtttcgggggtttgactgccccgaggattacggcgccgagtatggaggcgaggccgccgaggaccagggctgtctgtacgccggcgccgtcgacgaggagccccccaaggaatgcgccgagggcgatcgcgacctggaacacgcctgtctgcagtccgccgatgctttccaggcggctcggttcggctcgtgcgagccacgtcgagatgacagtgggcagggcaccgaagccggctccccagagtgcggctgcgacgaagagcaaaacgggactgctgcccatgtacacgaaggcgatcattgccaggccaaggacgagcgggaagatcagtgccgcggtgcgcagggtgcggtcggcgagaggtccggcgatcaggttgccgcccacgatgccgaggccgtacaccaggagcaggactgcgagctgttcgggatcgagtccgccgacctcggtcgctgcgggacggatgtaggtgaagccggcgaagtgaccggcgcccatcagagccatggtgaacaggcagaggagcaccatgcgggagcgcagtgtctgtaccaggggccggaatccgcttgaggggccggtcagcattgaaggcagggcgaggaattggatgatgatggcgatgatgccgacgccggcggccagtgcgaacaccgcacgccagccccagatctcgccgagcagcgtgccgagcgggacagcggcgacggtagccagtgtcacgcccacgttcacgatcgtcagacccagaccgagtttcgatgccgggaccaggcgcgctgtgatggagattgccagcgcccagaacccgccgattgcgatgccgagcaggacccgggcggccaggaggattgggtaggtcggcgcgatcgccaccagcacgtcggataggacggccagcgccgagaggatgatcatcaggtgccggcggtccatgcgtgagagcacgacggggatggtgatgccggagatggctgcgacgatggcggtgatggcgacggactgaccggccaccccctctgtcactcccaggtctgcggcaactcgggaaagaaggctcgccggtaggaattcggccatcacgagggcgaagacgcccacgctcagcgaggccacgcccgcccatgatggtttttgcgtccgccctgcactattggaccgtgatccgttagcgccggtctcttgtgttgctgttgcttcgtgagaagtcattcgtcagtcatcctggcttgcttgtgagcgcgcatcggtagatgcgcgccggtgagtgcgtgggtctgtgggtaggtgcgtgggggcgtgtgggtggaagctgtggggccgcagcgtcagctgtagcaggcacggttgatcgcgacgaggaacttgccgtccggccttccgccggcggcgatgtacccgccgatggcgtccatggccaggtcccggcgctgcgggacgcgttccttctcggcggctgccaggaaggcaggcatctgctcgcgcgtgcgatcggtgcagtagacgggggcgccgggctgttggcgccaggactcggcaaggactccggcgtcgacagcgtcgaatccggtttgctcgacgagggacatcgcgaggttccggtgatcatcgtcatcggaagccaccggaatagcgacccggcctgcagtgccagccccggtggccttggcgtcgaacgactgggacgtgatggcgttccaggccttggtgacggggcggccgaagagctcggacaaccagatgctctcgggttgtccctcaacaatggccgggacgatgccgtcgcgggccgggtagtagttggacgtgtcgatcaggacggcggcctcgggtgcgcgctggacatgggcggcgatgtcctcgttgcggttcatcgggaccgagacgatgaggacgtcgacgtcagccgccgcttcggaagccgtgacggctcgcgcgccggtgctcaaggctgcggcagcgatggtctcggggccgcgggagttcgcgatcgtcacgtcgtgtccgtggcggctgagccgtcgagcgatggtcgagccgatcgagcccgcgccgatgattccgatcttcatgtctctcctagtgcgatgtctgtcctctcatcatcaaccttgccattagtgtgaaggtcaaatcgggaagggaaccacgccggatatcgaggtcgtaagtgcgtgcaaagccacgtttcgctagcgaagggtccggtatcggccttggaagtacagcaagggatcagggtgctcgccaggggatgccccgagttcgattacccgtccgagcacgatgaggtgatcgcctgcgtcgtgttcggcccagatcgtgcagtcgagccaggccaggctcctctcaaggatcgggtttccccgtgccgtggggctccactggatgctggcccatttatcggtgcctcgtcgcgcgaactgattcgatattgcttcctgctcgcgggcgagaacattgaccgtgaaggtcccggtgtcgcggatcctcgggtaggtggtggaggtcttcatgacgctgaaggacacgagcggcgggtcgacggagacactgtagaacgattggcaggtgaaacctatcggaccctggtcatcgtggccggtgagaatcgtgatgcctgaggcgtagcggccgacggtactgcggaaaaaactctgatcgatgatgtggctttggctacgggtgtcggcggttgtcgtcactcggcggggttcgcgagccgggtgtccaggccatactgggctggggcgccgaggtggtcacggagggtggtgccttcgtagtcgtcgtggaagagaccgcgttcctggagcaggggaacgacgtcgtcgacgaaggtgtcgatcccgtcctcgtagacatcaatggatacccagaagccgtcgcaggcgcctgcttcgaaccattcctgcatgtgatccgcggtgaccgatgccgggcctacgggggtggggtggtagtcgatgaccccgtgggcgaggatgtcgcggagcgtccatccttcgcgggcgacctcgagcgctttgggggagcggggatcgaagggactgggtcgggccattgccagctgggcgggcctgagtggttcgtcgatctggctcgcatccagcgtcagtcccagcatggagccgagatagggcaccagggccggagcagcttggtctccgagagtgacgcggcgatccagcgccgcccgtttggtcgcagcgatggccggcatgacaccggcaatgaacttcacctcgtcagggttgcgacctgccttgcacgcagcatcgcggacagcttcacgctgggcgcgcgcgtcctcgatagtgaacgcggcgccaatgacggcgcttgcgtaccggccggcgatctcaaggccattcgcccctccgccggccgagaacaccacgggttggccctgctctgagggcggaatgggcagcggcccgcgggaagctacatacctgccctgcaggttgatggcctcgatcttctccggatcgacgaaccgggcgttcgctgtgtccctgatccaggcatcctgctgccagctaccccagagagcctgcgtgatctgaatggtctcgtgcgcccgctggtagcgctgcggtcggggcgcgatctcctgcccgaagttcgcggccgagccgggatcgctcgtcgtcacggcgttccacccggcccggccatggctcatcacgtccagcgccttgaactggcgggcaagattgtagggctcgttgaaggtagtggagccagtcgcgacgagaccgatgcgctcagtcgcacgggcgatggccgccagggtcagcatgggttccagggtgagcatcggagcttcctgcacaccgtctgctttataagccaggaaatcaggcaagaacaggaacgcgaacttgccccgttcggccgcctgggcgtaccgcacctgcgcgtcgaagtcagtgtaattggccgggttgacgcccgcggcgcgccaggccgatccgtgggcgccgtacccattaccgagctgcaggccgaggatcattgtcgaagaggaggaagaagtcacctacccatggtgcaaccttctcactagtggcaaggtcaaatcgtgaccctgctgctacgccggctgtcgttcgcgagtgccgtgcctgctcccggcggtctccagtgcctggatgtagcgggtgatggcgtctcggttctgcgaaaggacgtcgatcttgtgggtcatccggtcccgctcctgccgcaggatttccaggagttcggggtcagcgtcgtcgacgacgactctttgcggctggttcaggcacggcaggatgttgccgatgatcctggtcgggatgcccgagtcgatgagcccgcggattttcgccacgcggtccaccaggtattcgtcgtactcccggtaaccgttgtcgaggcggcgcggagtcaccaggccctgctcctcgtagtaccggagcatccgagccggcacgccggacctctgttccaattcgcctatacgcatgcccgctccttctagtgactcgaaccgcatcaaccttcacataagtgtaaagccagcacggtaaaatacccggatcggatcccgaagcagtatggctgacgcaacaccgaccctgactcatatcgaccaacggttccgccattacccccagctctacagccgtctcggttttctcactgctaccgcccgctcggccgcgacgagcgcatctaagcagccgccggcaccctcgttataggtaactaacgacaaagagcgccaccagaacacagacaaagagctccgaagtccacaggtcaggaccccgggtgttccgttgtcagactggggtgtacttcaacatgacttaagaagaacaaaagcttgccgtatcagcgttaggaccggttggggtccagctttagaattccggaagcatcaaggtggctagtccttcaagtccctctgaagtttggggatccggagggtgatcagcgtgccttcgcctggcgcagtgtcgataatgaggtggaattcgtcgccgaatgcccgccgcatcctggtgtccacgttgctcaagcccacgtggtgaccgtcgaggtttccagcgagggcggccctgagccggtccgggtccatcccggcgccgtcgtcctctatggtcacgacagtgagggcgccttcctcgtgtgccttgatttggatgtgaccgtcgccttcggctgactcgacgccatggcggatggcgttctcaaccagtggctggaggctgagatagggaatcctcgcagagagggactccggactgatctggagtgtcactttgagtctggatccatacctcgcctcctgcaaaaggacgtagctctcgatggccctgagctcgtcggctagtgaggtgaagcgcccggccttccggaaggagtatctggtgaagttggcaaactcgatcaccagcttccgcgcacggactgaatccgtggcgatgaacgttgctatgacgttgagcgcgttgtagataaagtgcgggctgatctgcgcccggagcgagtccacctcagcttcttcgagcagcgcccgcgcatgcttcagttcccgcaggctcagttgagcctccatgagtcggcacatgtcactaagtgcccgtacctggttgttgctcaggctggtgcccagtgcgcagagggttccaaccggccggccctccactcggatgccgatcgttgcataggatttttgtgggcaataggggtcgctgcaactggccccgtcgcccgggttgccgcggtgacggtgcacctggttgcgctctatggccaattgccgttccgcgatggcgcgtacacactcgaattcgtcggcccctacaccatgggctcccacgatgccgtccagatccgcgacggcaacggcatccagctgcagcagcccggcaaggcgggccgccaaccggtcggatttcccgggctcaaaggcggctcggaagtagggaagcaggctcgaaatcgagttaagtgggggcggcgcgaagccttccgacgcgtgccgggctgcccgccgcttgaccaacaggaagacggccgttccagccaggccgagcaccaggaagccgagcatggccaacacgagacccccggggccatcatttaggtccatgtgttgtcccgctttcggtgacttttagccggtagttcaaagtccgggcggtggatttgccgcatgaaccgttcaacccgtgcgggattcgtgggcttgcttgtgagtgaaacggcgatcatgatcgcgaaggacgtcggcacagcccacgctgccggttgtgccagcagatccgagaccggcccggcggtgcttcccatgattgtgtggatcaccagcgccgtcaccacgagcgaaccgccggagatcatccctgcagcggcgcctgacggggttaggcggggccaccagattccaagaatgagcatgggaacaatggtggcggccgagaaggcgaagatcagtgccacggtttcgaccagtgacaccgatgatgtaaacagcgacaccgccagggtgctggcggaggagatgatggcagcccactgaaacccggcaacatctgagtggaaaaattcctggcttacaaccgcggccaaagccacgatcaatcctgaggttgtggccaggaaggcgctgaaggccccggcggcgaccacggccgaaagcgcggcgcccggcaccccgtccagcagaagatccggcaacagcagcaccaaggcatcggcttctccttgccggacagccggcatgaatgcccgccccagtaccccgtagctcatcggcagcaggtaaaacccagccaccaaacacgggacgatagttccggttctccgggccgagccgccgtccggacttgtataaaagcgggccaaaacatgcgggagacctattgttccgagtatcagggccatcagaagggatacggtgcggtacgggcttgcctcagccgaatcgcccggcagacgctcaaaggccatgctcaccgctgcaaggccattttctcgtcccatcagcgcaaaggccatgaacgccaaggggaacgccatggcagcgactttgaaccagaactgaatggcctgcacaaaggtaatggatcgcattcctccggtcaccactgtcaggcagaccacggcggccacggccgcggatccggtccagggcggcagccctgccgccacttcaaccgtcagggcagcgccgtgcagctgcgggaccacgtaagtgccgcagatcataatcgacacaatcgcggtaacccgcctcactgccaacgagccgaacctcgcctgggcaaaatccggaagggtgtaagcattggaacggcggagcggcgcagccacaaacatgaggagcaacaggaaaccggcggtgtatccgagcgggataagcaaagcgttccggccggccactgcgatcaggcccgcgacgccgaggtagctggccgaggccaggtactcgcccccgattgcagaggcgttccaccacggccttgcagccctggaggcgacgtagaaatcgctggtggtacgtgagaacttccggctgtagacgccgatcaggatggtcagcgccaggatcacgagcaagcccaggagcccggcaacgttattcaacgaaagccatcaccgttgtgcccgcacacgcgtgcgctccagcagaccacggaccaacggcaaacttcgccggctcacaggaagttcagcacctcccacccacacgctccccttggcagtgccgagtctcatgttctggatgtgccggacggaaacgagataggaccgatggatgcggagaaaatctgcgtcagaccattggcgctcaagttcggccatggcgacccgcatcaggaacgaagcgtccgccgtgtgaagccggatgtagtcgccccgggcttcggcataaagtatgtcctcccgcttgatcaggcggctggttcccagatgttccacggtaaccatcggtggggcgttgacgggatcctcgcggccctcgcagagccggcggacggactccacgagcctggcatcatctacaggtttcagcaggtagtccgatgccttcaagtcaaaggcctcaagggccttcgtttcatccgctgtcacgaagacaacggccggcgggttagcaaaacggttgatcatcctggcaatgtcaatgccggacaacgatggcatgtggatatcgagaaagacagcgtcaattgcgtgctgttccagggcgtgaatggcttctattccgctgcccgccgcgtagatctgtgcgatgcgcgggtcttcccgcagcatgcgcaccaggccctcgagagccggaagttcgtcatctgtgacgaggacattgagtcgtcttgccatcattccattctagattgaagcggaattgctccggccttactggattccgagggtgccatgagaaattcatacatccagcgccagggggaggctgcttcgaaggccgcactcgctgccatgacgtccaggtccgcattccggcggcccatgatctgcatgcccacgggaaaaccgccggacatgccggcagggacggaagcgctggggtgccctacaaagttcgtcaggtaggtcatgcaccacccgatgagcgggtcaatggcctctccgttgatctgtgacggcccttcggtgaagccgtcgccgctgttttccaccggcatacatgcaagggtcggggagatgatgaaatcaaactcctcaaaggcggccgcaaatttctcgaagaccaccgagcggacggtctggtccgcgatgagctgccgggtggacatggatctggccgcgtccacccagtgcatcattttggccggcaattcatccgggcacatttgctcgacatctgttcctgacgccttcagtccgtccagggcggccatagttcccagggctgtaatccggctccagacatcgctcaagtgtccttgcgtgtagggaaggccgacgtcgacgaagtcgacctgcgcgccgagtgcctcgaagatccggacggcgcgggaaacagcatccgccacctcgcgctcgaccggaaagatcccgaaatccttcgtgaacccgatgcgcttccctctgacaccggcactgagggctcctctgaagtccacctttccggtcagggccagtggatccgcccggtcaaagccctgcagaacgtccatgacgagggcggaatcggcgaccgtccgcgtaatcggcccttcgaagaaatacatgctggggccaaagacgttggggctggagggaaatggcgcccttccgggcgaaggctgaaatccgaacgtcccgcaccatgcggacggaattcggatggatcctcccacatccgtggcgccggcgacgggcacgatgccggctgcgacggcagcggcgctcccaccggaagatccgccagcgttgaatccgtgattgaaggggttgcgggtgggtccaaaggccttgctgtcagtagttccccgaaacccgaaaactgcgctgttagtggtgccgacgaggatgccatcggcctcttcgaaccgtcgggggtagttggtggatctcgtggcgatccggtcccgcagcacgctcagcccactcgacgtcggccagcccttcttcgcgctgaaggtgtctttggtcagggtggggatgcctgccagcgcaccgacttcctctcccgcaacgatccggtcttcaaggtgtcgcgcccgttccctggcatcctggaaccctttgaagacgacggcattgatcgcgggatccctctcctggattcttcggatggcggcttcaacggtttccctcggcgagatttccttgctcttcaccagcgacgttatctgcagggccgagagctggtccaggtcttcagctgcgttgttcatcattgaatcctttctagtgatccagggctttttcggctcccgcgccagtcagtgagcgcacttccatttccgcggccttgtggggatcctcgcggttcttgtccgtaacggaccccagccagccgaggaagaaggcaagcgggatggaaacgatcccggggttgctcaacgggaatatggcgaaatctgcgccgcggatgagtgaggttgctgtcccggagaaaacgggggagaagatgatcagcaggattgagctggcgagtccgccatacatgctcagtacggctcccttagtggtgaaccgcttccagaacagtgagtagaggatggtgggcaggttcgcgcttgccgccaccgcgaaggccaaggcgatgaggaaggcgacgttctgatctttggcgccgattccgccgacaatggcgagcacaccaatgaccagtaccgtccgccgggcaaccttgacctcggttgctgagtcggccttgcccttgcggatgacgctggcgtagatatcgtgggcgaaagatgctgctgcggtgatggtgaggccggcaaccacggcgagcagggtagcgaaggcaacagcggagatgaagccaaggagcaggggcccgccgagttcgaaggcgaggagggtggcggccgaattgacgcctcccggtgcggccaggatctgttccggcccgatgagtgcggctgcaccgtagccaagaaccagggcgaagatgtagaagaggccgatcatgaagatggaccacaccaccgattttcgtgcttccttggccgtaggcacggtgtagaagcgcatcaggacgtgggggagtgcagcggttcccaacaccagcgcgaccgccagcgacacgaagtcgagcctgctggcgtcactggcaccgtacttgttgcccggttcaagcagtgaaacgccgttctccccggccatggtgacggcggaaccgagcagttcggaaaagttgaagccataaatgcccatcacccagaccgacatgacgccggttccgccgatcagcagcgcggccttgatgatctgtacccaggtggtgcccttcatgccgccgatcaggacatacatgatcatcagcgcaccaacgatggtgatgacaatgccctgcccaagatcgtccttgatgccgagcagaagggacaccagtgccccggctccggccatctgtgccagcaggtagaagaaacaaacagccagggtcccgacggccgccgccagacgtacagggcgctgcttcaacctgaacgagagcacatcggccatggtgaacttgccggtattcctcagcatctcggctaccagcagcaaggcaaccagccatgcaaccaggaatcccaccgagtagagaaagccgtcataaccgtaaacagcgatggcccccaccacgcccatcagcgacgccgcgcccaaataatcgcccgtgatggccagaccattctgaccgcccgtaaaggagcgcccgccggcgtagtaatcagcggccgtcttgttgttcttggacgccctgatcacgatgaacaaggtggccacaacaaagaccgcaaagatggacatgttcagtagcggatcagcatttgctgtggacgcctgcgcattcaggggcatgaaattcatgacttttctccgggagtttgtgggcgaaagcccgaaccttcaagggctgcctcgtcgtcgatgcggcgctccagggcattcctcagcttttctgcagccgggtcgaggacccggttggcgtaggacacgtaaacaagcgtgatgatgaacgtggtgacgaactgaagaaggccaaacagaagtccgctggtgatattgccgaacacgcggatggacatgaagtcgtgtgcgtacgcggcaaggtacatatacaggccataccaggcaagaaatcccatggccaccgggaaaatgaaacgtcgctgctttcgcttcaggtcctggaactcgggcgagttctgcacggcaagaaagtcgggggcatctggccccgcggcctccacgcgttctgtctccgttgacatgaaaccaacctcctgctccgagtgatggcattcgaaggtccaggaaacccaagccacacactgtgatcaatgccactttgcgccctggagaggtgggatggaacggcaccagcaaccggccgcggtccccggcgaacactttgcgataagaggcgcaatagccgcgacaaacgggtaagcggtatgcgtcagcgcgacgttaggtggtccaacttcctgtggaccggaagcgtttctgataagcccccggcgccacgccataggtggcaccaaagagccggcggagggtctcatcactgcctagcccgctgcgcatcgcagctgacgtgacggaatggccagcttcgagcatctgccgggcaacttcgacgcggactgctgcaactaccttcgctggcgggcttccccattcggcctgaaacttccgagcgagctgccgggtgctcagtcccgcccggcgggcaaggtcggtgacgctgtgaccggcagcagggtttgccctgacagcgtcaaggatcttccggaggccatcgtccgctgtcctctgcgtttcgcccgggctggcgaactgtgactgaccgccctcgcggcgcatgaaaacaaccagctcccgcgccacgtcccgggcggcagctgctccgtggtcctcctccacaagagccaaggcgagatcaatcccggccgtcacccccgcgctggtgaagatcctgccggatccaataaagattgaatcctcctggaccgcaacacgcggatattgcagactcagttgcggagcgaaacgccaatgcgtggtcgctttcagaccatcgagatacccggcctctgccaacagaaaagcccccgtacagaccgacgcaatccgacgtgcgtccttagctaaggtcagcagtgcaggttgcaggccggtgagcagggaccggctccccggaagggtgtctgaaccggccaggatcagggtatccaggaccggagcctcgaatgccgcgccgtggacggcgaggcggacgccggccgaggaggtcacgtcgttcccgtcaggagaatacagtttcagcgcgtaaccggctgcgtggaagacttccgcgggccccgtgacatccagcaactgaacgccgtcgaaaacgaagataccgacgtggcgtccgctgctggcgggcgagagaaacactcgtgtctgaatctgtggggtatcggtctgaaaagacatggcaacagaactgtatcgcgacaaggatggatagcgggcctatctcagtctggtggcccgttgctgctgaggagaatattttgaccgaggtaattgctggaattcctgtcccggatacgcggctcgtggctgaggccacagcatttgtgcgggacgccacgaacgatctgctgttccatcactcgcgccgggtttatctgttcggggcgctccaggggcagcggcgcggcctggacgtggacctggagcagttgtatgtcggggccatgttccacgacctgggcctgacagatgcccacggaacggaccatctgaggttcgaagtcgacggggccaatgccgcccgggacttcctcagaagccacggggttccggaagaaaaggtcacaaatgtatggacagcagtcgctcttcatacgactccagggatcccggaatttttatctccagagattgccttggtgacggccggcgtcgagacggacgtcttgggaatcggttatcaggatctcgatccggacgtgttgcaagccgtcacagatgcccacccccggcctgatttcaaacgccagatcctcgaagccttccgggacggcaatgttcaccgccccggcacaaccttcgggaatgtcaacgcagatgttctgacacacttttgcccggactttaaccgcacagacttcgttgacatcatccgcacctcgagctggccggaatagaagcagacaacgccgccaagtcttgcctgcgtacgctggcccctttggcggggctcccctgctcagcgtgaaacgccgataaccggccttccgtaaagctacggccgagtggcaaggcacaacgacagcaccggtagcggagcgggtcactccagcttggcgtggcgcaggtactggtagacggtttccctgctgattccgtagtcacgggcaagtaaggcttgcggtacaccgctgccggcgcgcttgaccagttcggcggcccggtctggtgcgagtgtctttttccgtcctttgtaggcaccacgctgcttagccagggcgatgccttcccgctgccgttccctgattagggagcgttcgaattcggcaaaggcacccatcacggagagcatgaggttggccatgggggagtcctcgccggtgaaaaccaggctctccttgacgaactccacccgcacgcccttgcgggttaggccttggacgagagcacgtaagtcgtcgaggttgcgggcgagccggtccatgctgtgcacaacaacggtgtccccatctctggcgaaccgcagcagttccgtgagctcgggcctggcagtgtccctgccggaggccttgtccgtgaaaacccggtccaggacctggccttcgagctggcgtttctcgttctggtccagcgtgcttacccgcacatacccgattcgctgtccggccactgctgcctccaaccttcgcctgtgaggttgagttctagaaccgtcctacaaggaagtcaagcccctgacattcccttgtcaggtttggggtgtgccctaacaggacaatctccgcctgagcaggttctccggacctgttgagtccgccggttctacaaggggccgtgttctccaaaaactataagcaggccccgccttacagtgctgatcagcaggcacaacagttccaccgcggctagcggagcccctcagtacgtcgtatccacgggccactagtactggactccgccgcggcggatcagcttgcccgtgggggtctggccgtccactactacgccgcgcaggaaggttttgcggacgaccccggagagggttttgccgtcgtagggggtgatggggttcttgtgcttgagcttggagacgtccaccacgaatgcgtcgtcggtggcgaagacggcgaagtcggcgtcgtagcccagcgccagctggcccttgttggtgagccgggcgagggctgcgggcttctcacccatccaggacaccacctgctccagcgggatgccgcggtgccgcgcttcggtccagatcagggagaggccaagctgaagcgacgagacgccgccccaagcaacggcgaagtcgccgttctccagatccttcagatccagggtggagggggagtggtccgagacgatgcagtcgatggtgccgtccagcaggccctgccacagcagctcgcggttggaggcctcgcggatgggcgggcagcacttgtaagcggtggcgccgtcagggatttcctccgccatcagcgtgaggtagtgcgggcatgtctcgacggtgagcttcacgccgtcgcgccttgcagaggcgatcatgggcagggcgtccgacgacgagaggtgaagaatgtgcgcacgcgcaccggtccagcgggcccgctcgatcacctcggcgatggccttgttctcggcgccgcgcgggcgggaggccaggaacgtggagtagtggtcgccacccgggtgcggggcgcggtcgatggcgtgggaatcctcggcgtggacgatcatgagcgaatcgaaggacttcagctcggccatgtcctcctccatctcgtccgcgtccaggtgcggaaactcgtccacgccggagtgcagaaggaagcacttgaagccgaatactccttcgtcgtgcagggcgcgcaggtcgcccttgttgccggggatcgcgccgccccagaacccgacgtcgatgaacgcctggtcctcggccacctcgcgcttgagcttcaggttttccacggtggtggtgggcgggacggagttcagcggcatgtcgatgatggtggtcacgccgccggcagcggctgcacgggtggcggaggcgaacccctcccactcggtgcggccgggctcgttgacgtggacatgggtgtccaccaggccgggaatcagggtctcgtcgtcggccagttcaatgacctcgcgaccggccaggccgttaccgaggggctccagggcgacgatcttgccgttgaggacgccaacctcgcgagccgtaatacccgcggtggtaaggatgcgctggccacgaatgactaagtcaaacgtgccggttgctgggatgggattctcaggcatggaggggctccttggtatcgaatgcgagctaagatctgggaaattccgaaaggtgcacgccgatgtgcgtacccaattcttcaagcaacggacctgcttcagctatacatttatttagattgggctcaaagtcagtcagcgcgtgaaccgcctcgaagccggattccttgagtagttccgggcttaacgtactgcggccgcataccgcaatgacaggcacaccggaacgcgccgcagcccgcgccacgccgatcggtgttttacccagcaggctctgctcgtccaggctgccttcgccggtgatcaccaggtcggcgccggccagccggtctgccaagccggtgaattcgaggacgacgtcgatgcccgggcggcgcgttgcggcaagtactgcgatggcggcataaccaacgcctcccgctgctccggctcccggggcttccgcggccttgacggccctgttactggggccgtcgggaccgatttccctggccaggacttcgacaaacctggccagggcggcgtcgagcacgtcgacgtcctgttgtgtggcgcccttctgcgggccaaaaatcgccgcggcgccctgggcgccgagcagcggattgtcgacgtcggacgccagcacaaagcgtgtgtccttcagccgggcgtcaaacccgctgaagtcaatccgatccaggcgggccagcgcggcaccgccttccggaagttcgttgccctcaaaatcgaggaacctggcgccgaggccctgcaggacgccggcgccgccgtcggtgttggcgctgccaccgacaccgaggatgatgtgccggcaacctcggtccagcgcggcccggataagttcgcccgttccccggctagtggcacccttggccgttgcggagtccggcccccctgccggcaggacagcgagaccggaggccgccgccatttcgatgacggcctcattgccccgaacagcgaagtcggccgtcacgggctcgcctgttggtccggcaaccacggcgctgcggcgggtgaagccagagccgacggcggcgtccagggtgccctcaccgccgtcggccacgggaatccgaagaacctcaaggttcccgcccactccgcgctgaaggcccttttccaggtgcctgcacacgtccggggcggacagcgatcccttgaacttatccggcgcaatgaccactagcatccccttacctcctttcagatgttcagaacctttacgggagaagggaactagtccaacagtgcgataacggcggtgggtgcgtcctcgcccctctcggccaattcttcgaattccgttacggcgttgatttccacacccatggagatgttggtgaccttttccaggatcacttccaccaccacgggaacctggaactcgcccatcagtgccttggccttgtcgaacgcggcggcgaggtcgttggggtcctccacgcgcacggccttgcagcccaggccctcggccaccttcaggtggtccaccccataaccgttggtctcagggctgttgatgttgtcaaacgccagggacacgttctgctccatgttgaacccgcgctgggactggcggatcagccccaggtaggagttgttcaccaccacgtggatgtacgggaggttgaactgcgcacccacggccagttcctcgatcatgaactggaagtcgtagtcgccggagagggccaccacggtctcgtccggcttgccgcggaccacgccgagggcggccggggccgtccagcccaggggaccggcctggccggcgttgatccactggcgcgggccgaacacgtgcagcaattgaccccctgcgatctgggacaggccaatggtggacacataggtggtgtcgcgaccgaagaacttgttcatctcctcgtacacgcgctgcggcttaatggggatgttctcgaagtgcgtcttgcgctgcagggagcctttacgctcggcgcactcggcaacccaggcgctgtagtccggcagggatcctgccgccttgcgctctttggcgagctcaaccagccccgccagcgccgcaccggcgtcggacgcgatgcccaggtccggcgagaacacgcggccaatctgcgtgggctcaatgtcgatgtgcacgaacttgcggccggcggtgtaggtttccaggccgccggtgtggcggttggcccagcggttgccgatgccgatcacaaagtcgctctgcaggtagttctcgttgccgtagcggtggctggtctgcaggcccaccatgccggccatcagccggtggtcgtccgggatggtgccccagcccatcagggtggggatgaccgggatgttcagggtctcggccagctcaaccagctgtgcggaagcgccggcgttgatgatgccgccgccggccacgatcagcgggtgcttggcggcggtcagcatgtccagcgccttttccagctgcttgcgggaggccttgggcttttcgacggggaggggctcgtaggtgtcgatgtcgaactcgatctcggccagctgcacgtcgatgggcaggtccagcagcacgggaccggggcggccggagcgcatcagctggaaagccttctggaaggcgccgggaacctggccgggctccagaacggtcatggccatcttggtgacgggcttggcgatggattcgatgtccacggcctggaagtcttccttgtgcagcttggccaccggcgcctggccggtgatgcagagcatcgggatggaatcggcccaggcggcgtagaggccggtgatcatgtccgtgccggcggggccggacgtgccgatgcagatgccgatgttgccgtccttggcgcgggagtagccgtcggccatgtggctggcgccctcaacgtggcgcgccagggtgtggcggatgccgccgtgggcgcgcattgcggagtagaaggggttgatcgcggcgcctggcaggccgaacgcctcgatggcgccttccttttccaggatggcaaccgctgcatcaacggtacgcatcttgctcatggtgtgctccttgaaaactgatttaggggggagaaagagggcccgcgaaccgctgctcggcacttggacggggcagcggttgcggctacttgcggccgctgagctggaggacctgtttgaagagtccggagtggtcgaggccgccgtcgccctggttgacggtggcggcgacgagctgggcgacgacggcgccgagggggacggcgacgttggcttcgcgggcggcggaggtgacaatgcccaggtccttgtggtgtagggcgaggcggaagccggggtcgaagttgcggtcaagcatcttctggcccttctggtccagaacctttgagccggccagtccgccgccaaggaccttgagggctgcgtcggtgtccacgccataggcctcaaggaacgcgatggcttcgccgaggacctcaatgttgacggcgacgatcagctggttggcggccttgacggtctggcccgagccggaggggcccacgtggacgatggtcttgcccacggcgttcaggacgtccgaggctgcctcgaagtcttccttctcgccgccgaccatgatcgagaggacggcatcaatggcgccctgttcgccgccggagaccggggcgtccagcgggcggatgccggcttggcgggcgtcgtcggagaggcgcttggcgacgtccgggcggatgctggacgcatcaatccacaaggtgcccttcttcgcgttcgcgaaaacgccatccccgccgctgaccacaccctcaacatcgggggagtcagggaccatggtaatgacgacgtcggcgtccttgatggcgtcggcgatgctggtggcacccttgccgccttcggagacgagcatgtcgatcttgtcctggctgcggttgaagccggtaaccgtgtggccggccttgaccaaattgatggccatcggcaggcccataattccgagtccgataactgcaacattgctcatgatggttcccttactacagtggggttaattcaggtgctctgcgggagtttgccgaggattagtgaggggcaggaggttcggagaccgcccagctgaaggccgcttgctgcggttccttgtactcaaggccgatgtagccctcgtaaccgagctcgcggctgcgggcgatccactcgcccagcgggagcgtgccggtgccgggggcgccgcggccggggttgtccgcgatctggacgtggccgaagtccttggcgtggttttcgatgacggactcgacgtcgtcgccgttgactgacaggtggtagaagtcggcgaggagcttgatgttgccgacgccggcctccgccttcacccgggcgatgaccttgagtgcgtcgtcagccgtgaggagcgggtacctgggtgccccgctgaccggctcgaggaggacggtcccgccgatcagggcgacgccttcggcggctgcggccaggttcttgaccgccagttcgtcctgctcttcaggagtgaattcgtcctgccggttgccgtagagggcgttgaaggccttgcagcccaggcgctggccgatgccggctacgacatcgatgttgtccttgaactcagagcagcgtcccttccaggagaccaggccgcggtcaccgccgggcatgttgcccgcgttgaagttcaggcccgtcagctggaccccggcatccttgatagcgttctcgaattcggtgacctgggcatcggacgggacggagctttcaaagggccaccagaactcgacagcatcaaagcctgctgccttggctgcggcagggcgctcgagcaggggcagctccgtgaggaggatcgagcagttcactgtgtacgtcattgaggttcttctctcctgggttcatcagtttcactgtgaggaggcaaagcccgcggatctggtgaaggcggattgggatgggttgccgccaagtcgcgtgccctgatggaccgacagccgcgctgacgtcttccgtgatcggcttgattctgatttgacgcaaagattccggatggtcctgcatagtgatatgttcctccggttttcgtaaattcgtacctcatgtaaggcggatttggcggttcatgtctttgtacagcaggtagcggaactcgcccgggcctccggcatagcaggcctgcgggcagaaggcgcgcagccacatgaagtcgccggcctcaacttccacccagtcattgttgagcaggtacatggccttgccttccaggacgtagaggccgtgctccatgacgtgggtttcagggaacgggatgacgccgccgggctggaacgtcacgatgttcacctgcatgtcgtgggccaggtcgttggagtccgtgaagcgggtggtcttccaggcgtcgttggtgtccggcatcgacgtgggctgcacgtccttttcgttggtgacgaaggacttggcctcgtagtcctccaggcgttcgtaggccttgcggatccagtggaaggagacgacgtcgtcggaaacgttctcaaggccccactcggaaccggcagccaggtaggcgtagccgccttcctcaagttggtgcagttcgccatcgagggtgaggttcaccttgccgcgggtaacaaaaatgacgccttcaacaccggcctcgaattcagccttgggagcaccgccacccgggccgatctccacgatcaactgcgagaacgtcgtggcgaagcctgagatggggcgcgcgatgatccaggagcgggtgttcgaaaagcccggcaggttggacgtgacgatgtccgtcatgacgcccttgggaatgaccgtgtaagcctcggtaacgatggcgcgctcggtggtcaggtgggtctgcggtggcagtccgccggtgggggagtagtacttgcccatgaaagagatccttacctaggagttggaggtggcctgcgacagccgcgggtgcgccagtcccgtgagttgggggatggcgacgccggccagcgcctgtacttcatccgcaccgacagcgccgcactggacgccgcgcagcacgaacgctgccagggcccgggcggtggcgggctcgtccatcacgccgccttcggtctgctccacgtagttccgcagccgggctgctgcggcgggcagtccctgccggtagaaggcataagtggcggtgaaccggctgggcagctgggccgggtgcaggtcccagccctggtagtagccgcgttccagcgaccgccggaccaggcgcccgtgcagctgccaggcattctccacgttgtcgcccacggggatgatgttggtggagccgtccgagagccggattcccgtgcctgcaactgcgagctgcatgacctctttggcgaagtcggccaccgggtgttccatggactggtattcggcggagatctgcagggacgctgagtagtcgtaggtgccgtaatgcaggccgctgatccggcctggcacggcatgcggcagttgcgccaccggggaggtgccctcgggtccgaggatcagctgcggcgtctccacctggacctcgaagcggagccgccccgccggaagcgagtgcacttcctccagccgcgagacagcgtaatccatcgcctggacctgggccaccgtggtgaccttgggcagggtcaggattagcccttccggcagttcgctggccgcggcgagcccggaaacgaacaggtcaagcgtccgcaacccgcgcgaccgtgtcggtgcctcaaaacacttgaagcggatcccgatgaacgggggagcggagccggcagcgacggcggcggccacagcggatgccgcagcaaccgcggcggcgtcctcggcgtcgtcacccctgtccccgaacccgtcctcaaaatcgagccgcaggtcctcgatcggttcactggcaagcttcgcttcgacacgggaggccacggcctccgcgagggccgcgttctggcccaacagcgcgccgagcttcgccaggccgccgtgcgcttcagcagtattcagcgcctcggcgccccagtcagcagcgagcgacggcgtaaaccggtctgcggggacgtataccgtgtggacgggctggcgggagccgtcgtcgcccgggtagttctgctccagcaggcggtccgtcgcggccagctgtccatcaatgtgcgcgaggtcccgcggggagagcgacgccgtgggtgttgccggcatgcgtcagcccaccagttcgtaggccggggtggtgaggaagtccgtgtagtcctcggacaggcagatgtccgcgatcagtttgttggcgggctggtagtagcggcggaaggtttcgtcgcccacttcggtgcggagccgctcggtttcctcgcccaggatgcgctccaccagctcgcgggtgacggtgttgccggtgtcagcgagcatggacttgttccggatttgctgccacacctgggagcgggagatttccgcggtggcggcgtcctccatcaggttgtggatggccacggcgccgtttccggacagccacacggcggtgtaggcaacggcgacgtacaggttcagccggaggcccgcttcggttacctggccgtcggcggaggccacatccaggagctgctctgcagtgacggaaacttccgggcgctgcttgtccagctggttcggcttgtcgccgagcactgagtcgaagacttcccggcacgtcgggaccaggtccgggtgcgcaacccatgaaccgtcgaagccgtcgttagcctcgcgggtcttgtcagcgcgaaccttggcgaacgccgcctcggtgacctcggggtgccggcggttggggatcacggctgccatgccgcccatcgcgaaggcgccgcgcttgtgacaggtcttgaccaacagttcggtgtaggcccgcatgaacggggcggtcattgccacggaggcgcggtccggcagtacgaactgttcgccggcgtcgcggaagtacttgatgatgctgaacaggtagtcccaccggccggcgttcaggccggaggcgtggtcccgcagttcgtacaggatctcgtccatctcaaacgcggccgggatggtttcgatcagcaccgtggcacggacggtgccctggggcaggcccagttgctcctgtgcgaaggcgaagacgttgttccacagcctggcctcgaggtggctttccatcttgggcaggtagtagtacggaccctggccgttgtccaccagctgcctggccacgtggaagaagtgcagcccgaagtccaccagcgcacccacggcaggttcgccgtcgatcagcacgtgcttctccggcatgtgccagccgcgcgggcgggcgacgacgacggccagcggcacgtccgtgcggagcctgtattccttgccttcctccgaggtgtaggccaaggtgccccgggcggcgtcgcgcaagttgaggatggcatccaccacgttggcccacgtgggtgtgctcgcgtcctcaaggtcggcaagccacaccttggcgccggagttcagggcgttgatggccatcttcgccggtgaagcgggaccggtcatctcaacccggcggtcctgcagcgctgcgggcgcgggcgcaaccttccagtcgctgtcgcgcacgtcctgtgtttccggcaggaagtccagctttccggtctcggctacgcgctgccgcttgagggcgcgggctgccaggagttcgttgcgggtgccggcgaagcgggtatgcaactcctccacaaaggccagcgcctccggggtgaggatctcctccgcgcgctcgatcggccggggatctgtcactgaaatcggcatggaatgtccttcctagaggtccctgctggctatagcagctgagtgtgcggctgcggcatgggcggcagcagcaacggctgaagcaacatcggccgcgacgtggggatcgaagacgctggggataatgtagctggcattgagctcgtcgtcagctacccggttggcgattgcctccgcggcggccaccagcatctccgggatgatgtccgaggcgccggcgtcaagcaggccccggaagaagccggggaacgccaggacgttgttgatctggttggggaagtcactccggccggtggccaccactgcggcgtgcttagcagcaatcacgggatcgatttccggcgtggggttggccatggcgaacacgatcgcgttctctgccatggcggccacctgttcctccccgatcacatggggtgcgctgacgccgatgaacacatccgcacccacgagcgcctcgtgcagggtgccggcaaagccttcctcgttggtgttcgccgcaatccagctgcggtgttcgtcgtcgtacttttcgccggagtggattgcgccggagcggccggcggcaataatgtggcgggcgccctgggccttcaggagctggatgatggccgagcccgccgccccgacaccggaaaccacaatccgaacctcatccagtttcttacccaccacccggagcgcgttgaccaaggctgcgagggtgacgatggcggtgccgtgctggtcatcatggaagacggggatatcgagttcatcgcgcaggcgtttctcaatctcaaagcagcgcggggcggcgatgtcctcaaggttgattccgccgtagacgggggccatggccttggcgatcatgatgatttcctcggtgtcctgggtgtccaggcagaccggccaggcgtccacattggcgaactgcttaaacagcgcggctttgccttccatgaccggcagggcggcggccggaccaatgttgcccaggcccaggacagctgaaccgtcggtgaggacggcgatggtgttgcgcttgaccgtcaggttgcgggccgctgcagggtcctcggcaatggcgaggcagacgcgggcgacgccgggagtgtaggcgcgggagaggtcgtcgcggttgcgcagggctactttcgggaccacctcaagcttgccgcccaggtgcatcaggaaggtgcggtccgagacgtgctggaccctgacgccgtcaagcgcgttgagggcatctttgaccctgcccgcgtgctcgtcatcggtggtgttacaggtgacgtcgacaaccagggtctcgtggtgggattcgctgacgtccagggcggtgatggcggcgccggcggcacccacggccgcggcgagctcgctggtggcgctgaagcttgacggtgcttccacgcgcagggtgatcgaatttccggggctggggttcgccattgaatctcctcctgttacccatgtactgggcttgcttacatctcatgatatttcgtattatggatattattctctacatagtggaaaagcaagggctaacttttgttattgcccaatcgcagtaaccgccagcccgtacgcgaagcatgttttccacgtggcgatgtgagttgtcgaaaagctaccctgcaggagaggacggaatggccgttaaagccacgggaggtgtgcagtccgttgagcgcgtcttcgaacttttggaactcatcacggacgccgggggagacatcacgctcagcgagctctcctcgtccacggacctccccctccccaccatccaccgcctgctgcgcaccctggtgtcgctgggctacatccgccagctgccgaaccgtcgctatgcactggggccgcggctgatccggctgggtgagggcgcaaacaagcagtttggtgccttggcccgcccgcagctcaagttcctggtcgacaaccttggcgagacggccaacatggccgtactggactccgacatggtcatttacgtggggcaggtgccgtcgctgcattcgatgcgcatgttcaccgaggtgggccgccgcgcccacacccatgacaccggggtcggcaaggccatcctgacgcagctggatgacgacacggtacggggcattgtcagccgcaccgggatgccgacccccacgcccaagagcatcggcgacattgatgagcttctcgcggacctgaagctgatccgcgagcgtggatactccatcgacgaggaggagcaggagctcggcgtacgatgcttcgccattgccgtgccgaacgcccccacccccactgctatttctgtctccggaccgatgtcccgggtggacgaatccttcgccgaacgggccgtcccgctgctccgcgaagccgcgctcagcatttcccggctgttgcagtcaaggctcagttaagggcccggagccgtcaccgtgagccggccgcggggccggactctcggcccggtgcactctctcattcaggatttggtgcgctctttggatctgtgcgtgaacgaacggctggctgtaagtgcatacgcgtacctgacaaagcgactgccaggacccacatccgggatatcaagaggcgggatgccaccgccagtaagagcgcacgttcctcgttttgctgcagctgccgaccatcgccggggtgagggcacgacgaagcggtccccgaccttgggcgccgggcagctgttgacccactaagcgttaaagtcggactctcatgtttcgccgccggtgcgggtttcggggcgacggaggcaacatccaccgtgccgtaaaagtgcggaacagcggacgggaatggtccttcggccacaacccgtccgcccactggcaccgcttctttgacgtgttatgcgtccccgccggcgttcccggtggaaccggcattgacgttgtgcaaccggtacttgtcgattgccttcatcggtgcctgggcgtcaacctcaccgcggcgggccagcatctccagtgaacgcaccacgatggagtggatgtcgttcttgaagaagcggcgggctgcggcgcgggtgtcggagaagccgaagccgtcggcgccgagggtggcgaactcgttcggcacgaactggcggatctggtccgggactgccttcatgtagtcggacactgcaacgaccgggccggtggcgccttcgagttgctgggtgatgaaggggacgcgggcgggttcgccgggtttgaggaaggcttcctcttcggcggcgagtccgtcgcggcgcagttcgttccaggaggtcacggaccagacgtcggcggagactgaccagtcttcggcgaggatccgctgggcttcgagggcccaggggacggacacgccggaggccaggatctgggtccgcggaccatcgatcttcgccggagccagcaggtagatgcccttgatgacgccctcgacgtccagttcctcgggttcggcgggctgggtgatcggctcgttgtagaccgtgaggtagtacatgaggttccggtcttccgagtccggcccgtacatgcgttcgaggccgtcgcggatgatgtggcccatttcgtagccgtaggcggggtcgtaggtgaccacggcggggttggtggaggcgagcaggggggagtggccgtcggcgtgctggagtccttcgccggtgagggtggtccgtcctgcggtggcgccgatgatgaacccgcgggtcatctggtcggccgctgcccagaacgcgtcgccggtgcgctggaagccgaacatggagtagaacacgtagaccgggaccaggggaacgccgtgggtggcgtaggcggtgccggcggcggtgaacgctgccacggcgccggcttcgttgatgccggggtggatcagctggccctgggcggattccttgtaggccaggacgaggtcgcggtccacggagaggtagttctggcccttggggttgtagatcttcgcagtggggaagaacgcgtccatcccgaaggtccgtgcctcgtcggggatgatcggggcgatgtgcttgccgaagttcttgtcccgcatgaggtccttgagcaggcgcacgaaggccatggtggtggcggcctgctgcttgccggagccgcgtttggcggcctcgtaggatttggcgtccggcaaggtgatgtcggcgtgcttggaccggcgctcgggcacggacccgcccagggccgcgcggcgctccatcatgtacttgatctcgggtgcgtccgtgccggggtggtagtacgggggctggtacaggtctttttcgagctgttcgtccgtgacggggatccgcaggtggtcgcggaacttcttcaggtcatcgagggtgagtttcttcatctggtgggtcgcgttgcggccctcgaagtgcggtccgaggccgtagcccttgacggttttggcgaggatgacggtgggtttgcccttgaattcggtggctgccttgtacgcggcgtagaccttgcggtagtcgtggccgccgcgtttgaggttccagatctggtcatcggtgaggtccgcgacgaggtccttggtagccgggtccttcccgaagaagtgttcgcggacgaacccgccggattcggccttgtaggtctggtagtcaccgtcgggggtttcgttcatgatcttcaccagcgacccgtcggtgtccttggtgagcaggtcatcccattcccggccccagacgaccttgatgacgttccagcccgcgccgcggaagaacgcttcgagttcctgcatgatcttcccgttcccgcgcacgggcccgtccaggcgctggaggttgcagttgatcacgaagttcaggttgtccaggttctcgttcgcggcgagctggagcaggccgcgggattcgggctcgtccatttccccgtcgcccaggaacgcccagacctgctggtcggaggtgtctttcaggccgcggttgtgcaggtaccggttggactgggcctggtagatcgcgttcatcggcccgatgcccatggacacggtggggaactcccagaagtgcggcatcagccgtgggtgcgggtatgaggacagggcgtggccttccttggacttttcctgccggaacccgtccaggtcctcctccgagagccggccttccatgaaggcccgggcgtacatgccgggggaggcgtggccctggaagaagacctggtcaccgccgccggggtggtccttgccgcggaagaagtggttgaagcccacctcgtacagggtcgcggcgccggcgtaggtggagatatgcccgcccacgccgatgttcgcccgctgcgcccggtgcaccatcaccgcggcgttccaccgcatgtacgcccggtaccggcgctcgtattcctcgttgcccgggaactccgcttcctggtccaccgggatcgtgttcacgtaatcggtggtggtcaccatcggcaccccgacgctctgcgcgcccgcacgctgcagcaggctccgcatgatgaattgggcacgctcagtgccctgttccctgatcaacgaatccagggactcaacccactcggcagtctcttccggatcacgatcaggcagctggttagtcaacccgctgaggatatgggaggtatcttctcctgcagccacggcagcctcttttcgccttaacggctatttggtatttcatgatgtgagaaaaagtttctgtactacgagattatctgaacgtccgcaagggcgcaaattgactgggggcggcaaaaggggtatgggcagggtcttgaccggcatgtgacctagcccatacactagttccatcattcaaaattgcttttccacgaagcggaaaccctgcgcaaagatgcggaggatgtgcttcgggatcagcctcccagaagtggaagtcgcatgatgcaaaagacttcgccggtcgctgtcgaccaggttgacctgccggcatcttcagatgttggcacctatcccgctccgggcgaggacgctctttggcccgctatcgcagtcgaggcgggaggctccgttagcccgtctttgtacaacgccgacctcgcgcccactaggacaaaaggccgccggtggactgcgtacagcatcttcactctgtgggccaatgacgttcatagtctcggcaactacgcattcgccatcggactgttcgccctgggtctcggcgggtggcagatcctcctggccctgggcatcggagcggccctgctctttgccctgctgaatttttccggcttcatgggtgttaagaccggggtgccgttccccgtcatgagccggatcagcttcggcatccgcggggcccaaatccccagcctgctgcgcggggccgtagccattgcatggttcggcatccagacctacctcgcgtccgtcgtcttccgcgtcttgctcgtggccatgttccctgccctggcagccatggacaaggactcaattctcgggctgtcaacgctgggctggatcgccttcgcggtcctctgggtcgttcagctcgtcattgtcagctttggcatggaaatgatccgcaaatacgaggccttcgccggcccgatcattctcgttaccatggctgccatcgccgtctggatcttcgccgaggccggcggctccatcgcctggtcctcggacaacgccctgcaaggcggggagatgtggcttacgatctttgcaggcggcgccctctgggtttccatctatggcacctttgtcctgaacttctgcgacttcacccgctccgccgtctccaaaaaggccgtcgtccgcgggaacttctggggcatccccatcaacatgctcgtcttcggcgccatcgtcgtggtcatggccggcggccagttcaagatcaacggcacgattattgagagcccctcggacatcgtgcagaccatcccgaacacgctgttcctcgtcctggcctgcctcgcactgctgatcctgaccattgccgtaaacctgatggcgaatttcgtcgcccccgtctacgccctgaccaacctgttccccaagcggctcaacttccgccgggcagcctggatcagcggcgccatcggcctggtcatcctgccgtggaacctctacaacaacccgctcgtcatcgtctacttcctcggaggactcggtgccctgctcggtcccctgttcggcgtcgtcatggcagactactggctgatccgccgcggcaagatcaacgtcccggacctctacaccgaatctcctctcggtgcctacttctacaagaagggttacaaccccaaggcaatcatcgccatggtacccgcggcatccgtcgctctcctgatcgctttcactccggctttcgcggcggctgcccccttcgcctggttcattgccgcaggcatcgcagcagtcgtctattacctcatctccgatcgcaggcaacgccacgacgatgtcgccggtgacgccatcgccgtcgccagcacacactaaggaaaacccatgcgtattcttgtagccaacgtcaataccaccgagtccatgaccgactccatagccgcccaagccaggctggcggcggcaccaggaaccgagatagtgggcctgaccccgcgttttggagccgattcctgcgaaggcaacttcgaaagttacctggccgccatcgccgtgatggacaaggttctgtcctacccggaaccgtacgacgccgtgatccaggccggctacggcgaacacggccgtgagggcctgcaggagctgctggacgtaccggtcgtagatatcaccgaagcggccgccagcacggcgatgttcctcgggcacaagtactccgtggtcaccacccttgaccggacggtcccgctcatcgaggaccggctcaaacttgccgggctcgacacccgctgcgcttcggtacgtgccagcggcatggcagtcctggagctcgaggaggagcccgaacgcgcagtggaagccatcatcgaacaggcgacgcttgctgtcaggcaggacaaagctgaagtcatcatccttggttgcggcggcatggcgggtctcgacgagcagatccgccagcgggccggtgtcccggtagtcgacggcgtcgctgccgcggtaaccatcgcggaatcactcgtccggctggggctctccacttccaaagtccgcacctacgccccgccccgccccaagaaagtgctcggctggccgctgacagcaggggatatcctcgccgccccgtaaaaatcaggcccgaacaaacggcacagccttcagaggccggccagctgccgcgacggacaggtcagccgaggtccgcgtaaccagtcattgagatccagcgccacgacgacggcagacgatcccaagaaggacgacgtcccgggcactcttgaccgtggcctgcatcacagctacatcagtttgatagagcggacccgcgcggcggccccgacagggacggcgtttccgcccacccgcaccagccgaaccctgcacagcccatttcacggaggtttgtacgatgtccccacagcacggtcccagctcgcacgacgagcacgggcacccgcacctaattgacccggagccctggggcaccggcgaccccgcagtcgaggaaatcgtccggggagggccagccgccccggcccaggtgcctgcgggcatcagctcccggctctacaacgaggacctggctcccaccacgcgtaagggccgcacgtggcacgcctacagcatcttcaccctgtgggccaacgacgtgcactcgttgggtaactatgtcttcgctattggattgttcgccttggggctgggcgcctggcagatcatggttgccttcctgctcggtgccgttttcctgttcctgctcctgaacctctccgggttcatgggggagcggacgggcgtgccgtttcccgtcatgagccgcattgctttcggcatccggggctcgaacatccctgccattatccgcggcgctgttgccgtggcatggttcggtatccagacctatctggcttccgtagtgcttcgggtgctcatcttggccctcgccccgtccctggccccactggacacggattcgttcctcgggctctcgacgctgggctggatctcattcctcgcactttgggtgctgcagacggtaatcgtcagctttggcatggagatgatccgtaagtacgaggcattcgccggccccatcatcctggtgaccatgctcgctcttgctatctggatgctggtggaggccggtgggtccatcgcgtggtccacggccgactcgctgacgggcgcggaaatgtgggtgcggatcttccagtctgccgctctttgggtggtcatttacggcactttcgtcctgaacttctgcgatttcacccgcggcgccccctccgagcggtcagtggtgcgggggaacttcttcggtatccccatcaatatgctcttcttcgccgccatcgtcatcgttctcgccggcgcccagtacaagatcgacggaacggtcatcgagtcgcccaccgatatcgtcaacgccatcccgaacaccttcctgctggtgctggcctgcctggccctgatcatcctgacgatagccgtgaacctcatggccaacttcgtggcgcccatctacacgctggcccacctcttcccccgggcactgaacttccgccgggcagccatcatctccgcagtgatcggcctgctgatcctgccgtggaacctgtacaacacacccgtggttatcgtctacttcctcggcgggctgggcgccctcctggggccgttgttcggcgtaatcatggccgactactggctggtccgcaagggcagggtcaacatcccggacctgtactcagactcacccgacggggagtacgcctacacccgcggcgtcaaccggaaggccatcatcgcgggcacgccggctgccatcgttgccctgatcctggcgctcgtccccgcattcactttcgtgtccggcttctcctggtttgtcggcgcgatcctggccgccgtcacctacctgctaatcatggaccgccacgcgccgttccgagcggtcgacggcgaggatatcgccgtcgcccccaagcactgaccagcccggcagcatgcgggttctcgtggtcagtgtgaccacgagaacccgtgaccagccccatcggtcgagagttgcatggggctccccggcaccgcagggagtgtccccctgacccctgttcgcaggcgcgtcgtcaggacaacagggacgcctgatggatccattcgcccgccagcggggacacagcccgagcccccgatgagaacacataaatgagacgcgtacgccctccgcctttcgacagcaaccaacgatgaaaccgccagggaagcgctcggaaaagccgagggactactccggccgcgcctcctgaatgttccagccttcggcacgcgtgtagacagcgatgaccgaaccttcaccgaaggcagaacgtggatcggcggtatgccgcacggcggcactagtgcaatccaaaccttccagagctgccctggccttagcgatagcgtcactaagactcgtgccttcaacccggcaacgaccagcactgtgatccgttgcgtactccaggacgaacgccatgaacggaagcgtgccagatccgacaaagctcctatagggccaatggacccggttctagacgcgagattgcccgcagaccctacccgctcccgggcgcgggcccggcggaactcggcagcagcagtgctactgtttggaccagctcctgggcctgtggcgtccagaacatggagcccaaagaggccacgacgccagaggaccacctattcgtcgctagtgccagaaggtccataaccggcagtctcggtcctaaactaatggaagacggcctgatgggtttggacgatccggtcaatggcaacctggaccgctcatctccgcccatagccgctcgccaatcgaaggagacacgatgaccataggtggtcatcgtgtccactgtcccctgatttgctaaatccgggccggcgaccctggatgctgacgtaacgaggaccattcacaaagtgaaatttgtccaaagcgagcaatcgaaggacaatatccgctgtgacggtggtaattgggggctccgccacgggctggctcttgatcctaagaaccttgcaggagccagcccagctggctccaaaggttttacacgttcaaaatggctgcgggtagtgcgccactgctattgcagcgcgctgctcccaggggccaactcccttagctgaggtcgacttccgcgctgctacagaagtcactccccagccaagctccgcacctgcttcacggatacacacatcttcgcttcttcaactcaagagttgtccaaggatgcggcagttaaggttttaccatgacggacgcggtgcgcagaggcttgcccgtgatcattgggcactccgggtagtggccaggcgccggcccttctaggacttccttcgaccggctaagctccgttaccgcggatgctcatttgcggcaaactaaactgggcagtaactttgacgaggcggctacccattttcccccatttgggcagtcgccaaggctccgcggctacccccaatgccgcggggccgttctcatacatcggctatgggcggcacgcctctcaccaccagccatgctccaagaagtagatccggaacggagcgaccacagtggcgaggccacgatcgtcatccgacggttgaagatctaccgcccgggaggtcgtccgtggacaacgaatgcagccatcaatgtaccggctgcgtcaaccgcggcataaggcagggcctacaggccttacgcaccccgtcggctctggcccagacagaaaagaccccgccggctcctggtaataaaaccgaagccagcggagtcatttctacccaagcgtatttcgtgaatcgttgccaggagcaattgtgtcctttgctctgatcttgttgtccttaccgtggatattcaattcagcgccccgaagagcgggacagataaccacgagcagcatcgattgccgcggactgcgtgtcgtgaacagaagaagcgcgagacgagcctaacgctcggccttccatccatcttcacccggaaccacgtggtaggaatttcgctcagccatttaatgacccccagatgttgctgatggatgcaatgtatcaaaccgctccgacaatagcatcggggatattcccagccacttttgcatttcccagtcctgtcgggcagaccaatgaggaacggaatcaagcccgtccaaactgccgataatggaccttttcgtcaagcaatcgtgttcccacctgagcagtaaacaaccgtgcctgcaggggagggttgcacccctgtctggcgtggcgcaggtactggtaggcagtctgccggctgatcccgtagtcacgggcaaggacggctttcggaaccattgccccgcgcgctgatccggctcgtttgactgaaggccctggttttgcgcagaccgcgttgagctttgatagaaaggacatcatggatctggacgatctccttagggcgctgaatgcaggccacaccatcaccggggactcgccattgcatgcggtcatgcaccgggtcagccaggatgccctgcggatcacgggcgaactcaacgatggatatcaggagcctgctcgggtgcgggagctgttagctcagctgacgggcaaggcagttgacgaatccgtgacggttttcccgcccttctactccgactttggaaagaacatcaccttcggtgagcggatcttcatcaattccgggtgcaagtttcaggaccagggcggggtggttatcggggatgactgcctgatcggtcataacacggtgattgccacgctcaaccacgacctggcgccgagccgtcgcgcggacatgcaccctgcccctgtcgtcatcggccgcaatgtttggatcggatccaatgccacaattttgccgggtgtgacaattggtgatgatgcagtcgtggcggcggcgtccgtggtcacgaaggacgtaccggcaaagtccattgttgtaggctcgcctgcacgagtagtgcgctcactgaccaactgacccgtgctggtattcgttgtatcgagttaactgaacgcctgcggtggtcgatggcggggaaccgcccttgcgggccgctaagcgccgcacccgtcaaggttcctcggaggtcgcctcgccgtagcgccgagttggacgggtggcgggcagcgcggggcaacttgcggcgccagtcttgcgtttccataggctacgcgaaattcgacgcgataaccttagtcggtgtcagaattgcgcccaaattccaactattgacagtggatcatgatgttttcagattccaccctgacagtcgtagaggcaggaaacccggattcggtaagcccgagaatcatcgaaatagtccaaagaatcgggacttgatggaaacccttccggcagggatggcgatgacgccttttccgactctccggtgtccagaaacaagtccggagctccgtcgacaggccgaattctccctggccagaccgccccgacgtcaggttggggtgtagctcaggctgacaagctgcagtgcttagaatcaacgagtcgtatgccagcggcgacataagccctgttagcctgcgagataactctcacgcggagaggttttcctcagcgcaaggattgtgagatcaggggaaacggcgtcgataccttcccagcggccgtcatgcagacagaccaagccgagctctgccaacctgctgacgttaagctagtcattcctcgccagataggtttcgatggcgctttgaaggtcggccagctgggcatacgacatagtccacactctcccaacttggggatcctttttaaaggaaaccttcacctcgtccaccgagaataacttgccgttgttgtcctctacggcgaaccatgtatcactcatctggtttttccttgttaagatcctgctgtcctaatctctcgggctgcgggaaactccgtttttgtgcagtcgaagtcaggacgggtcccgtccaggagcatttaggcacggagttggctattgcggctccttccacggctgcttcaacgccgtatgcatgacctgggccagatggacgccatcaacaccggttccctgggctatttgggtacggcaggagaatccgtcagccaggacgatggtgtcgtcggcggccgcgcggataacggggaacaattccttctcgccaagtgtctgggagatatcaaagtggcctggttcgaagccccagtttcctgccagtccgcagcaaccgccgccaatgacggtggtatcgacaccaagcttggccaatacctgtagttccggcccgtagccgttcatggacttttggtggcagtggacctggcagacagcctgcgccgctcctgcttcgcctgataaatctgcgaacggccacggccctttttggtccaagtgggcggctgcgaacgcaccgagtgtggttgtcagttctgtaacgcggcgggcgcggggatcatcgggaagcagttcggtgatctcgtgttgcagcatgacagtgcaggacggttccaacccgatgatggggtagccggcttccagcaatggctccatgacgtcgagggtggaagcaagaaccttacgcgtcatgtccaattgccccgtggagtgccaagtcagcccgcagcaaacgttacccatgggcatcagtacgcggtaacccatggcttccaggacgtcgatcgcggccttgcccggcgcgtcggcggagaagttcgtgaaggtgtcgggccacagaaccacggtcctgcggtcgtcgacgtgatcaccgggacgtttcccggtttgttgccgccgccggaaccaggcagttagcggttggggggcgaaggaaatcatccgccgtttgggttcgattccgccgaggcgtttagtgagttcctcgacggggcggaaggattcaagccagttcacaacccggaacgagaaggggactttttccgtgacgcgcatgagcagtggcatccatcccatggtgaagtgggccattggccgccgattatcgccgatgaaggacttcagtccctgcccgtaatggtggtggaggaattcggctttgtaggtcgccatatcgacattcacggggcattccgtggcgcatgccttgcaggacaggcaaaggtcgagggcttccagtgtttcctttgatttccagccgtcggtgattgtttccccccggagcatctcggccagtgagcgtgcacgcccccgggtggaatgcacttcgtcccgtgtcgcctggaaagacggacacatggcgccggtgtcggagcggcaggcgccgacaccgacgcaccggttaacggctccggcaaaggacccttcgtcacgggaaaaagcctgcaccggccgaaggtcaaaggtgcgggcgcctggtccgggcctgattccctggtcgatgggttccgggttcacgagcacaccaggattgaacactccgtcggggtcgaagacgtgcttgaactcttcgaaggatttcagggtctccggggagtagatggtggctaacagttcggaccgtgcgcggccgtcaccgtgctcgccggaaactgacccgccatagctgcggattagtacggctgcccgctcgatgaaggtgcggtaggcggcgacgccggtttcgctgttgaagtcgaaggagatgcggatgtgcacgcagccttcgccgaagtgcccgaagggtataccggtcagtccaagctcgtgcagcaggtcgtagaggtcacgcaggtactcgctcagccgggccggcggaacagcggagtcttcccatcctggccaggcttcccctccctcgggcaggcgcgtgacgatgcctgcgccggcctctcggatattccacagcactctcgcttcggccgcgtcggccacgatgatggagtcaacgacgttttccggcaccaggcccggaagttcttgtgcgcgggcttcggcttcttcgagggtgtccgcgccgacctcacagtagagccagccacctccgcgcggcagctcggaaccggcgaactcctggccgggccgggtttggagcgcttcgacaaggtctgcgcccataccttccaccgtgtagacgcccgggacccgaagtttcggtgccgcggcggcggcatcgaagacatccttgaaacccatgactgccagggcagtatgagcgggcttacggaccagacgcaccgtgagtcgggtgatgattccgcatgttccttccgatcccgcaaaggccttggctacgtcgaatccgttttcactcaggaggtggtgcagcccgtaccctgagacctgacggggaaactggcccagctcggtccggagcattgccaggtaacggtcgcgcaggtcggtcagggcaaaagtgagctgttcatcggaggtgccgccctggtagaggtccacttcccggccgtccgccagcatgaccgtcagtgaaacaaggttgtcagcgctgctgccccaagcgatggaatgtgatccgcacgcgttgttggccaccatgcctccgatcgtgcaccgggagtgcgtggagggatcaggcccgtacgtgagcccgaactcggaggcggccgtccgtagctggtcgcagatcaccccgggttcaatggttgccgtcatggcctcggggtcaatggacaggatgcggttgaagtgtctggaggtatcgatgatcagcccgtccccgatggcgttgcccgcaacggaggttccgcctccgcgggagacgaccggccagccgcgctcccgcgccatggccaacagctcgcggatctcctgcaccgtgccgggttcggcgacggcggccggcagtcggcggtagatggaggcgtcggagacgtaagcggcgcgggtcgtgaggtcgtctcggatctcgatcatgggtcctatctcaggggcacgtagttctaaaggctgcggacggaaaacgtcgtcgaggttctgccggtccggaggggaccggcagaacctcctggtgcggattaggcggacttgatccgggatggtgaagcgctgacacggaaggcctcgtcgaagaattcctgcacgcgttcgcacatcagcacgaactcggggtggtcccggtacatgaagtcgttgtgccggccctcaatcgtgtacagggtcttcggcgactcggccgcttcatacagaccgaccgcttcgtcgatggggtgaagggtgttgttcaccccgtgcgcgatgaacaggggggtcggagacaggtacttcacaacccgttccgccttcaaattcatgatggactcggtgaactgcagccgggtgggatgcccgaagccgtagacctgctcgagttccttaccgacgtagtccttggtcgccgggtccaggggatagtgctcgaaggtgtcagccagctttgactcgccttccagcacgcgacgggcgcggtcctcctttacctcatcgaggattcgggtccattcgtcataggtgtggatggacttcagccaccgctctccctcgtaaaagccgttcagtgcagccacgcccgcgacgctgcgttcctgttcgcctgccaggacaacgttggcagctcccatgccccatcccacgaggccgatacggtgatcgtcgacgtcctcctgggaaagcatgaaggtgacggcgttgcggatatcttcaacctgctgctcgataaggacggtgcccttctcgccctcactgtctgccatgccccggtaatcgaagccaaggcatatgaagccgtgctgcgtgaacttttcggcaaacagcttggggtagaactcgttgaatccctggtatccggagttgacgatcagggccgggtgcggcccggccgtggacaaatcatcggggtagtacaggctggcctggagacgcttgccttcgctgaaaaacgtcgtcttcttctcaatcattttttcctcaattcgttaggtgctgtagaaaacttttgttcttggagcccagccgctcgtgagctgagggtcttgggcctgtcagggggcgggtcagatgtcaaaggggtgcatcagaaggtcggttagatcctccagggggtagttcgtttcggataaggtcatctccgctatggcgaggcttctcttagggcttagccgtctgctgttgcggtagaactttgtgaggagtacttcgtcactgagtggggactcagggtctccttcggcttcgaccggcttcgaggaatgggtctgcccgtcttcgtaggtgatcttgatctgtgcccggcgtcttcccgggaattcttcgctcatcctcccggaggctgtcagccgaattttctgtgccaggcggagcgctccggattctttctggggagccaaaatatgttctgccgccaattccccgtggatgagcgaggaggccaaggcgaacgggaggctgtactgcgcctcttctgtgtccttgggcgctgaggtgtgcaggcgggtagccgcgtcaaaggtgatgacttctatttcccgaatgtcatccgcgacgaggccatttcccgcggtgagactcaagccggcctgaattgccgggtgggaccagcggcagacggggtagggcttgaagtactgctccaggattcgccaccgcacgcccaagtcccgggtttcgcgaggactcaggaggtccactggcgctccggtgaagccttcggaagcgaggaacgcggcgctcacgccggcccgggcgccccaggcggagctatctttgaccatggtcggatgtttgatggcccgcatcattggcccccgcggggccgaatattccgctatccctagagcatgatgggtcgcatcagttccgagacggaggagccgggcaccgacggcggcggctccaacagcattccacgcacccgaactgtggtactcggtggcagtgcggtgcaaggcgatccctgcgcgcagtgagacctcgtatccgacagtgagagccgtcagcaaatcattggccgttagtcccggtgtctcatccatgaaggccaggactgcaggcagaatggcagcgcccgcgtgccccttgacgagtcgatggccgtcgtgtccatccaaggaatcgagcgttcctgcgttggcaagcgccgcatcggcagctcccacccggctcccattgaaaagcaagcgagaggccctgttcgcccccccggaatgttccagcgcgtgccggtagaggatctgtgacaggtttgtggaagtacctgcggcagcgacacccaaaaggtccaacaggcacctttttgcctgatgtgctacctcggcagggaggtcttcatacgttgtgtgctgaataaagttggcaacggagccgtatgtggagcccacgggtgtgcctttcttttctgtgatcccggtttgagctggggaacttgagggcagggaggatggaacccgcgcggtcagggcatgacgtgcggagttctgccgggtgtcagttcggggtgaagagggctgtcggtgtggttgatgctgcagattcgagccagcggcgatcaagaccttcggctgcgagggtgtcgatgagcagcaggagcgcctcgggagggggaggtgaatcgggctgtcctgcatccgatgagaggatgagcctgctaccggcagcctctgcggcacgcgccaacatagtgggggtgcagcggggttgatggagcagctggtaggtggtgatttcggcgtatccgccgttctcgaccaacgttcgaatggctgccggttccagtcccggaactgtataggaggggtgcgtgaacatcacgcgcccgattccgaaaaagcgggcccgttcgctgagccatctgcattcgtccccgctgaggtgtccggtggccagcaccgcgtcgtggtcggcaatcagggccaggacggtctcgactgcttcaatgttccgcgtgtccacgggcggtatggcgtaggtgtgaggtccgatccggggttcatggttgcatagtctgggaaggtctgcggtgtgttgtgtgtgcgcatcagccgttggcatccagacgacgcgtcctccggcgcccaaggctgcggctacggcgctggggttgatgccgccgcagtgctggttgagtgcgatgccgccgtagacagatttgccggtgaggcgggcagctgcatgtgcccgccctactgtcgattcgtagtgtgctttcagcacaaaccctgagaagtcggcgaggccgtacatccgtgccacatcggtgtcgtcgccgatgcggtccagaacgtccggtccggcatggacgtggctgtcgaacatcttagaactcctcttcggccagccgggcggcttcccgggcaatgaggtctgccctgggttcctggagcagcggccactgccggcgcagcaaacgcagctcctccaggtccaagtcgcagtccagctctccggcctcggaacctagctggcccatgacctcgccggagggatgaatcacccgtgacccgccccagaagtcctgcccgttttcttcgccgcaacggttcacgaacaccacgtaggactgcagcgccacggcggcgtggagcaggagaatttcccatgccctttccgtgggaaggcccacgttgctggtaacgctgttgaccgggaccacgaggacctcggcgccactgtgcgctgcgagccaagggataaccggttgccaggcatcgttgcagatgagggtggagattctggttttgggcaggtcatagcagtgcagtgttccgccagggcggaagtgcttacgttcctcccaggcccggtacgtcggcagaaacatcttgcgctggatacgcggttcgccgtcactcagcagcgctgcactgttgtaggtgtggtgacggaatgcttcggcaaaaccgacgactgctgccggaccgtacgtccccaaacgcagcagcctgtcatcgccaggggaaagcggcatagcctccggcacttcactcagatgatagccgtgtgttgccagctcgggcgcaactacaaggtcccggtcggaggcggccttcaccagggagtccagccgtgtcaggttgccctcaacatccccaaggacagggtccgtctgcagaaggcggactttcagtacaccggtgtcagctgtggacgagacccgtgtttcactcaccgacaaaccccttctcaaccagccaggtcttggcagtttcctcgggggtacccccgtctacgtccaccttggcgttgagctttcgaagcgtctggtcatccaaggcctcggtcacagtggccagcacatcgcgcagggccggagttttctcaaggacgtctgcgcggaccgacactgcagggttgtagggcgtgaagtactttttgtcgtcctcaaggacgaccagatcgagtgcctcgatgcgtccgtccgtcgcgaatacctcaccgaagacgcaaggagcggcagtgtctatggagttgtaaattgcgcccgcggccagttcagatacgttgttctttggcagctcaaatccgtagctttcctgcagtcctggccatccgtcgttacgcccgaagaactcggcggcaccacagaaggtagccttcgaagggtcgctgttcgccagggcagcataatctgacagggtcttggttcccagttcctcggccttctcacggctgacagccacagcgtaggtgttgttggccggggaaggttccagccacttaactgagttggccttttcgtcacgttccgtcacggcctggtagagctcctgcggatccgcaattggatccgtctcaccaagatgggtgatccagcccgtacccgtgtactcccagtacatgtcgatgtcaccgctgagcagcgcggaccgaacgctgcttgttcccgacatcccgcagctgcggctcaccgttgcacctgtcgattccaaggcctgagctgcgacttcgcaaagaatcagctgctcggtaaattccttgccgcccaccgagacctcagcaccgctcaggtcacccacttcggccagcgatccggcggtcacaccgctcggagcgctccctcccaaggcacaaccggagaggatgacgctgccagcgaccagaccggcggcaattatggttttttgacgcattgttatttccttttcgaaaggggcgaatttcaaaagttcagatgcctttgggggtcaggcggcgttcaatcaggccagccagccaatccaccagcagcgccagcgcgatggtcagcagacacccggtcagcaggatcggcatgcggtagaacacgatgccccgctcgattaggtctccaagccctcctgcgttggtgtaggtggccagagtggcgacgccgacattcaggatgagcgagacccggataccggcgagcatgaccggcactgccaggggcaactccacggtgaagaggatgcggcgggagttcatacccatgcctctcgcggcgtcaatcacgaacggtgaaacctgttgcaggcccacgatcgtgttcctcaagatcggcagcagagcgtagaccaccagggcgacgacggccatgttgaagcccacgccgtagatcagcgccagaagcaccaggatgccaatggagggaatggcctgacccgcgttagccacggcgagaacgggtgcccggaagtacttggcccagggccggctcagcaggattcccgcaggaacaccgacggcaaccaccacgatcgttgagacgataactaacaggacgtgctcgtaaattttgtccagaagtatctcgggtgtgagggcgcgggcttcgatgtcgtccaggtccgccgtcccgatataaatcagagtgcctgcgacaagggccaaggcgacggcgggaaggatccacaccgaccggtctttggctttgagctgcggagcagttgcgcgcatgcgggtagcgagggtactcaccgggtgacctcttgcctggtttgaccggcggcgaggagcatgtcctgcactgtcatggtcgcgccgcccgagaccgtcacctgggaggctccctgcatgagcatcctttccaggacggcagatacggactccgtcggctcaacgacaagctcggcctgcggcacgccgaaaccctccggtacatcaaggtcacccacacggagcagggacaggcgacgcaatgccgcgccttcgccaatgaaggagcgaacgaaatcatcggctggattcgtgagaatctccaacggagtggcgaactgcgccaatctggagccttcagcgaagatcgcgatgcggtcacccagccggagcgcttcgtcaatgtcatgggtcacgaagacgatcgttttgcggatacgctgctgcagctgcaggaattctccctgcaacctgtccctcgcgatcggatcaatcgctccaaagggctcgtccatgagcatgaccggcgggtcggctgccagtgcacgggctacgccaacgcgctgctgctgcccgccggagagctgttttgggtacctcgaccggtagatggaagggtccaatccgaccagttccagcagttcatccacgcgggctgcgatgcgcttcttgtcccacccaagcattgacgggacaaggcccacgttctgaccaatggtcatatgaggtatgagtccgacctgctggataacgtagccgatatggcggcgcagctcgtccgggctggcgtgtgtaacgtcctggccgtcgatccatatttgtccacgggagggttccacgagacggttgatcattcgcagcgtggtcgtttttccgcagccggaaggtcctaccaggcagatgaactctccgcgttgaatttccattgtcaatggcgcgacggcgggggatgcggccccttcgtagtgtttagtgacgtctaccagccggatcatggtgtcggggccggccgtggagtgggtaagggtgtcagacatgaagacctctcggtgtagagatgcggccgataacgatgaagagcacatcgaggattgcggcgacggccacaatcgcaaccacgccggcaagcgcttcgttgagtgcgttggcgccgcccattcgggacaggcccctgaaaataagttcgccgagcccgggaccccggacggctgcgccgatggccgcgatggcgaccaccatgatggtggcaacgcggataccgttgaggatcactggccacgcaagtggcacccgaatccgccacaaacgttgccaggagcccatgcccattccccgggcggcatctatgacgcccggatctacggtttccagaccagtgactgcgttgcggaggatcggaaagacggcataaacggttagtgctatgaccgttggcactacacccaatccgaaaaggggaatcatgaggccgaacagggcgaaggaagggatggtgagaatcgttcccgaaacggacagcgctgctttgcggaacgagggaaagttttcagtggccacggccagtatgaggctgatgatggtggcgatcacgaccgcgatcaacaccacttcgatgtgttgcatcagcaggaaaatgatgcggctcgaattgtctgcgacgtagtcaaagaagttcatgaaacccttctaacttcgtcgcttgacccggtttgggcatgttgtttttccttggatatagacggagtttccgcaggaggcgatgacaaagagcgactcaagtacagcgctgcctggcttatctggcgccctgcgttatgcaggttgttgttcaagcggtaggacggtgccgacatgttgatggcagcaacaatgcgtccatgaacatcccggactggcgcggcgactgccgaaaggccgtcctcgaactcgtcgaccaccagcgcatacccctgcacgcgggccagcctgaccctatcgatgacttcttcgaccgtcgctggcgctttcgggcccgggccggactggaaggtgtcttcgagcaggtcgcggatttcctctgcgctgtgatcgaataaaagtgcccgccctgacgaagtgcacgtgatcggagtgctgcggcccacccatcccacggcttcaatggcccgttgcgggccctcagacaagatggtgaagacctcatcgttgcgtcggacacttaggtggacccgctccttcagcaagcgcgtcaagtgacgtatgaccggcggagccagaaggagcaagcgttgatctccagcctgtgcggctacggcgaagagcttccacccaagccggtggagcccgtcagcatcgcgttcgaccagacccagatcgaccaacggtttcaactgacgggaaacactcgacttatcgcggcctaatgaacgtgccaaggcggtaacggtggaacccttttctccgtcctgacccgcctgcgagagcgcctccaggatcgccaacatcttggcggcggctgtgtcttgggtctcgttcatggtgaccactctccgcgaagcgatgcgttaaacgcaatgcggtgttgcattttttgcaacaggagccggggaaaagcctcaaagttaggaaagaagcacgtaccgagtagcggctgggtgcctaggctgcatttagcctccgcgaccttacgggacgggaacggcctaggacaaccttctccgttcagccggtgtagctagcttctatgccgtcacactcagttggggtcaattgggttatccacggctggaaaccgggagccgtcggggtagttccccttgcagcaggagcggtggataacccgtaggaattgtcccccgggtgtgggcggcggcgggaccgagcctctcagtggacccagatccaaggccctctttctggactgaagccaagacgccctgtgtcaggttgggtgtgcttgcgtcgaacgcgcgccgcgccgccctggaattggcatgacttcaactttggaagaaggtagcggggtttctccggagaggtgggtgacgattccttttgcgaggtccggcagcgtcttatcgatggcctgcgacgcgtttgtcaggatggtcatggcctcgttttggctgcagcggttctgggccatgattatgccgcaagcgatgctcacgggtgtttggctttgcagggctgaccttagctcacctgcggtgtcctgggcggccttgattttcatcacgaggcggatagcttgtgaggctgcgtctgcgaaggcaggggtttcttggatcgtctggtcgtcaaagaccggcccagaggcgaaaaaattgagtgcggctgtggagtctttgccgatttgcaagggcacgccgagaacgcttcggcagttctgggacacgagctcctgccggtaggacggccaacgggggtcactccagacatcttccaggagcaccggagcaagggttcgcagggcttctacgcaggggccttggcccatgcgctgcccaatttggtccagacggacagcgcgcgggctgctcctggcgacagtaacgcgccggcttccctcctgaaacgtgatgccgcaatcaatggtgctccgggtacgtccactcaacgtggtggcagcgacacccgaaagaccactaagaaagtcctcgacgctttcagcactgatcaggaggttctgaagctccactatgggcgacggttgtccaggggtcatggccatgcctcaacgtaaaccggagctgtgtcatgggcaatccctgccgtcaatccaggggacgggatcatcaccgtaacgtccgtgcgtcaatgtcattttggacgatggctgcgagggaccgaagtaccagctcgtcagatgaagaaaacctcctgggtttctggtcaatgacgcataaggtgccaatgttccacccacgcggaccgtgcaagggatagccggcatagaagcggatataagggtccccgacgacaagtggatttgaagcgaactgctcatcagtcagcgtgtcgtttataaccagcatcgagtcccgcctgacggtctctgtgcacagcgcgatttgacggggggtctcctcccggagagggccgacaacggacttaaaaaactgggcgtccttcgcgatcagtgacagtgaggcagcgcctacgccgaagtagtctctggcggcatttactgcgcggtcaaaagtttcctccgggcctgtatgaaggaggtcagtttcccgcaaggatgccaaccgttcctcctccgcccgttcaggggtgagaaggaacctgcccgccgctcccaacgcagccaagatatcctcatcagcccttttcgacacaccatccggctgatctgatccgcgcgggttggactgcggcggccgccaccctgccctggcttccttctccagcgggtcagtgccgtgactgtgttcaaagtcgggaagggcgaggacgccatgaaggtaggcgcgcaactcaaactcagaacacggggcctggccgaaataggagggccaaagaacccgcggttgcaggccatcaacgaccagtgcggcgagttccagccgccgcttcgccgcttcatccatgcttttcacctccaacctggcagggctcctggctaccccagcttttgagagtgcaagaagtcatggtgataagtgtacttattacttcaaggaagcagggcgacgattggtgacgggagggagggttacctactcggaggaacagtccggtccacgacgggacgtttcggactgggcgctgattcgttgtcgcccagtcttgaagttcgctaggaatgtcaccgacaactgaagccaggccaacgagcaaggggcgtcgtcagccccttttgcggccgatcccctgcctcttttaatgagccgatagcttatatttcgtaaacctggccgctaggggaaatggctgccccggcgtgactggacagcgcaggcgccgggagatagcttcagggcagcacctcctggtgccgccgccgcatgccccttcaggggatggcggaatccctacgtatcgaaggtgctgccgtgagtacaacccatttcgatgatttcgtcagggatacgaccaacagtgacccgggcagtgaaaagggtttggattcagaagagcttttcggtctttacaccagctggtgcatactcaacgcatgtccacaggaatccgcagacaccctctggcaggctctagtcgtcaggggcatcgtccccggacacaacacccttgctatgacagggccggcggctgcggactacatcctctccagcgcgcccggccttgtatgaggatcgcttgaagccctttgggcttgtccggcacgcccgatctgcggccttgactgccaccccttactgggcctcccccagctctttttgaaccgccgataatggaccttctgtaaagctggtcgagtagggggcgttctacagggccactgagggacatccagttcggggatcagcttcgcgcaagtcatttccggcttgggcgtagacgcatttcttgtaccttaaggtgggttagtgaatgcgacagaaactgaggaagtaagccaagatcccagcgtccgcggcgcaaatatggttgatctcgttattggttcgccagagtgggtccatcgccgggtggacactctcaccttgggtacggatggggatacgcagcgatccatctctctcgatataactcttccgcagagtttgaaggttgaggcttccggaaagcgagtcctacttcctctggccttcattcgcaaaggggctttgaggcgagtgagcaccgcgggcccatccaagcacccgtttcccattcttgaaaaggccaggaattccgagatagcccgagagatgctcttgacgatgatcccggaggattgggttagcgggcaggagtccaaagtggcggctgctgtcgggctaatcgtaaggcacgatggcgtcgaatctggtaatcccgcgaagcaattgaagaggctcttaacttcaattacgaagtcacgagaggaggacgctgaacaggttcagacgatctcggacctagctcgaactcttcaaactcactttcttcttattggtgaactcgacgagatgcacctggataccaggtgcatcataaagatctcctacgagcacgaacttgagttcgacgacgggtgggactattccaccgtcttccgctatgatctgcccgattacggcttcgctgccagcgagcacgtcgaggtggtcgtgccctctgaactcacacttcgaatcgtgagcttaagcgagaccggcggcgacgggagtagtcctacaaatgaggatattcccacgacggagagggcgcggggccacgttgcactaccgccgactgatcgctttactgaagcatcagtggttgttgaagtcgccccctctaagaggggcatttttccttttgcggccatctcggtggctgtttgtaccgctgtcgcgggactcgcgcttatggagcgctttgaggtcctaaccatcgtggaccgcagccgtgacattcccactacggcagtttctctacttcttgccggcccggccctgttcctttcttggattgcgaggaccccggagcatgagattgtcgcaaaactgcttagtccgctgcgactctgtttgttgatgtgtgctgccgttttcttggggcttggtgttgtcgcagctttccctctcactcgtgaggcctgggatgtcgtgtggcttctgatttatggcggagccttcgtgtcgctcggatggttcgtggccttccgcttggcgctgcgcagaaggttgaccaaggccctagacttactagtaagaagccgcaagaagagcgaaggaggaatgcgacgatgaggcgctctgatcgacatctagccgaaaagctggctcgaacacgtacacctgccgttgaaattgtcatcgagtccggcgcaggttccctacttggcccgagcgtaggcaagcggaacattgaggccactaggcgggggctcgccgccatccgccagacggctgctacgaggcgagagaacgccaaaaaagccggcgcatcttctaccccggccacggccatgtgggaaaacgcctaatctagtcgttctggaactttggggggcgccatgcatgcttgtcgcaaacccaaacattcccccgatcaatctagtgtcgacaagatggcatcctgccagtagtaggactcgctgagtcaatgagagacagcagttgccgtcggacgatcagcacacaggctgattaggttcttggcctctggcttcggtccagcgccccgtggctcttcatgaactatgaagagtcggcattcctgccgtgaaccgttcgctggcagaacggttctgacttccgcgtttagggaaaacgcgaagaacgacggccaggaaacagccccttcttgggacactcccccacgcaatttcggacgccgataaccgacgttatgacaagct

SEQ ID NO: 39 - DNA, 4841 bp, Arthrobacter sp. OY3WO11
ccaggcaccacgggaaaacgcggaaccaggctgcacaaaatttgaaaccagctgtaaaaaccagacccaatccacggggtggacaggcccagccaaaacaaccaatcaataaaacaattggtatcaacaaacttggcacactattgagttctcaaacaacagacacacccggcaccaccacagcctcaaaccagccatggatcgctccggagcaacttcacaaacttacccggtttcaaggagctttgcaaatcggcgctttcgcgattctcgctgctctcaaccagccccgcccggatccggcgcgccaacaggcgaaccattttcaggctgttcgtaagggggtttggccgctatttttccgcttcagcggcggcgactcagaaaacaatacacgtccccaagccggtccgcaaatcctgcggggaaagagcagggtgcctccaaaaaccccgcaatgcaggggtttttggaggcatctcacgcgccctgaccggtcaactcggcatcacgtgacggtatggactggctcacatatgtccgctccctcagctgcgcaccttcagtgtcagcatgaagtcggcgtcccgcggcttgaggcggtactgctccagcacgccggggccgcaggcagcggtccccaccccccgcagcgcgtggtccaggtacaggtaggtgcgtccgtctgccttcaagtccgggcggtgggccgccgcgtccagcacgtcctggctgtagggccgcactgtcagggcaaaggggtcaccgcagatctctagcgtccggccgccaagctgcagtgcagcggaccgtgagcccgaccgggcaccgcattcctgcggccgcacgtattccacatccagctccgccaggggcagcgagaaccagccggcacgcgtgccctgcccggtgtccgggtagctctggtgtgggccctggccgaaccagctcaccgaatccgtctcttcacccaggacgatttccagccctatccgcgcccattcgacctcgaagccgccgttgacccacgtgccgtcacgccggacctgggtccggagccccacggtttccccgtccgtggtccaggtgtactccacaagcacgccgtactgtttgtcggctgcgctgacgcgcgtgcggaccgtcagggcttcgcctccgccctgccttggggtggcggagatgtccatcagccgggtgtggaggcggttgagtccggcatccttccactgtgtggccagcggtcgctcgtctgcgccgccccattcgcggccaaggtcattatcggtgggggcccaccacagggtcagtcccagcttctccaccgggacgccgccaattgaggtgggcatgccggtggcgcggctgaagaccaccggcccaagcgtgagttcgttgtcctgcacctgaacggtttcaacaggcggcggcgaaacgggagcgttcggctcccggaccgattgcccccatgcgatttcgtgtcccgcgtccgcccaggcggaatcagcgccaaggaccgcacgaatggtgagcactgcgggccggccatcggacaggcctgcggccaaagcagcgacgctgccaggcagctccacaactatttcggactgaggtgcaacgggcgcaacgtccaccatgccgccgtcgagagtcccgccgtcggcctctacttcgtagcggaagctgaacgcggacgtgtccgcgaagtcctggccgttgcggagggtgaagctggaccagtcgcgggcgacagcgatgcgcagcggctctatgaccttcttgaagtccagcagcccgggccggggcttacggtcggcatcaacaagcccgtcggtgacaaagttgccgtcgtgaacttcctcaccgaagtcgccgccgtagccgtaatggtcaacaccatcagcggttgagactgtgatgccatgctccagccactcccatacgaagccccccatcaggcgcgggtacttctcgaaaagatcctggtactcgctcatgccaccggggccgttacccatggcgtgcacgtattcgcagaggacaaagggcatggcccggcgccgggtgtccaaggcggcatcgtccagggccggctcgatgccctgtccgatcagggccgtctcggcatggctggcgtacatccgcgagtagacgtcaacgtgctccgaggaccagtctccctcgtagtggatggggcgggacggatcccggtccttggcccaccgcgacatagccgcgaggttcctgccggtccccgcctcgttgccgagcgaccacatgatcaccgcggggtggttcttgtcccgctccaccgttcggcgcatgcggtccaccagcgcggtttcccatcgggggtcatcgctggggttctgcgcccagccggcgctctcaaatccgtgcgtttccaggtcgcattcgagcacaacgtagaagccaagctggtccaccagtgcgaggaactccggatggggcgggtagtgcgacgtccggattgcgttgatgttgtgctgcttcatgagccgcaactccgcctccaccacatcacggggaaccatccggccaaggcgtgggtggtgctcgtggcggttaaccccacgcagcaggatccgccgcccgttgaccttgaactgcgcgtcctcgatggcgatgctgcggaagccaatctgcagtgctatggactcgccggcggcgctgacggccgcctcgtagagccgcggcacctctgcggaccagggttcgacggcggggacgcgcacttcggtgccggcgggcaggtccaggttcagctccggaacgcggacgacggcgtccgtcgcctgtccgccccgggtcacctccaccttgaggatgccttcgcctgtggtgtggtcgtagccggcgtggacgaagacgtcgtcaatgccggcgccgggcctggcctgcagggtgacatcgcggaagatgccgggaagccaccacatgtcctggtcctcaacatagctggcggccgagaactgggcgacgcggacagccagggtgttctctccctgcaccaggatcccggagacgtcgaattcgtgggcgagcctgcttccacgggtggttccgagttccactccgttcagccacacggttcctgcggactcgatgccgtcgaaccgcagcagggcatgcggaaagaactcgggcccggcctcaaacacaaccaggtggtcaccgatggggttggcctccggaacgtgcggcggctccacggcgaaggggaactggacgttcgtgtaggccggtgcgccatgtccgtgcataggccaactggacggcaccggcaggctctcgaacccgttcagcgactctcccagctgccagccatcatcaggagctacccggcttccggggctgagccgaaactgccactccccgttcagcgacaaccgtggagcgtcgctgtgcaggtaggcgcgggcgggcagggcgccccggcccgcctcaaaggattcgagatcctggatatccgcgacgccaagctccatgctcctaccggttgaaccgggggcggtgtgcggggtgctgtccgccggcgcggacggggtttcgacagacatgggcttccttgcttcggggagtctggaaatacgtgaacgttcacgtgctgcatgcaaccctagcctctattgcgtggtttgagtagggtcaggccgactggcgaaggacgagctggtgcttgaggaccagctcgctgtcccggcttcctgcctggatcctgccggacatcaaattgtccaccaggtcgacggcggcccgtcccaccgctctcaggtcgagtgagagcgtggtcaactccggcgtcaccagctcgccgagtggtatgccgtccatgccgataacggcacaatcctccggaaccctgcggccggcgtcgcgcaaggccttgagcgcccctgccgccatgaggtcgttgaacaccaggagcccgtcaataccaccttcgtccgcaagcagggagcggactgcttcccgggctgcgtgggcggagtccgctgactgcccgaccgtaagctgaatgccggcacctgctgccgctgcagcgacggccagcccgcgggtggtggcaggcccttccaggtccgcatcaaggtaagcgatacgccggcaccgtgcagactttaggcgttccagggccaattgtgccgcgtacgcgtagtcgaaagagatgaggccggccgactggccggacggataatcgaggaccaccactggccggcggcccatcatggactgggcttcacttgagctggcacccagataacccacgagggcgtcaacctggggtcccagccgggcgacggcgtccaatccgcttccgcttccgtggccaaaatcatcaaccaccacgttccagccccgttgtgtggcttcttcaaccacgctggaggcgaaggccggaaagtacgggttggtcagatcagggatcgcgagtcccagcgatgtccgtgcgccctgtaccagacccttggcgaagcggctgggggaatacccgagttctgctgccagttgctggacacgctcacgcgtggaggcgctgattccgggcatgtcgttcatggcacgggtaacggtttgccgggaaacccccgctgcggccgccacgtccagtatggtcgctcgacgaacctgggggccgctgtaactcgaggtcatggctgcaagtctaggctgaagccgccggcggacggcctttgacctatttgccggctcatccctgcgacgctctctcaggtgatgtggggtttccaggggggtctctcacgtggggctggcattatgtgcgagagggtgccggggttggccggggggtcccgggg

SEQ ID NO: 40 - DNA, 55345 bp, Bacillus subtilis WAUSV36
gttcacttcgttcaagcgactttattattataactcgttgactcagtgaagtcaataactttttttgaagttctttttttcgttatcgccttgtttagcggcaacgaataataatataccacctagtaaataatagtgcaatagtttttttgaagaaatactaagggatttaaaaagagcggcatcctttccctatggaggataccgctcttttttattagcgttgtctcatttgcgggaataacagcacatcgcgaatagaaggggcattcgtcagcagcataaccagacggtcgataccgatgcctaaacctcctgttggcggcataccgtattccagagcttcaacaaagtcttcatccattaaatgagcttcatcattaccggcttcacgctcttttaattgcgcttcaaagcgttctctttgatcaataggatcattcagctctgtaaacgcgttggcatgttcacggccaacgataaacagctcaaaacggtctgtaaaacgcgggtcctcagggtttttcttagcaagaggagaaatttctacaggatgcccgtaaataaacgttggctgaataagcgtttcttcaattttttgttcgaagaattcgttgatgatatggcctactgtcatagagtctttaatttctacttcatgttcttttgcatattcacgcgcctgctcaacagtaacctcttcccagaaatcaacgccggtcgcttctttgactgcgtcaaccatatggattcttttccactccggtttaaggtcgatttgctcttccccgtattgaatcgtagttgtgccaagcacttcttgggcgatatgagcgacaaggttttcagttaagctcatgatatctttatagtccgcatatgcttcatataactcaatcattgtaaattcagggttatggcgtgtagagacaccttcgttacggaaaacacggccgatttcatatactttttctaaaccgccgacaattagacgttttaggtgcagttcgatagcaatacgcatatagagtggaatgtctaacgcgttgtggtgagtgataaacggacgtgcagaagctcccccaggaatgctgtgcattgtaggtgtttctacttctaagtatccatgatcatcaaggtaccttctcatagcttgaatgatcttgcttcgtgtaatgaacgtatgtttgctgtctgggtttacgataagatccagatagcgctgacggtagcgctgctcaacgtcttttaaaccatggtatttgtcaggaagcggacgaagcgcttttgtcagcaattcaaaggaagttgctttaacagacaattcgcctacatttgttttgaagacttttccggttacgccgataagatcaccgaggtcagaagacttgaagatttcatattggtcgtcaccgacactgtcttttcttacgtagatttggatttggccttctaaatcctgaagatgggcaaagccggcttttcctttgccgcgttttgtcatcatgcggcctgcgattgtaacttcaatcgctttttcttctaactcttctttggttagatcttgatatgccgaaataacttcttgagactgatgagttctttcaaaacgtgcgccgaatggatcgatgccgttatctctcagctgattcattttatcgcgtctgacttgcagctgatcattcaattcttcatggttatgctcttcttgactcattgttatcactccattacagatattgtttcatgaaaaaagcagaaaaactgccagcgtaaaactagcagtgagcagcaaatagaggtgagtattatcctacttttgcattttgaagctcttttgcctcaacttcaaccgtaaatgcatctaaaagctgtacaaactcttctctcgtctcgcaatgattgatttcattacgaacgttcgcattgcctttcacgcctttcagataccatgcagcgtgctttctcatttctcttaccgctacgttttcaccttttaagtcaatcaggcggtcaagatgcagtttgcatacggccattttttcgcgtacttgcggctcttcttttaatttacctgtttcaagatactgaaccgtacggtaaatcatccacgggttacccaatgcagcgcgtccgatcatgaccccgtctactcctgtctcatcgagcatacgcttagcatcctgcggtgtcttaacatcgccgtttccgataaccggaatcgatactgattgttttacttctttgatgatatcccagtttgccgttccttcgtacatctgcactctcgtacggccgtgaagcgccactgctttaccgcccgcacgttctacagcctgtgcatttttcactgcgaaaatgtggtcttcatcccagcccattctcattttcactgtaactggcttattaacagcatccactactgcagaaaccatttcgtaaatcttatcaggatcgagaagccatttggctcccgcatcgcattttgtaatcttcggcacgggacatcccatgttaatatcaatgatatcagcagttgtgttttggtctacaaacttcgccgcttccacaagggtttccttttttcctccgaaaatttgaaggctcagtggtttctcacgttcatcaatataaagcatacccattgttcttgcattgttgtaaaggatcgctttgtcactgaccatttcagcgcataccaatccggctccgaattcctttacagtcaatctgaacgcagagttgcagacaccagccataggtgcgagcacaacccggtttttcaattgaatatctccgattttgaacaatttttctcctcctttcatttgttctatttttctggcggcgccaattcgtccgcacttatatttaaaacatctgctgcatcttgaatgatggcagcagacggcaatcggtttccgcgttcaatttcgccgagaatagaaactgatatacctaatgcttttgcaaatccttcttgagtataacctttcagctttctgaatgcacgaattcgtctaccccagatttctgcttccatactcttacaccttcttggtctgtttcggcgcttgtagcctctttttcaacctgctggcaaatttccgcaagcggcgcaaggacaaacaaacgctcatacattctcggatgcggaacaattagttgctctgtttcaatattttcacgattaaataacaaaatgtcaaggtctgccgtccgcggcccccatcttacttcccttgttctgcctaattcattttctatctgctgcgtcagttcaaggagttcaaaagggttcaatgatgtcttgatttcaacagccatattcaaaaattgagcttgatcttcgtatccgaccgggtcagtttcgtaaatagacgacactttagtgactgtcaccgcagcatgctgatgcagtaaagccactgcttgccttaaatacgtttctctatctccaatattagatccaagtgcaatataagctatgttgttcatgacttttttctcgtaatttcaattgctactgatttatagtgtccgggaattggcgggtctggcttaatcactttcaccgtacattgctgaacaggctgaaattttccgagaacagtgccagcaatacgttccgccagcgtttccaccaatttcacaggctccccttccacgatatctttacatacgtgatagagctcagcatagttgatcgtttgctcaaggtcgtctgtctgtccagctttgcttaaatccagctcagcggttaaatcgactttaaaccgctggccaagtttgttttcttctgtgaacacaccgtgatatccgtaaaactccataccttctacataaactttatccatggtgcacccctcccttattcagcatcgcgtccatcattttcgccattctggcaatttgctttacatcatggaccctgacaatgtcacagcctttttgaatgccgagacacacagtcgcgcctgtgccctcagcccgctcctcaggcggaagatccagaacacgtccgatgaatctttttcgggaggttgccagaagaaccggatatcccaatccgctgaaaatctctagtttgttcatcactgccaagttatcgtgataggttttcgcgaaaccgataccaggatcaagaataatgttcttctcgtctactccggcctcaacagcaatttttacactctccattaagtccgacagcatatccggcaataagtcattgtagtttctttcagggcggttatgcatgagtacaattggaacattatgttcagctgcaacggaagccatcttcggatcatgtttggctccccaaatatcattgataatggatgcaccggctttcactgcttcatctgcgacagaagccttgtacgtgtctacagaaataggaacaccaagctctttcgtaatccgctcaatcaccggaatgactctggacatctcctcatcctcagatacgcactcagcgccaggccttgtcgattcccctccaatatcaatgatatgggcaccatcatcgatcatctctttcgcgtgcagcagcgccttgtccaagctgtcatattttccgccgtccgagaaagagtcaggcgttacgtttaaaattcccatcaccagcgtcttctctttatatgataaagcgctgggcttagtgtggattacttgtgtttgatctattgtgtgctgcgccatgctcttcctcccttttcatgaatcatgttctttatttcttttttgtataacaattgaagagcggaggttgcttctccgctttggcttccatagtttacttcttctattttagtaaacgggatgatttcaagaaccgagttcgtcatccacgcttcgtcagctgtcaagagagcttctagctcatatcggcccgttttgagctccaggccgatatcctttgcattttctatgataaaacgtctcgtgacgccgtccagaataccggtatcaagcgatggcgtatagatacagcgaccttttctccagaagacattagatatgataccctctgcaacagctccatcctccgttaagaaaattccctcgacacgcggatcatttccaatttcccgtttcgcatacatattatttagataatgatgagattttaaccggaacgatccctctggagtgtttctccgtatcgataaaacctttccttctttttgcaaaggaagactttctggtttcagctgattcacaaagcataaaacggtgggcttatcgtacgtctgggcgacaaagcctttatcgctgattcccgctgatatgttcagtctgacgcgggcattgccatccttgatatcatttagcttaagcagcttgtccagcatctcaaggatctcatgctttgaaacagtatattcgatttgcagatccttaagcgcgcgttcaagcctctctatatgccaatcaagcaaaaacgggcagccttcgtagagcctgaaggtttcgaaaacaccgatcccatataaaaacccatggtcaaaaggagaaagaactgcatctttctcctccatataccggccgttcacatatatcatcacgcaataacttccttgcgatatgtctcaataaaatttctgagcatttctttcccaaaggaggtcataatagactctgggtgaaattgcacaccctctatcgggaggtcattgtggcgaatagccatgatttctccttctttcgtttgtgctgttactgtaaaacagcttggcagcgtctcaggttttacgatcagcgagtggtatcgcgtcgcaacaaggggatttttcaacccttcaaaaatggttttgccgtcatgctcgatatccgaggttttcccgtgcataagccgttctgccctaacaacatcaccaccgaacacttgtgcgatggactgatgtccgagacatacaccgaaaataggaattttccctgcgaaatgtttaattgcttcgaggctgattcccgcctcatcagggctgcacggtccgggagatatcatcagaaagtccggagacagttcttcaatttcatcgattgtgatgctgtcattgcgtttcacaaccagctcttccccaagctcgcccaaatactgtaccaagttgtacgtgaatgaatcgtagttatcaatcattaaaatcatttctccgctcacctcatctaatttttgtctcttcttcgctcagctctaatgctctttgcatcgcaaaagcttttttgaatgattccttgtattcgtgcttcggaacagaatcaatcacaactcctgcaccggactgcataaatgcctgccctccggttgcataaatggttcgaatgacgatattaaactgcagatcgtgattatatccaaaccatcctatagatccagtataaagccctcggcgtgtcggctcaagttcttctataatttccatcgttcttactttcggtgcaccagtaatggttcctccgggaaacacagcatgaataatatctacagcatcatacccatcctgcagttcaccttggacattagacacaatgtgcatcacatgcgagtatttttcaattgccatgaattcatttacgcgcacagacccgtaacgtgatactcttcccagatcatttcgctcaagatcaaccagcatgacatgttccgcgcgttctttttcattgtgtatcaattcgtttgcaagcgcctcgtcttcttcatttgttttccctctggaacgggtgcccgcaatcggtctcgtctctaatagcttgccctttttgctgacaagcagttcaggcgatccgcaaatgatttggaaatcaggtgtttctaaatacgccatataaggagaaggatttacttctctcaaggttttgtaaatttgatatgggtggacagacagtgactgtgactgccttattgatagattgacttgaaacacatctccgctggcaatgtattgtttgattttctctacagcttgtgagaacccatcctcggtaaatggcgccgcgaaagaaccagctgtttcaggcttcatctctcgcgaagtgacagcgggaagctcagtcaaccacatctgctctaactcagatagcttcacatccgctgtttcctgatcagaaccattaacatgagtaatcagccatagagactcttcttgatggtcataaactgctatatcatcaaaaacaagaaaataaatatctggtgtttctaaatcatctaatgagagcattttaaaattttcaatgtaccgtgcgtaatcatagctgagaaacccgattgccccgccttgaaagtcagggaactcatgattcgtttctgtttccagtgttttaaaccagctgtggaaggcccgtaatggatcaccttctttaaacagcatctcatcaccatgcttaattgtagttattccgtcttttcctttcacagtcgcaattggatcaagaccggctatactatatctgccgcctcttgcactttcgagaagtacatgatgtttccgggattgcgcaagtttctcaaattgttgtaagaatgagtctttttgaaaaggtatttttttgcctgccggtctgcgttgtgccatttgtatcattcctctattttcttttttacttgtttttaattgtaaagcaatgttgttagtgaaaaaagtgaatttctcttccaagaataacattcgtcgcagacatggcatatttgatgcacgaaatataaaaaaactcccggcgaaccgggagttttggctttttttaatcgaattggtacagcggcgtgcttagataacgttcgccgttacttggaatgatggccaatacttttttgccttttccgagtttttttgctacttgaagagcagcataaattgccgcacctgatgagatgcctccgagaattccttcttcacgtgcagctctgcgggcatattcgaatgcttcttcattcttcacagggaagatttcatcatatacttcagtgtttaagatgtccggcacgaatcctgctccgattccctgaattttgtgggggcctggttttcctcctgaaagcactggggaatctgacggttcaacagcataaatcttgatggaagggtatgcttccttcagcacttcgcccgctcccgtaatcgttccgcccgttccgattccggctacaaatgcgtcaagctgatcatcaccgaattgctcaacgatttctttacccgttgtttggcggtgaatttcggggttagaagggttgttaaactgctgcggcacaaagtatccgtgcttttcagcaagctcttcagctttcttaatagcacctttcatgccttccgcaccaggagtcagcacaagctcagcaccatatgcgcgaagaaggttgcggcgctccatgctcattgtatcaggcataaccaaaatggcttttaatcctttagcagcagcaaccattgcaagcccgattccagtatttccgcttgtcggttcaatgattgtattaccggcttttaattttccttctttttcagccgcttcaatcatagctaaaccgatacggtcttttacactgcttccagggttcatgtattcaagttttagatatacatccgcactgttttcatctgcaaggcgatttaatttaacgattggcgtattcccaattaattcagtaatggagtttgctacacgtaccattctcgacacctcaatttccgactatttgtattggtattatgtatataatctatcaatttcaaaattttttgtcaatcacttagtacttttttccccataaaaccaagatacatcggcttctttccaaagtgtcttaactgtcgctttatcgcctagctgatccattgcgatttgccgtctgatctggtcctttacttcatcaaatgagaacgttcttgcctttagtttttctttcagctggataatggcatatccgttgctgacctttattggttcctgagaccattcatcctctttgagtgttttcgcctcttcaatgtatgctgatggaatgttgtctgatgcctctgtgacaaaacctaaatctccgccgtatggtgatgtatatctgtctgtagatctttcggcagcgacagcttcaaagcttgatccgcctttcagttctttcaggacttctcttgcttcttcttcatcttttacaacaatgtgccgaattcgatacgaatcatcaaactgatatagttccttatttttattatagaatgattccaattctttgtttgagatatcgatatcccttgttaacaaatcctcaaggaggatattataacgaatttggtctttccactctttctccgtcgtatgttcatcttcgtaaaaggaattattgaccgctttaatcagcaaaaactcacgatcaacttcgcttttggatattttaagtttgttctttttagccagctgctcaacaactcggacattgatcatatcttcaagcgttgacttaccatactgatcttccatttctttcagccattcttctcttgtcacactcttgcctccgatagtcgcaatagactcaccggatgacgatgcgccggcttgggatttcgtcagcgtatatgcaacagcaatacagcaaaccaacagcgcccctaaaataatggtccagattgttcttgatttcaaacctgctttcagccccttttctcaaattaaaaacccgctaaagagcttagcgggtagtttggtcacgaagcccttccagctcttcttttgtaaataagtacttttcattacaaaaatggcatactgcttcggcttgtccatcttcttctatcatatcttgaatttcttttttgcctagtcctaaaatggctgtttcgaaccgttcttttgaacaagggcaatggaatctgacaggcatcgtttccaaaatctcaggtttctcgcctaggacttcttctaaaatttcttctggtgtcagccctttttggatgagcttagaaatcggctctacttgagatagacgctgttcaatttttgtgattgtttcatcatctgttcccggcatcagctgaataataaagccccctgccgcaagaatggtattgtcaggatttacgagcacacctacgcccactgatgaaggaacctgctcagatgacacaagatagtaagtaaaatcatctcctaattctcctgaaacgatttctacttgtcctgtgaagaactcgcgcaaacctaaatcttttacgacacttaacgttccgtttgttccaaccgcacgtctgacatcaagcttaccttgttcatttaaatcaaaatgaacttgcgggttagagacataggctctgacttctcctttggcattggcatcagctacaatagctccgatcggacctccgccctcgattttcacggtcagcttatcatcgcccttcagcatagcgccgagcataagtgaagctgtcattgtacggcctagtgcagcggatgctgtcggccacgtaccatggcgtctctgcccctcatttaccatatcagtcgttctcgctgcataagcccgaacttttccgtcatacgcaagtgcttttactaaataatccattactaaacctcctatacacttcctacgcggtttctttcataaatcaattccagcccttttagggttaagaatggatcaacgatgtctatacaatctgattcgttcgcaatgagcggcgccaggcctcctgtcgcaatgacctttggttcctgttttgcctgccatttcattcgcttaacgattccttccacttggccgacatagccaaataaaattccagattgcatcgcgctaacagtgttttttccgataatattgtcgggccgggtgatttcgatacgaggaagctttgctgcacgcgagtaaagcgcctctgtcgaaattgtaatcccaggggcaatcgccccgcccatgtattgtttgttttcatcaatatagcagtacgttgtggcggttccgaaatcgacaacaattaatggattgccgtacaagtgtatcgcagcgacagcatttacgattctgtctgcccctacttctttcggattgtcatattttatatttaaaccggttttcatacctggaccaacaatttgaggctcgatatgaaagtattttgtgcacattctttctaacgcaaacatgattggcggcactactgacgaaataataatgccatctatctgttcaaacataagcccggagtgatcaaataaggagcgcaaaatcatcccaaactcatcttctgttttatgcctgcttgtttctatacgccagtgatattctaattttccatcatgatatacaccaagtacagtattggtgttccccacatcgataaccagtaacaacctctatcaccacttttgaatagtttctctactttactttttacaaacattctacaataccatacacgatcagcggctcatttgtaaacaaatcgataccagaattggatgattgtaaaagccgcagctgagccaatcatttacataaaaaaactgccagcgtcagccggcagtttttttagaaagaaagcgaattactctttcgtatcgtctttcttttcttctgtttttgtcagaatgtttactttcacatcatcgttcttttcatcatctgagaaattacgctcaggtaatgttccatgatcgataaggtgtttgatttgttcagcgtcaagcgtttcaactttcagaagcgtttgggcaatcaattcaagcttgtcacgattttcagtcaggatttgtttcgcacgctcataacattctttgatgatgcgctgaatttcctgatcaatttcgtaagcgatttgatcactgtagttctgttcgttgttgaaatcacggcctaagaatacctgaccgccctgagactgtccaaattgcaacggtcccagtttttctgacataccgaattctgtaaccattcgtcttgcaatattcgtcgcacgctggaagtcattgtgcgcccctgtgctgacttcaccgaagataatctcttcagcaacacgtccgcccaagaggccgacaattttatcaagcagctccggctttgtttggaaataacggtcttctcttggcagcataacagcataaccgccagcctggccccgaggaacaatcgttactttatgaaccatatctgcctcatctaaaacgagaccgataacggtgtgtccgccttcgtgataagccacgatattgcgttctttcttggagataacgcggctcttcttagcgggtccggcaattacacggtccgtcgcttcgtcaatatcacgcgcatcgatttttttcttgttttgacgagccgctacaagcgcagcttcattcaagaggttttctaagtcagcgcctgagaagcctggtgttctcatggcaattgattttaggttaaccgtttcatccagcggtttgtttctcgcatggactttcaatacagcttcacggccaatgacatctgggcggtccactgtgatttgacggtcaaaacgtcccggacgaagtaaggctgggtccaagatgtccgcacggttcgtcgcagcaatgatgataattccttcattagcgctgaatccgtccatttcaacaagcaattggtttagcgtctgttcacgttcatcgtgtccaccgccgagaccagcgccacgctggcgtccgactgcgtcaatttcatcaatgaagatcaaacaaggcgcattctttttcgcattttcaaacaagtcacgcacacgggaagcaccgacccctacaaacatttcaacgaaatcagatccgctgatgctgaagaaaggtacgccggcttctcctgcacaagccttggcaagcaatgttttaccggtacccggaggtccgactaaaagcacgcctttcggtattctggcgccgagctcggcaaacttgcggggatctttcagaaactcaacaacttcaacaagttcttgcttttcttcgtcagcccctgcaacgtctttaaatttgacgcgtttcttttcctctgtatacagcttcgctttactcttgccaaagttcatgacacggctgccgccgccttgagcctgattgagcaggaagaaaaacagaataaagataatgacaaatgggatgatggtcgtcaggaacgtcacccatccgcttgtttcttgcgcgggctcaacctttacgtctgtctttttcaaagcgttaaatatctggtctgctccctttccttcaggaacatgagtcaaaaagtattgatctttgtcgtagtttttcagctgcccttttacctcataaacacctctgacaggctgaaccgatacgctatcaactttcccgtcatccaggtttttgatgaacgtactgtacgacatattttctgttttcggatttgaggtctggaagtagctcacaaccccgattactactaataaaataagtaaataaaaaatggtattacggaagacccgattcattccttacctcctcccacagtaagcacaactatgttcaatagtaccatagaaaatcattccaatacaaacaataaccatctcggaagcaggctgccgatcagctttcataaactgccggttttaacactccgatataaggcagattgcgatagcgctcagcataatcaagtccgtaacccactacaaacgcgtcaggaacttcaaaaccgacaaagtctgctttgatgtccgcttttcttccgctcggtttatccaaaagggtaacaatcttaattgattttgctttacggtatcggaagagctctacgagataacttaaggttaacccactgtcgatgatatcttcaataattaagatgtcccggccctctacagatgtatccaaatctttaatgatttttacttctccagaagaaaccgtagaatttccgtagcttgatacatccatgaaatccatttccaaatatgtatcaatatgcttgataagatccgccataaaaggaagtgctccttttaacacaccgattgccaacggaaatgtatcttgatactcgctcgttaattctgcacctaactcttttactttcttttgtatctcttcctctgagatcagtactttctcgatatcatgtttcatcatgattttgcttgccccctacacttttcatgctgtctatattgtaatacaatgcggtcgctgtttggaatcacaagatcttcaaaaattgattttttcaagccaggtatccagataatttcaccgcttgcgtccgtcacaatcggccagttgtctctttcttggagaggcaatttcttatcaataaatatatcctttaccttttttgagccgttcatcccttttagtttgatccggtctccagcttttctcgtccggattgttaagggaaatcgcacctttttttcacttgtgataaaaacagcattcccatgttcttcaggcgagtccgcataatgccttgcctctatcagatatccattagggagcactgccgtttcatcagcagctccgctaatttggtattcaaagggaacatttttgcactgccattgttcaaatgtaaacaaacatgtctgatatgatttgaccaccttcagccctttcggaaagtccagtactcctgaaggaccgccattttccgcccaatcgagaaactgctgaatgtgatgggctgaaaaggatgatggaacgttttcataaagatagtttaatattagttgaactcctcttctttgtaaaggcatcgggagggcaagcaattgagaggaattgatttcaactgatgtattagactggcttgtgattactttattcatttcatctttcgttaatgactgtaagaattgctcatcttccgtcagtgcttcactcactttctgaaaccttttatgcacatccggagattcctgcttcaaaaacgggagcactgtttttctgaatctgtttcttgtgtagtcatctttggcgttgctttcatccgtccggtagctcaagccgttttcatggcaatagtgaaggatctcttcctttgtaatggttaagaacggcctgatgatccgccctgtcccaaaacgtctaaccggctgcattcccgcaagtcccgttccaagcgtacccttagccagtttcataagcattgtttcaacctggtcatcaccatgatgcgcaagagccagatagtccgcttggtgcttcgacatgatttcctcaaaaaactggtagcggcaatcgcgtgctgcagcctgcttattgagtcctttttcctgtgcatatgcggttacattgatttgagccgtttcgcacacgagctgttcagctttacaataagcttggacaaaacgcatgtcctcctcggattccgcacctctgaaccgatggtcaacgtgagctgcaataacattcgctgaacggccgcataacgtatgcaacgcgtgaagaagagccattgagtccggaccgccggaaacgcctacaatgattgtcgccccttttaacgtaagattgtgtttgtttaaaaaatctttgacacttttcacaatgtcctcctcacaatgagcaggtattttaaagatattcatatcctaacactttcaacccctccaagcaaagaagaagcataggctctgcagtttgcaccattcagattaagaaaaagataatataggcgaaataaagcgctaaaacactgatcacgataagcgttgtttcaaataacccccccgacttagccggtttctgttttggggtatatcgcgtcttcgttatttttccttggcgcggtttttgctgtctttgtcgtgtggcaggctgcggtgatgcttttataggctgttttctttgtgctgctttttgccccgcgtctagcatatcctttttcatttcatctgcggattgataatctccgttcaaggctgaaaaaagcgcttttttatacttttgaagcagcgggtttccttcgatgagagacctaagctgttctttgggctggttcgttttcttaaattcttttttatgcacactgttgatcataatcatggcaactgcgaacagatcataggatggctctgcctttcttgttccatacccccaatagcctctgtcataaaactccgtatactcttttatcgcccggccttcctttgtcgtgccgcccacatcaatgcagcggatccttgcgggcggaccagttacgatcagattatcaggtttaagatcgccgaatatccatccttgctggtgaagcaccgataagctggataacagctgaatcattaataccggtatccactctgctcctttatcactgacatacttcaaaagcagcggcccttttatgtattccattgcataaaatgaaactttcgtattggcactgggaatataggcatcatccgtatcaaaaaaagaaggccccatcgtaacggactgggcctttgagaaagatttcaagacattcacttcagaagtaatagacaggctgtcatcactcacctttaaggcaacatgtccatctgatgtttctgccaaatacacaattccattggcccctttaccaagctgtttacgcaatgtataagtgtttccattccacttgcctttgattgtcgtacccggcttgaggctacatgccaaactcgtcaaagcgtcgttcatcatctgccagcatgccccttcttgagcgtattttttcaaactgcagtgtcgcttcacgaatcgccggacctgtcggcgtgatgccgcctgtcgaaagctttgcaaagagtgtggaaagagattgcagcttcggtgtccagttcagcacaagctcgacctcttgttttttcccgggaaatatacacatcgcaaattcgttattcccaattcgggaattgaggcttacagacaaatcaatcagcgcctcttttactgttggaagctttggcgccatacttgcacttgtatcaacaagaaccaaaacctgaagatgcaccgtttctccaagctcgtctaccacttccatgacttcgccgcgtttttccggagaaagctcttccatttccacattctttccgagaatctgtttcagttcttgattgactacaccttgtaaggtttgcgtcatcgctttctttgttaccatttgaacagtttgtgaaagctgagatgcataaacgacttggtgcacgcctcctccggcaagtgcaatcccttcgacttccttcattgcctcagggtcaatttgattttcttccattataccaatgacatttaccgtaatcccctgctctttagcaaaagcagccattgcaagcgggtcttccccatggtttgagcagccatccgttatcagcaaaatttgatttaaatgtccgttgttcacattcattcctcctggagaatacgaggattctcagattcatatattcccatcttcgccagaagaaatttgatttatacggaagcgttatgaaatttcttgtttgttttgaaagattgccggaacaggaatggatgcccacttcggtgtattgtgatcaatccggacgacaacaacagtcatatcgtcctcaatttggccggatcttgtgcggatgacttcttccataagcaaatcggcaatctcctgcgggtcatttgttttcaaccctttcattttacgcttcatccataagtcgtgattttccacatgcttaggcccctcaaaaatgccatcactcatcataattaagaggtcacccgctttcagctgttcactcacaacctccacatcgaattcattaataataccgattggcagattgctcgcttgaactttcatgacctggtcaccccgtttgataaagctgggcgtcgatccaaccttcaaaaatttacagctggcatcttgaagatcgataatagataggtcaagcgtggaatatatttcgtcagttgtccttagagacagtatgctgttgatcgttttaattgctattttttcatcaatgcccgattcaaggattttttcaagaagcttgatcgtttcattgctttcaaagtgcgctcttgcgccattgcccattccgtcactgattgctgcagcatattttctggctccaagctccatcatgctgtagctgtcaccggagacaaggccgccgcccttcgcagcgtgagcagctcccgtggacaccctgtatgattttgttgatccaaaggcgacatggctgtatccattcggatgcggagagtgctgttcggctttcacaagaatttgttcctccagaatgtcagaaagcataggagcaatgattttttcactttctccatgtccgctgaacggaatggtcatttcaatatcgatatttccttgttcaagactatagatctcgacatgctgaatctcaattccgaaatgctgaagcgcttctatgatttgctcttcctgcagaaagtgttgttctcgctctctttttatttcccgagaaaagtcggccataacctcagaaacgcctaaaagctgttcagcaacaaggcgcctgctgtcttggacttttttcttgagtgtcaaatgggcatgatgatgtgcgagctcatcctcaatcagctcttcaacctgcttggatttagaacaatactgttgaaactcttttttcagccttcggtttgatgcatattctttttcctctgtttcaagcataacttgtttcattaagtcatatgttttatcaaagttctgtacccagcacctgtttttcttgtagcacgtctggcaggaatgctccgtgattttgcttaagaacagatcaacttcgctgtcatctgtctgttcgtctgatgcttgataaaaggttgcaaagctttcagacagcgcgtgaaatacattggagaattggtctaccttctgagcagtgacatcacggatttttctagcgtattgctgttgctcttgaagatgctcgacagttcccggaatatatctcgccactttcctcgtaatagattgaggtgtgagcaaaaacaggcagactgcgattaatgactcatagagcgttgtcatcagaccggcagagccttcaccatataaagatataagaagtgatccaacgatcaaaccaattgctgcacccgcttttttcccttccttcagcaaaccgcccaataaaccggaaaaagcaagcagactcatttgatataggtttccgatattcgccaagccaagaatcaggccggtcacaaccccaaccgtacagccgatgcttgctccgccaataaaggaaaaactcaacacaacataacgagccaatatatgttctgcctgcatcccttggtaggacaagccagccagccccgttaaaacagaggcaataagaatcataaagcaaatgatttcctctatttttaatgattgtttcacttttttcacagtaaaaatcggaaggctctgaaggaaaatcagtgttaagataaacgatagtccagcctcaacgatagccattacataatcataggttgtaaatacgccattttgggcataaacaaacccggctcttgctgcagccatggagaagaacacgacaatcgggagcgctttaacacgatcgtcggtaatgaaggcagccactttagaaaatacgaagaatgccagcaatgccgccagtatgagcaatgagtgctttggagatatggtcagcgcacctgcaagcacagccaaaaccgcataaaacgctttgtctcttctgataagaagcatcgctccaaagaaaggaagtgcgaaaggaagcacctcggataatatgaaagcccgtccaagcaaaaatccgatgacaacataaatgaatcctttatagaaaaacagtgaatgcaaatgatgagtcaccagcttcgtgcccctgttaaaaaacgattggagtttttccaaagcttgtcccgccattggcccgttcactcttctttctgctttttccattcctctcatctcccacctgttatattcgttgcctgtcattatagcgaaagcacagataggattttgtcaaaagaaggtaacaataccaaagaaatcttcgacggtttctgccttgatattcgtttatgaaaagaatttccggaatgttgtctaaaaatgaaaaaaatcggcttctgcaagagaaaccgatttgttaggatgacccgtacgggattcgaacccgtgttaccgccgtgaaagggcggtgtcttaaccgcttgaccaacgggccaaacaaatatggtagcggcggaggggatcgaacccccgacctcacgggtatgaaccgtacgctctagccagctgagctacaccgccatattgttttgtgcttctaagcacaagttatataatacaaaggtttgtctctttcgtcaacagaaactttaatgttgtaattttctgactcttaaagagaatgaggataataaaaaagcatccgtcgggatgaacggatgcttcatttattttatagaaagcagcaagttatcctcttcttgctccgcgccctccacgttttgattccgtattgcgttttaaagatgacaagcgatcttcgctgtcttttaaaaacttattcattttctgttcaaaagattctttcggacggaaatcatttctaggtctggcttgcggacggtctttagcttttttaatagataaaccaattttcccgtctttttcaacgttgatgactttcacttcaacttggtcgccgacttttaagtggtcgttaatgtctttgacataattatcagctacctcactaatgtgaacgagaccggttgagcctccaggcaattcaacaaatgctccaaaatttgtaatacctgtaattttcccttgcaacttgctgccaacttcaatcgacataaaaaaagtgctcctccttaggcttataaaaagatcgtttgcttaattatacctaaataaaaatttaagtgtcaacaaggctacttgctcttcttctccacattgaagataatttctccgtctccagacatgaataagtcccttctggcaagctctgtgacgtaatcctcatccttcaatttggatatttcttcttttaaatccgtttgttttgtctttaaacttttcagttctttttcaagctgttctttcttttcttcttttgcactaagggaagatgtttgggaccatacagagcttgccagcacaattgccgtcaggaatactagggcgccgaatacagttaaccgtctgtacagccctttgcgtcttcgtttcttcagctgattttgccgttctacttgttctttatagtcgttttgtatttcagttatcgttcgttccctggaaaaattcaaaccagacggtcctcctttcatctcttcaaaaaccgtgtgatggtcgttcttatggttatcaatagtttcttcttctttttgagaaatcctgcacctttttcaaaataacgtctaaaagttagacgcattttcacaggaagaagtttcaaacattgtttcgcgataaaacggatcggaaaacacagaaccatgactattttatatagacacagcaggagaaaacctatcaggctgtatgttttcttgaataaaaatgccgccagccagatgatcgctccgcatgtccacacaataggacgaaataacacgtgctgaatgagttttttgaagaattgataaacagaaacaacaaggtaaatgacgaatttcagtatttttatatagattcgtttgcaaaggctctgatacgtcgcaacgcccagcagaaccgctaaaaagatgtaaatcctgaattctccctcatttacatgaagcaagacataaaagaaaagcagcccttgcataatccagaaaagaatatcatgaataaataatagccatctggctgttttggcacgaatgacaaagagccggtatgtatcaagcgaagcaccaagccagagacccataccggacatcgctagcattgtatagaattgtgtcgtcagcgtcatttaaacaacttgctaaaaaaccctttagctttatccccttgttgttcgtctaagtacactaaatcaaataccctgcctttaatcgaaacaatccctttttccacatcaagatttttcatctgcaggttttggcctctgacggagagcattcccatcaccgtttccagcaggaattcttcgttatcaaaactctccacatgcttaaccccagaaatatctaaatgcttccggcctttcattgtcacatcatgctgttccggaacagacgaagaacctttttgatcataatatgaattcatctattcagcccccatatcctcgatacttttagcattattactgcattgtatgaggtggggggtttttttagaacaagcctattcgccgagtttttcttcttttagaatcgtgtacatgtttgcagcttcttcttttttcgtcgtgtctttcaattcattaacttgaaccgttacaagcttttggccgaagcggaccgttagttcatctcccggttttacgtcagagctagctttagcttggtttccgttaatagagattcgtccttggtcagctacttccttcgctagtgtacgccgtttgatcagccgtgatactttcaaaaatttatctaatctcatatctatgatctcctctcagtttcttttgcttcattccacagtttgtccatgtcctcaagggacatatcagccaactcgactccctcttccttcgctgtttcctcaatgtacgagaaccgtctccggaatttgtcattagtcatggtcagcgcttcctctggctctattttgtagaagcgggctacattcaccagcgcgaacaaaatgtcgccaaactcagctttaagattgtgttcgtgaggagcttcagaaacctcagaagaaaattccttcatttcctcacttaccttttcccaaatatcgctgacgtcttcccagtcaaaaccgaccttcgctgcttttttctgcaatttagctgctttcgaaagagctggaagggttttcggtacgctgtctagtaatgatgattcagatgtatttttttcggccttttttatatcttcccaattggctaaaacatcgttttcatcctgaaccttaacatctttaaacacatggggatgtcttcggaccattttttcactgattccttttatgacatcatcaattgtgaaataaccttcatcttcaccaatttgcgcgtgaagcaagacctgaagcaaaacgtcgccaagctcttcgatcatatggtctgtgtcttcttcgtcaatagcttcgagaagctcataacattcttcaatcatgtactgctttaatgactgatgcgtctgctttttatcccacggacatccattaggtccgcgaagctctctgatgatgcttcggaacgtggagaattcgtgataaagcagcttctcttctttaatcggcggaatatacacacttgttaagttgttcaaagcgacattgcggtccagctcaaataatggcactgtcctgatctcctcgccacggctgcctgctgcagtcacaatgacgacctcataatcatcaggcagcttctccatcaatgtcagcttgacttcagaagccgtcatttggtcgtaaacctgacatatgatcagatgatgtctgagctcaagctcatccgcggacaatgtgccggcatccacaaattgaaaaccttcaatcgggtcaatttgcaagacattgaatgtggcatcaaggaaactttgtccccccgcgactttcacttgaacgttttccttttcctgccgctccgtcagcagctgaactgttttttctgcgacaaaagggtgtcccggcacagcgtaaaccacgtcctcacgccgcgccgcttcaaagaggatatctgcaatttcttcatataccgcctcgaactgatcatgtttctcatatatatcatcaaagaaacggatgttcttcgtttctttttcaagctcctcaattaaaggatgatccttggttctgacatacagcgtatctgccttcgtcagcagcttgtgtataccaattgtcaattggtccatgtctccggcaccaagtccgacgactgtaattttacccgccattttgttctctccttctcatgaatttgcttaacttgctgccgaatggcacactgttcagctcttcatctgtaaatattcccaatctcatcatacaataaataaacaccgcgccaccaatggcaacagcagaaagactctcaatcacagccgctcctcttcctgttgcaggaaacaagaaagtccagagacgcgtatacgcaagcaaaacagctgacatcaaaagagcagatccaataatcggaatcaaaacgcctctaagcttatcgagccattccttttgccgaagctgatacaagttaaggccggcgacagccgcaaaggaagccgctgtcgcaagcgatgcgccttcaatcccatagcgcggaaccaaaagtgtgtttaacacccatttcaccgcaacacccgcgcccaccgctatcgcaggaaaaactgtgtatcccgctccctgtaagactgccgctgccgttaccgccaaggatgcaaacaaaatggagcagctaaatacttgtaacgcacctgtcccttctccattttgaaacagcatgatatttaccggctttagaatgcaaatcaacccagccgatgcgcctgtaccgagcacaaggcatagtttcaaagatgacgtgattttttctttcatgatcttcagctctttgttttttacagccatagaaatatacggaacgagtgacgtcgcaatgcttacggcaaaaactgaaccgagctgcaacaagggttgtccccgatcatagatcccctttaggcattttgcttcttcgcttgcctcaccacccgaaagcaatgcatataaattcaaagcatcaacaagctggataaacaaaagcagcaaactgcttacacaaattgtgaccgaatataaaagcagttttttcgtcaattcttttgttgtgatgacattttcgttttgcctatccgtttggttgtctcttttcgttttgaaccaaaaaaaccccagtattatcaatgcaaccaaacttccggcaagagagcctgaagcggctgccgctcccgcagtataaagcgaggctccctttttcacgagccaaaatgataaacccaagagcaccgcaacacgcagaaactgctctgtcatctgtgataaggctgaagggagcatttcgtgccgcccctgaaaaccgcctcttagcaacgcgacaaatgggaaaagcagaaacgcgtatgcggccacttgaattaacacggctagatgcgaatctcccataaagagtgcaataggaacagcacccagatataaacaaagaaataataaaataccgattaaagacaaaaacaacgctgatatttttaatatggtgtgatgatttttttcactataatcattcatcagctttgaaataatgactggaaatcctgatgtggacagcatgaccgcaataccaagaaaggggtatacctgctgatatatataaaatccaacatcgccgacaatgttttgaaacgggactctgtaaacagcgcttaaaatttttgtgatgacgcctgccagaattaaaacaaaagccccctgccaaatccaatgccgtttaacgcctattgaatcgtccatccaaaagctccttcccaacgtcaggggcaatacggttcacgtattaccgcggcacaaataaaaacgaggttattataccacatcccaacccttggattcctttttcggcacgcatgaaaaagaacagcgtcccaaggagagctgttctttacatacctattttcgaagaaaggaataagacctactgttccatttgacgagccaaaaatccagctgctgtttcaacggctttatgctctacttcgcccattgtctgatcttttgaaaagatcaccacagcacctatcggatcaccgttcgccacaattgggcctacagtataagaattcatgtcctcatcaattccattcacaagctgtactgatttcgcatcactctcaagcacggagctgcgctgatccattgttctttccagcatttcgctgattgacttgtttaagtaatcttttttggagctgccggacacggcaatatatacatcacgatcacaaatcagcactgaatggccgaggctgtcgtaaagcgcgtctgcatactcctttgcaaagtctccaagctcactgatcggagagtactttttcaaaatcacttctccgtcacgatctacaaaaatctcaagcggatcgccttccctgattctcagagttcttcgaatttctttaggaatcacgacccgacctaagtcatcaatacgacgtacgataccggttgctttcatctctggtgcctctctttcatttgatggtatatacatgtgggaaagacctaaagcagttactttatgtaccttccgcctcgcttgaaattagtatccgtcacatcaaatgtaatatacaccagagagtaacaaaatttacgttgatgaaatggtttgctttttcacatcttttaagcccttcagcatgcccagcacggtgtcgagccattcatcagcactacggcctttcgtctgtatggagattttgagttttttcccttccattcccagtccgatttgtctgccatattgattgccaagctcaaacagcttctgcccgtcaatttcagcacttgcttcttcagaaatcgtcaatctgacagcatctttatcctgcttaatcagctcgacacgttcctgtctcgcatagactttcatttctgcaacagtaaacaagtattcgacttcttttggatagtttccaaagcggtcgatcatttcatcttgaagctcattcttctcttcgattgtcgccacagacctgaagcgtttatacatatcaattttctgtttgccgtcttgaatataagtttccggaatatacgcatcaagctcgacatcaatttctgtttcaaactgctctgtcttcgctgtgtctcctttacgctcctcaatggcctccttcagcatttgtgaatagaggtcaaatccgaccgaatcgatgaagccatgctgctgggcaccaagaagattcccggctccgcgaatcgttaagtcacgcattgcgattttaaaaccggaacctaactctgtgaattctttaatagcctgcagccttttttcagccacttctgtcagcactttatcccggcgatacgtgaagtacgcatacgccacacggttagaacggccgacacgcccccgcagctggtaaagctgagaaagtcccatcttgtcggcgtcaaatacgatcagcgtattgacgtttgggatgtccacgccagtttcgataatggttgtgctgacgagaacgtctgattctccttcaaggaagcttagcataacggtttctaattcattttctgtcattttcccatgcgcatatgctaccttcgcgtcagggactagcattgaaatttcatccgctttccgctcaatgtcctctacccggttgtacaagaaatagacctggcctccgcgtgcaagctcacgttcaatcgcctctctgacaagagcgccgttatattccacaacatacgtctgtacggggaagcgattttccggcggagtctcgatgactgaaaggtcccttacgccaagcatagacatatgcagcgtacgcggaatcggcgttgctgttaacgttaatacatcaacattggcttttatttgcttgatcttttctttatgggttacaccgaaacgctgctcttcatcaatgatgaggagccctaagtctttatacacgacatcctttgatagcagccgatgcgtcccgatgacgatatcaaccgttccatttttcagccctttgattgtttcgtttgcttcttttctcgttctgaacctgctgagaaggccgatattaatcggatagtcctggaagcgctcttttatggtttcatagtgctgctgtgccaaaatggttgtcggaacgagcagagctacctgctttccgtcaccgatcgccttaaacgcggcacgtatggcaacctctgttttaccgtagcccacatctccgcacagcaagcggtccatcggacgttctctttccatgtcttttttgatttcgtgaatagaacggagctgatcctcagtctcttgataagggaaagccgattcgaattcacgctgcatctcatggtcaggagaaaacgcatagcccttgctcgcttctctttcggcatacagcttaattaagtcatcagcaatatcctgaacggatgtctctacttttttcttgacccgcttccattcacttccgcctaatttatacagctttggctcttttccttcggagccaacatatttttggacctgatcaatttgttctacagggacgtaaagcttgtcactgccctgataatgtatatttaaatagtctttatgaatgccgttgatttcaagagtttcaatccccaggtattttccgatcccgtgattaatatgaacgacataatctccaatttgaagctcagaatagcttttgatgcgctctgcattggtaagcttctgttttcgcggcttcttctttacacggtttttgaacagttcttcttccgtgataacggcaagcttcattaacggcagctcaaatcccgattggagctcgccttccatgatatagacctgtccctgaacaagcgcttttttgctgtctgtcatggcggcctcgatatcataatcagccaaaacagatgacaatttctgcgtacgttccttgtttgctcctaagaacacaacagtgaaatttgattttttaaaacgctccatttcgcccgcaagcacgttcatttggccatggaaactctgcatttgccggcctgacacattgacgatattttgcgggctcgtatggtgtacatgccgcaaaaataaagagtagtacagcagaggccgtttttgctcagccactattttttggaagctgaatgacaaacgaatgtcatgcaaaatcttcccttcctcaagaagatttgttataaactccgcttcttctttttgaagctgttcttccatctcatgaatccgactgacttcatccaaaatcagaagtgtattatcaggtgtataatctagtaaactagcaggcttttcatagaaatatgagagatacttcacgagctcctgatctgtctggccttcagacaagcgttctttatcgtgagaaatattcgcatgaagtatttctttttgtttgtcagcctttaattttttcaagctcgcggcaagaccactatcgattttctccatcgcccgcgctttttcttccggtctgataattaattccttcgcgggaccgatattgatcgaggtaagggtctcaattgaccgctgatcatctgaattaaagctgcggattgaatccacctcggtgtcaaaaagttcaattctcaccggattctctgaagtcaacggataaatgtcaatgattccaccgcgaatactgaattccccgggcgcagaaaccatatcagaccgctcataccctacctctaccagccgtgaggcaagctggtcaggttcgatatcatggcctacttgaatgagcatctggctgcttttccacacctcaacaggcggcagcattcttctgattgccgctaccggagcaacgacaattggcgcttctccattcgttagtctattaatgacatctaatcgctgcgcccgcaattcagggcttgcaactgcgatttctgatgaaatgagttcattgacggggtacaaaaggacagaccgatcctctagaagtgaagtcagatcatctgttactttctgggcttgatataagttatgggtgattagaaagataggcttattcgtttcattagccagagcagaagtaaaaacagaacgcgcggaacccgacagacccgcgagcagctgttccttcaggccctcgtgtaaaccgttgatgatggatttaaagtcatcgctttcttttataaaggtttgaatgttgtccatatggcccctcctctctgtttcctgcgagaacagaaaaacgctttggtctagtgtctacaccaaagctttttattgaataaatgtgtgatattcgtggtaatgcggatttcggtcaagcgcctcttggcaatcttcacatatcgtcaaaacatggacatctccattttctttataagaaatcatatcgtttctttcctcatttgttaagtgctgaaatccaagtgagtctgtcgataccattgaagattcgagactgcctactttcactccgcaatgacgacaataataatgcaaagccatacaagggacctcctgatgaaaaagtcattttggtgtagtatggactttgttgttacattttatacctttgcgttaaattcgttcatgacttctaaaaacggtttactcaaagaagcctcacaagccttcacagatttatcaaccgcttcttcgatctcaggtgcctcctccttggtaaaggagcctaacacataatcaacgaccttcatgccgtttacaggccggccgattccgatgcggatacggtcaaactcggatgttccaagatgctggatcagtgatttgatgccattgtgccctccggcgcttcctttcgttcttaaacggatcttgccagtcggaaggtcaaggtcgtcgtaaatgactgtcaaatcttcgttatcgacatcatagtagtccattaaaggccgcaaacattctcctgataaattcatatatgtaagcggtttaacaagtagaacctttttgccggaaacaaatccggttccgtataatccgttaaatttattttgattcagctctatattccattcctttgcaagctgatctatcaccataaatccgacattatgccgtgtattttcatagttcttccccgggtttccgagaccggcaatcacaagcatggcgaatcctcccttagtcacataactcccgtcttcataaacgggctataattcttctcattctagcacaaaagacgtaaccgcgggagggttacgccttaagctattattgttcgttttcaccttctggctgagcatcggcagattcctcttcatcgacctcagctgcttcctgctgctgcggaggaaggattgaagccacaacctcatctgattcatgattaaaggagtagtcaccgccagcaggcaaatctgcaatcgtcagtacttcatttacatcgaggcttgaaatatcagcctcaatcgtttgcggaatggcttttggcttggcctttacagtaagtgcatataacggctgctgcagtacgcctccgtttttcactccaatggcttctccggtcagatgaatcggaacttccacttcaatgtcctcactcatattaactacttgaaaatcagcatgagtgatttcatttttcagcgggtccgtctgcaggtctgttaccatgacggagtgtttttctccgctgacctcaagcgtaatgactgcatttttgccttcgtccctcagcgttttgatgagctccacactgtctaatgacacaggtttgttgcccgtatccttcccatatatgatacctggaacatgtcctgaagtacggatattccgaagagacgaacgagtaaagtccgttctttcttttgccgttaaagttgccatattcagcaccatcctcttgtcgttttagttgtcctattacaaacaatacccataacgataaggatttaaacctcgaaaaatggtttagctgaacagatagctgactgattgctgctcatgaacgcgaataatcgcttcggccagaagcggtccgactgaaagctgcttaaagcgttcaattttcttttcttcaggaagcttgatgctgtttgtcacaacaagctctttaattgttgaattattaatccgttcaaccgcagggcctgatagtacagggtgtgtacagcatgcatatacttctttcgctccgttttcaacgagcgcattagcagcaagtgtaatcgtacctgcagtatcaataatgtcatcgatgaggatagcagtcttcccttcgatgttacctacaatattcatgacttccgccacgtttggacgcggacggcgtttatcgataatcgcaattggcgcttttagtcggtcagccagtttgcgggcacgtgtcacaccgccatggtctggtgaaacaatgacgatatcttcaagatttttgccttcaaaatattctcctaaaatcggaacacccattaagtggtcaatcggtatatcaaagaatccttgaatttgcggcgcatgcaggtcaagtgcaatcacacgagtcgcaccggctgtttcaagcaggttagcgaaaagtttagctgtgattggctcacgggatcttgcttttctgtcttgacgcgcataaccgtaataaggaataacaatgttaatcgtttttgcagaagcgcgttttaacgcatctaccataatcagcagttccataatatgctcgttaacggggtcacttgtagactggatgatgtaacaatcacatccgcgaatactttcttcgatattaatttggacttccccgtcactaaatcttgtgacagaacatttccctaattgaactccaactatatctgcgatttcttttgcaagctctggattcgaattcaaagaaaaaatctttaaattcttatctccgtattgattagacatggataaacctccgaatttaggattattttttatgaatatttttcacataatcgtctttatttacttgtctcgctctggcaatagcaagtgcttttccaggtacatcttccgtaacagttgaacctgccgccacataagcgccttctccgactgtgacaggggcaaccaagttggaattgcagccgataaacgcgccatcttcaatttttgtcaaatacttattctttccatcataattgacagtaattgaaccgcagcccaggtttacatcagtgcctacctcagcatcgccgacatagcttagatgagatgccttgcttcggtctccgaattgagtctttttaatttctacaaaattcccgatcttcacttcattcccgatgacagaatcaggtctgatgtgagcaaaaggtcctatgtttacatcattccccactttactgtgattgactaccgattgtttaataaccgtacggctgccaatggcactattcataatctccgtatgagggccaataatcgtatcttctccgatttgcacctcacctttaatcacagttccagggtaaatcacagtatcgcttccgataacagcgtcaggagaaatatacgtattcatcgggtcaatcaacgtcacgccattttgcatatgccgtttattaatgcgctctttcataaattgttctgcctgagaaagagcaactctatcattaactccgagcgtttcttggaaattaccagtctggtaagcggcaacagtttcgccttcatttttaagaatctctatgacatccggcaaataatactcgccttgtgcattatcattagacacctgatcaatagcccgaaatagcgcttcattgtcaaaacaatacgtaccggtgttgatctcagttacaagacgttcttcttcagaggcgtccttatgctcaactattttttgaaccgctccgttttcgctgcgaataatgcggccgtatccagttggatcttctgcaaccgcagttaaaatcgtagctttcgcttctctttgtgtatgttctttcagcatctgttccatcgtctctgctgtcaaaagcggcgtatctccgcaaatgacaattgtgacgcctttttcgtcagcaagaaatggctgtgcctgttttacagcatgagcagtgccaagctgttttgcttgaagcgcgtactcgcttttatcaccaagctgctttttcacttcttccgcaccatgtccgacaatcgtgacaagctttgataaagataattttaaggcttcgtccacgacgtgctctaccataggcttaccgcaaactggatgaaggactttataaagcttcgatttcattctcgttccttgtccagccgctaaaacaactgcaaaccgcttatccatttattggcctccaatatcccttttatccatagaaaaatatatcctaaatatcttctgatttcaaggagacttcatgaagtgcaagaattttctattgagtgcaactaagtttgaaaaatcagaattaaaaaaggaccgccggcaaaaggcttatgtcagccctttcagcagtccttgctttttggttattttttaagaagctccagcttcttcgaattctaatgcttcagtgtcacccagacgatgatactcatttaacacggcatcttgaatctttcctcgcgtgcttgaattaataggatgagcaatatcgcggaactctccatcaggggtgcgtttactcggcatcgcaacgaaaagaccattgtttccatcaatcacacgaatatcatgtacaacaaattcgtgatccagcgtgatggatgcaatcgctctcatgcgaccatcggtattcacgcggcgtaatcttacgtcagtaacttccacagtagttcaccaccttttccctatataaaagcattagtgtatcaattccacgattttttctgaaatcctgctcgtttttaaaatattttttgaaaaaataggatatagttacacaattaggtcataaagctttcatttcgggcataaggtaaataaaaaagtgatcccggctctcccagaatcacttttcttattatttcaccagtgcaataacttcgatctcgactaacgcatccttcgggagtctcgcgacttcaacacaagatctcgccggtttgtgagtgtcaaaatattgtccgtacacttcgtttacttccgcaaactgttccatatccgcgataaatacagttgcttttacaactgtttcaaaagaagcacccgcttcttccagaaccgcctttaaattgctgaatacttgatgagtctgctccttaatatcgccattcaccatttcgcctgaaggagtcaaagggatttggcctgagctgtaaaacatattgttgacgataatcccttgtgaataaggcccgattgccgctggggcatgttttgtgtggactgcttttgtcatgattctgtctctccattctttaaaagattgtctttaaaaaaacgcagaaaattgccattctgaatttcaatggacttctctttcatgttgatggttgaaagagtaagaagtgacatatattcgtcaacaagacgttcatctactccttcggcttcaactaagacgccgattcccgccacatttgcgttaaactcatccaacaggttaatcataccattaatggtgccgcctgctttcataaagtcatcaataatgagtacgtttgaacccgttttcatgcttcttttcgcaagtgacattgtttgaatgcggtttgaggagcctgaaacgtaattaatgctgactgtggagccctctgttaccttattgtctttacgaacgatcacaacaggcacattcaaatagcttgcagctgcgtacgcaagagggatgcctttcgtggcaacggtcatgacaacatcaatttcgcgctctgcaaacacggaagcaaacagcttccctaccttggagagtacagatggctttcctaagatatccgttaaatatacataaccgcccggaaggatacgctcaggatttgccagcgactgtccaagtgtctgcacaaactcttcagcttcagcctgcttcattttcggaatatatttaacgcctccggcagctccgggaacagtaagcaaagtaccaatcccctgctgttcaaaggtttgtttaataattgttaaatcttcactgatcgatgattttgcagattcataccgctcagagaaaaaggttagcggtattaactcgtgcggatgggttaacaaataatttgttaagtccaccaatctgccgctgcgacgaaacttcatgaactcacccccaaaatccgaatattttaagatcaatataacttaacatacggatttaatcaagagcgttctgttcgccgatcattctcaccgcataaacttgatcgcagaagcctcttaacccgttataaattctctgcaccttcgactcatactgaaccagtccaaacactgtcgggccgctcccgctcattaacacggcatctgcaccaaagcgtttcatctggtttttgatcatcgcaacttcaggatgcatatcgagtgtaacagattcaagcacattgcctaaccggctgcacatcttctgaaaactcttttcttctatcgcctcgatcatgccttgtacatcgggatgctctataccatccagtttcagcgctctgtacacttcagcagttgaaacaccgattgtcggcttcgctaaaatgacccagcagtgcggaggcgtgctgatatgtttaattttctcgccgcgccctgttgctaatgcagttccgccatagacacaaaatgaaacgtcagagccaatttccgctccaagctcagcaagcgtttccgcggacagatttaaattccacagtctgttcagccctctgagtgtcgccgccgcatcactgcttccgccggcaagaccggcagccaccggaattaccttcgtaatcatgatggaaactccctttttcacgttgtatctgtccttgatcaacttggcagcctgataagctaagtttctttggtcatcaggcacaaatcggttgtgggaggaaaccctcacttcatcctctgcaagctccgtcaattcaattcgatcagctaaatcaattgtcgtcatgatcatttcgacttcatgatagccatccgggcgttttcgggtgacgtcaagtgacagattgatcttagctggcgctttttctaaaatacgcatagctttcacctacttctccatctaaacataagtatgaacattgtatcacatttgaagtacaggatgaacatatccatattcagcccattatgtatttatatccaaaataaaaaaccagggaacagcacgtcccccgggtcacatccttatcggttattctgattctgagccatttgctgttcggcgatttcaatagcacgcttcaccatgttaccggcatcgcgggcccgaatttcaccccagcctccattttttactgtgtcataaaaaccaaggtctttagccagctcatatttaaactcatctgacataactccacgacgtctgcccaaacgaaacaactccttttttagaagtgatagccattcgtgcacgtcacgataatatgtgactgttttatcttttgttaaatcagatggaactttcgttaaaattattggaaaccaaaaaagggcaaaacaaaaagcagtaaacaaaaggttcactgcccgttaaaatgccactgagcttgcggcgtcatcattaaatgtcagctcaacagtctcagtcaaaatatcagcataactgtatgaaactctttcaaacgagttctcgtcttgatctagttgtatcacaaaaacagaagggtacgtctcagctaaaatgcccgaacgctcaatcgtttttcggcggccaccgtttgcttttaacgtcagccttttacctaaattcccatcaagcgatcttttaatatcggacaacgtcttcgccattgcatccacctcactacatttattgtacaacacgagcccatttttgtcaaataaaatttaaattatatcaacgttaataagacgttgtcaataaaattattttgacaaaattctatgattcctcaattatgttccgcaagtttcggtaaattatgtatcattatgtaaaataaaaaacccgcatagctctcctatgcaggttttcaactgttaattggacttataaggcataccaattctcagaactcctcttgtttcaatacctccaagccctttctctcttgtcagcgtattacggagcacttcccatacattaatccgttccataaacggcgtaaagctgatcttcgcgacgatatataccggatcaagcgcatgaatattgactcttgacggtgaacttgcaaaattcgcacccgctctgatgagtgattcaaaatgggattggcaggcccccgcaaaaataacaagctgatctaagtgagggatcttttttcgggctgtttgaactgtttcaacaaagtgcttagaatgtctgtacgcattcaaatcatcaataccgcccttttgcttcgagtacgcatcatgccctgtgatcaccaggatgtcaggtcgatatttgtcgagcaattcttcaatagaagcagacattttcttttcatggcaatggatgccatagaccggcactccaatttttttatagacattcaggcattttttcaaatatgcttcgtcaccatccagatgaagcactttgcccggcatatggaaataatgctcctgatgctgatattggcttgtcgcatagtactcctgcttttctctgagcagcttataatcttggcggagcaattcgagcgactcattcattctgctctcatctttctttttccgcatcatctgctcatcctttttcactgccaccagatcagaaaaatccgaatcagcaatcagcctgacttcatctccatgcaaaatggcaattgaatttcctttgcttgtttgctctattcctataattcgaaacaaaacatccatctgataggattttctggctaccatatcccctatttgaaattgcacgttcctcactccacacatagactaagcctcatcatgaaagaaagagccttgagaaagcgccttttttcgctgagtccaagttttttcttatcattgaatgaaaggtccttctctagcctatgtagcggcagtccatgtggtgcgcaaaacaaaaagcccttttagaaaagggctttatacaatccgttagacagcgctgcgaattcctcaatagacagggattcacctcggcgcttaccgtcaatatttgtttcttcgagcacttgttcaatcgttgatttttgtgcttttccttcaggcagattgttaactaagttattgagcagcgttttacggcgctgtgcaaagcttgccttgatgagctgaaagaaaaaggattcgttttccacgtccactgccgggccgtctcggagaatcagacgaatgactgcggaatcgacattaggctgaggaacaaatacggttttcgggacgatcatcaccgttttggcttctgtataaaactgcaccgcgattgaaagcgagccgtattccttagatgaaggatcagccgccatgcgctcagccacttctttttgcagcataaccacaatccctttcagcggaagatgttcttcaagcagtttcatgataatcggtgttgttacgtaataaggaaggttggcaactaccatgatctcatcacaatcttgaaattgttcttcaatgactgatttgacatcagcctttaacacgtcctgatgaatgacagtgacattttcgtaaggtgacagtgtatccttcagaatcggcaataatcgctggtcaatctcaaatgccacgacctttttcgcccgcttggcaagctgttcggttaaagccccgattcccgggccgatttcaatgacacctgttttctccgtcacttccgcgtgatcaacaattctgtttaaaatgttcgtatcaattaagaaattctgtcctaagctctttttaaaagaaaaaccgtatttcttcagtatctctttcgttctaatcggtgtcgcaatatctttattcattctgttcctcccgcataacggtatcgagcgcactcataaaatcactttttttaatttgaaacatttgcagccgtttttgaagctgtttgccatttgtatagccgattttcaacagatcacccagtcgttcccggcggcatttggccgcaggcccgcctattagtccggcatgaatcaaatcctcagctgaaatgtcactcggctgcgcttccatctcctcatgcacattttctaaacatgccctaatgctttcaaccgatgcatgctccacaccaattccccgcttgtttttaggtttggcaagatgttttggcaaaaatgcatgcttacagccgggtacagcctctgagatggttttgcgaatcttctctcccggaaagtccggatccgttaaaataatgacgcctctcgtcttctgggccaaacggatttggtcaatcacatgatcatcgatggctgaaccatttgtttcaattgtgtctgcatcaacagccaatttgatgcgggccgtatcgtcacgcccctcgaccacaatgatctctttaattttcattatttcctccaagacaaaataaaaacttttgtatattcatgaaactttttcttatatcgagcgtctaataagcagaaaatgcactttgtctattataacgaaaaaaacagagggcgcaaaaccctctgaatacataagtatatactaatttaagattttaattttgactgttttatttccccatcggtacgccgatgatttctctgggaaaaagacgtctatcttgttccctttaatcgctgaaccggtatctgcagcaatggcatatccatagccttccacgtggactttggagcctagcggaatgacatttggatccacagcgatgactttggcattcggattattttttaaattgacgcctgtcgctgtatgtcctgaacaaccgctgcagcttgccgtataagccgtagatgatacagtcatgactttgcctgttgattcattgctgcgggacacaactgtttttgaatcacctgaagcactgaccgtttcaaattttggactgctttgctttgtgccgacagcaatcactttatctttgctttgttcagctgtttcttcttttacaagctctctggacacttctttaccgttttctttaacgacttcgaaatgtttttttagcttgccttcttttcctttttggacgaccttttctttccctttttcaagagaagcgtcttcttgctttttcacatcgaacgcaatcttctcttcaactacatcggtgaccttttcgatacgagtaattgtaatatcagcctttcctttcgtcagctttgcatctaacgcaggcttgattttatcttcgtcttttatgttcatcttttgctgttttaaaaagtcagcgaccgtagtcgaagtcgtccagatcttcttttgtttccctgcatcattcacagtaacctgaaatgcgggctctatgttaatcttcatgtctttcgaaatatctgtatctattgcgggatcaatttgatcttgttctttcacatcaacatcttgttcgtccagtaatgcaccgaccgtttttgctgttgaccataacgtcttttcttccccgtttattgtaagcttcacaggttttgcagcctcatacacaacgtccatgtctgctgttatctttgtctgtttagcaggtgtgatcttgtcttcgtctcttgtctttatatcaagcgtctccaaaagatcaccgactgtatttgcatgtgtgcgtatatgtttctttttgccattgatagaaactgagactgattgtttcgtcagctcatgagccgcgtacgcagtcccgcttcctgccaaaagcaaacaagcagcaaccagaatgactttgcttttgctaagctttacggaaaacagctttttcattttttgtgtgatgaaaaacgcctccttctcctcggagagattatatagagtatctaaaaggctgtcaaccctcccttctctttctcccaaaagctcagtgtcctcttcattatcctgaaatacactgagaaacggaagaaagacttgtcgacaaacctatcctatgaggagaagaaagcatgtagaacttttatagaaaaacgctgtaagggacaagctcttacaaaacccgctagcgttttttgtcagtttatacggaaaagtcttttcgcattttcagtcgtgatggaagcaatctcttcaaaggtcatttcttttaattcggcgatttgttctgccacatatttcacatagcttggctcatttcttttcccgcggaaagggtgcggtgtgagaaacgggcagtccgtttcaatcagcagccggtcattgggaatttccttcactacttccttcggtttcttcgcatttttaaatgtcaccggtcccccaaatgataaataaaaattcattttcatgcattctcttgccacttccgcacttcctgtaaagcagtgcatgattccgcccacagcttctgcgccttcctctttcaaaatggtcacgacatcctccgttgcatcacggttatgaatgataataggcaaattgacctctttcgctaaggcgatttgatttctaaacacctctttttgaatatctttaggtgatttatcccaatgataatccagtcccatttcccctatcgctaccactttctcatgagcagaaagctctttaatccacgctaagtcttcctctgtcatgtcaatagcgtcaacagggtgccagccaatggctgcataaataaaatcatattcctcaatcatttccatcgcacgggtaatcgtcggacggtcaaaaccaactacgacaattcgttcaactttttcagcttttgcccgttcaataacctcttcaagatcagtatcatattgttctgcatttaaatgcgcgtgagtgtcaaacaacataagtgaaaaactcctttcttgtcgaaacacaaaaggtgttcgacgaattgttacacgtgaaacaccttttgtttatcattatttaattcttgtgccttttggtaacgactgatcgatagatacgacctttaaaacgccgtctgcttctcctgcaaggatcataccttgagaaagctctcctctgagtttaaccggttttagatttgttacacaaacgagtttttttccaacaagctcttcaggcgtataatgcttcgcaatgccggataccacttggcgcttttcaaaaccaagatcaagctgcagcttcaataaacggtctgcttttttcactggctctgcctcaatgacctcagctacgcgaagctctacatccataaattgatcaatcgtaatttcaggtaaacgatcgacctcttgaggctcttcttcttttgtttcttctttcgctggtgctgaaccttgcattttccctttgatgtaagcaatttcttcttctgcctctaaacgagggaacaatggctcgcctttttgtacttttgtatctttcagctggccgaaagctgtaatgctgtcccaagcttttaaagattcatcagtaatgcccagctgctcgaacattttttcaggtgtttttgttaagaatggctgaagcagtaccgctgaaatacgcaatgattcagcgagatgatacataactgatcgcaattcttcttcttttgccggatctttcgcaagcacccatggagctgtctcatcaatgtatttgtttgtgcggctgatgagctgccataaagtcgaaagtgctaccgagaactccatattttccattgctttctcataagctttcactgtttcttcagcaacagaagtgagcgtatggtcaaattccgtaacagcacctttgtaagaaccgatttgtccgtcaaaatacttattaatcatcgcaacagtacgattcaatagatttcctaaatcattcgctaaatcatagttgattcgctcaacaaatccttccggcgtgaaaacaccgtctgatccgaacggcacttcgcgaagcaagtaatagcgaagttcgtctaaaccatagcgttcaattaatgtaaccggatctacaacgtttccttttgatttcgacatttttccgtctttcatcaaaagccagccatgcgcgaatacttgctttggcagcggaagatccagcgccatcagcataattggccagtaaatagtatggaatcgtacaatctccttaccgactaaatgaacatcggcaggccaatatttttgataaagctcatcattttctgtatcataaccgagtgccgttaaatagttaaatagtgcgtcaatccaaacatatacaacatgctttggattttccggcaccttcacgccccaatcaaaagtggtacgtgatactgccaaatcctcaagtccaggtttgataaagttattaatcatttcgtttttgcgtgattctggctgaatgaatgtcgggttttcttcatagtatttcagaagacgatccgcgtatttccccatgcggaagaaataagattcctctttgatcaattcaactgggtgaccgctgtcagggctttttccgccgatgacctctcccttttcattccgctcaatatcaacgagctgagtttccgtgtagaacgtttcatcagggatgctgtaccagccttcatactcatcaagatagatgtccccgttatcaagaagcttttgaaacactttttcaatgacaactttatgccgtttttctgtcgtgcggataaagtcgtcgtttgagatttcaagctgcttccacagtttttgaatatctgccgctgcgcgatccacatactcctgaggtgtaatgttttcctgttcagctttttgctggatcttttgtccatgctcgtccgttcccgttaaatagcgaacatcgaacccttttaatcttttgtaacgtgccattgcatctcctgcgactgtcgtatatgcatggccgatatgtaattttccgctcggataataaatcggtgttgtaatgtaaaatgtattgttttcttgcggcatcttgaaacctcctaatcagaatgtcaaaaagctcccgcccaaaggacgagagcggcgataagtgcaaatcatatatgaatattatttatatttatcctttatctatgataccatcttagcctttaagatcaagaatatatacatacgccctgaaaaagaataattaaaattaaaaatctttaatgaaaataaaaaagtctgttcgtgtcgaattttgtcgtatataatcaaatgaaataaaaaactttggttcgaaagtcttgatttaaaaggatttttagtaggataatagctttattaaatatttataaaatgctgttatttcggtagtttccaagacattactgactataagaactaattcttacaatcaatagtaaacaaaatgattgacaattattggaaaccttgttatgctatgaaggtaaggattttgtcgaataatgacgaagaaaaatataatttaaacaaataagtatctcttgggaggagaatgtttatgaaatctactggtattgtacgtaaagttgatgaattaggacgtgtagttattcctatcgaactgcgtcgtactcttggaatcgcagaaaaagatgctcttgaaatctatgttgatgatgaaaaaatcatccttaaaaaatataaaccaaacatgacttgccaagtaactggtgaagtttctgatgataaccttaaacttgcaggcggtaaattggttcttagtaaagaaggcgctgagcaaatcatcagcgaaatccaaaaccagcttcaaaaccttaaataatcatttcttgtacaaaaaacgttcttgttatgacacaagaacgtttttttattgcttaatatggtaagcatcgtacacttcacgctttggtacattgcgatcgactgctgcttttttaatagcttctttagacgtagcgcctttcgaaatgtaatgctcgacatgttctttcgcagtgagggtttcccaccattgttcttcctcatctacctcttcattattacttccttctacgacaagacaaaactcgccgcgtatctgatcctcgtttgcccatccaatgacctcagatatggttcctcggataaactcttcatatttcttagtgagttcacgtgttacagcaatttcccgatctcctaatatctctgccatcgctgacaaggtttccttcaatctgtggggcgcttcataaaaaatgatcgtttcctgccgttttttaagggcttcaagctccttcttcttttctttttctgtctgttgagaaaaccgtaaaagaaaaaaggctgcggtacaatacctgaagcaataagagctgttaatgcagcatttgctcccggcaacggaacaacataaccgcctatatccgtaaaatcctttacaatttccgctccgggatcagaaatcgtcggcagaccggcatcactgacaagagcaatgttttttcccgatttcagccattcaataattttgtgcccactgctttctttattgtgttcgtgatagctgacgagcggtgtttcaatttcatatacatgacaaagctttttcgtttgcctcgtatcttccgcagcaatcgcatccactgatttcagcgtgtcgatcgcccggaatgtcatatcctctaaatttccgattggggttgggaccaagtaaagaatccccatgtccgactttccattaaagctcatttggcgccttaacatatacagcctccttgctgttccgcttttcttctatataaagctcttttttcttccgagttagttttttgaaataatattccgcctgcatagcttcccgctttgttgaaaagctctcggcaaaaattaattcaaccggacgtcttacttttgtgtactttgcgccctttccatcattgtgcgttttcactcgtttatgcagatcgttggtatacccggcataccagctattgtccttacatttcacgacgtagaagaaatggttatttgtctccatataaaatggtcctgatttcttttgtatattcattttgttcatcatatacgaataagggaggaagaattttcaaatccgggcgcccgcctttgataccttcaaccaaaatggtattggcttctttcccttgcttcggatagacaaattgtacacgtttcggctcgatttgataagccttcatcagttcaaaaatctccagaagccttcccggccggtgaacaagagctgcttttcccccttgcttgagcagcttgctgctgactgaaatgacatcctccagcgtgcagtggatttcatgtcttgcgattcggagatgctcgttcatgttttgttcagtttgtttcggcgttttaaaatacggcggattgcaggtgacaacatcatatcgattatgtccaagtttctccggcatgtttttcaggtcatcatgtatgatctggatctgatcgtccaacttattatactccacgctgcgaacagccatatcatgcagtctttcttgaatttcgactcccagaatgtctgcttttgatcttgtactgagcagcagcggcacaataccattgccggtgcataaatcaacaattttccctttttgaatcggaacgtacgcaaatttggacagaagcacagcgtccaacgaaaaagcaaacactgttgggctttgtatgattttcatgtcctctgccagcaaataatctaatctttcatcatcatgtaatgaaaccatcttcttatcctttcagtacctttgaaaaaggctcccgtcttatgcggaagccttttccctattttttatttaagaatgacagacagaaaagacaatcctcttttcgaacacttccatagtggacattgcagatatgaaatccttcttgatacagacgtgccagattatcatatccttcccctatatcagtttgctctgtcttctgtgtttttgattcttttttatcagctttgaacttttcaatctgctgcgtcgtatcgtccagccgtttgcgcaaatgcttgttttcaagctgtaaatgatgattttcctcaatcatctcaccgatatgctgcttcaaatcccccagctgccggtacagtgagccaatttgttcttctaagttaatgactgtatcaaataactcttttttatccaaggttccacacctcgttaatctgtggtttgtgcggatacgacgccctcttccaagagctcttcccaagtatattctatcactttttcacggtttatcagttccacctgaagcacccgttccagaatatttagtccgacgaccttcgcgggaccgtttgctgtcgtaatcatttctcctatatccggaagctgttcttttgccgtctcatactcatcgttctcatattttagacagcacatcaatcgtccgcaaagacccgaaatcttcgtaggatttaaagacaagttctgatccttggccattttaatggaaacgggttcaaaatctccaagaaacgttgaacagcaaagcattcttccgcaaggaccgattcctccgagcatttttgcctcatccctcactccgatttggcgcagctcaattcttgtcttaaagatagaagccaaatcctttacaagctctctaaagtcgactcggccgtcagcagtgaagtaaaaaatgactttattgcgatcaaacgtgaattcaacatcgaccagcttcatatccaagccatgctcaatcactttcttttggcagatatcaaatgctgatagtgcttcctgtttattttcttctacaatgagaagatcgcgatcgtctgccacacgtatcacttttcgaaggggaagcaccacatcatgctcatccacctgtttatttgcaattacgacctggccgtactcaacgcctctgacagtttctacaattacgcagctgtcatgttctatatgaaatccattcggatcaaaataatatattttacccgctttcttaaagcggacaccaattacattgtacaagcttatccctcctgcaacattaacaccaagtgctccattaatccttgtacattcacattggaatgaagccgtttctttgcttctaaaacagcaagtatctgattcgtaacgctttgttgtgttgattgtagcgcatgctgttttattgattggaataagtcttgataaatcaatttatcttcatttcctatttggatggacaacacatcacgatatatcaataagagcatatcaagacccatttcttgatgggttttttctttgaaaaagggcatccattgatcttgaataaagaaaaaagcatgtcctttccgctggtgtaggacttcatacaattttatcactttcgctctagactctgcaaactcatcatttcgacttaattcgactgcttctgctacattattagtcatgttggccagaagccttgccatatgaggcgagacgtcctgttcgatcagtctgtcttcaattgctttcggctgcaaaggctgaaaaggaagggtttggcatcttgaaatgatggtatccaataacctttggggctgctcagtgatgaggacggccattgtgtctttgttcggttcttctaaaaatttcagcaggctgttcgccgcatttgctgtcatttgatctgcgtgcgaaataatatacagctttttatgcgattcaagtcctgtcttagaaaactcttcttggagcgcttgaatttgcgcctttttgattgataagccatcaggctgaacaagatggagatcaggatggttccctgactctatccgtttacagtttcggcagctctcacaaggctccgcgccaccctccagacaaaagaagctttttgcaagaagcagcgcggcatcaagcttgcctgttccttttttcccctcaaacaaataagcgtgtgatagtctgtccttctcaatactattatataaaagcttcatcactctgggctgaagctcgttcatttccttccaggatattgccattgtatcactctctatgtgtaaaggttaattaataaaccttttatttcgccaatacgctccagcaaatcaattgccggtttttcctgatccatcatctcttccgtaagctgtatcaatttgtcatctatttctttcacaagtcccagcgttctgctgttcccgtaaaggtcaaagcttttcgatgtttcatgtgaaagaccgctgtccacagcttctttgacaaaacgtttcacaagtcctttaaatctcgctaagtctttaaaattccgagatttcgttagcctttttccaaatgcttctatatcagataacagcctggtaagctgatcaagcttcattttgctgctttggttttccattgatgttttaaacgatgctgtgatctcagatgttttcacagagggaatctgcttattatctataaatgtacgtatatctttattaattttcacagtttcagatccttaaaattgatgaaattcatcgactggaaggacaaatactgtcgctccgccaacttcaacttcgactggataagggacataggaatcagcatttccacccattggagatacaggggcaatcatctgatcacgtttctgcccgttttctttaatgagactcaacgctttattgacgcgtatatcctcgacaccgatcataaacgttgtattgcctgatttaagaaatcctcctgtcgttgcaagctttgtgactctgaagttgtgatccgttaaggttttcaaaagtctgttgctgtcctgatcttgtacaactgccactatcaatttcatctgtgaaggcctcctttagattggaaacaacgtgatctcgtttacattattatatcaactattgggaaacaggtcacaattgaatttttttcaacgcttcatcgatcacctttagaacatcctgaacgacgaggtctttggattgcccggcatcaactgaatgaaatctttccggaaatcgcttcatcagctcttgataaccttcttgtacttttgtatgaaagtccagtttttctaaatcgagcctgtttttctcccgtgagccgtttgcgtaaatacgcttcagtccttcttccggatcaattgaaaaataaaccgttacatggggcatcatatctccaatggcaaattcattaatggacagaacctcatcaattccaagccctcttgcatatccttgatacgcaagagaactgtctatgaatctgtcgcaaagaacgataaacccctgttctaaagcaggttttactttttcaactaaatgctggcgtcttgcagccgcatataagagagcttctgtttttgggtccattaatatattgttctcattcagaataacctctctaatttgttctgcaatatctattccgcctggctctcgagttgccataacctgaaggccttctgctgtcagtatgtttttgatctcctgcagaacagtcgttttccctgcaccttcaggaccttcgaatgtaataaataaaccgctcatgatttctcctcttctatataaacaagtagttgtttctctttgattttcatattcccttgaacatgcgttttcatgctgatcaagcggctgagcttttgcacactttcttttgttattctttctcccgccataatcatcgggatacccggaggataagggatgatatcttctgcattaagccggccagctgcttcctcaaagctcacatattctttcttaaacgaatgtaagaccttttttggataaggcaagacagtaacaggctgcacaccccattctgcagaaacaaacgtctgatccggaggcgttttctcaatctcttcatcgatgcttctaatgatttcagcgtttattctccgttttcctcccaatgggagaacgagcagaacttgattttcatcagcaagctcagtgaatatgttggcacgctctaaaatgctttgcagcgtatagccagaatgcccgcgttttgaacgaattgtgagctttagcggatccgtgatgatcagtggattagcagggttaacagcttctgcatttgtaagtgaatcaaacgtttgtttaagtgtttctatccgctgcagaatgtcagaaagcttttgttcttctataatatgctgtacataagcgcgggcaatatctaacgaagccataatcggataagacgggctgctgctttgtaatcggtttaaatactctgccacccgatccctgttaatcctgcagctgctgttgagatgcaaataagaacccatcgtcatggctggcaacgttttgtgggccgactgaacaacaatatctgcccccatttttaaagctgagaccggaaaaggctcacctaaaataaaatgtgcgccatgcgcttcatcgaccaaaacaggaatcccgtaatgatgggcttcagtaatgatctcagtcaaatcagcactatgtccgtaatatgtcggattggtcagtaccaagcctttcgcatctggatatgcttccagggcctctttaattgttccaagcggaacatgcgtaggcacatgcatcgctgaatcaacgtcaggtgcaagataaaccggctcagcaccggacaaatcaacagcatgaaatacagatttatgacagtttctttgaaccagaattgtatcaccaggttcacaaacagataaaatcatcgctaagtttccgacagtcgtaccatttaccagaaaaaaactttccgccgatccatataattgactggcaagctcctgagcttccttaatcaccccagaaggatgatggagatcatccagtcctgccagttcagttacatcaatggtgagaagcggatcgaatattgacttagcgtcatcaaaaaagacatctccattgtgatgtcccggaacatgaaatgaatgagaatttcttctcgcatgttgaattaatgctttatataaaggtgtgttcatgaaaacaatcctttgaatgtgtcttcttacaccttattatatcgtgcctctgacagaacttaaagccagacttactggtaatcatctttcctttattgtaatcagcttttgcttcaggtcgccttccatcatcatgagctcttcttctgcctgacggcgtttgattcgtccttcttcttgtatagtcagtgtttcttcaagcgtgcttattaagctttcctgcaccttcttcaaggtatctatatcaacaaggcctctttcatttgcccgtgcagtttcaattgtattggtttttaaaagctccgcatttttcagcaaaagctcattggttgtatcagatactttctgctgtgcatccactgcattgcgctgccttaaaagcgtcagtgcaatggcaacttgatttttccataacggaatcgctgtcacaatggatgactgaatcttttcagctaacgcttggtttgtattttgaatcagcctgatttgcggtgcactttggattgtaatttgcctgctcagcagcaaatcatgcacccttttatctaaccggtcagcaaattgaattaaatcattcacctcttgaacggccatttggttatgatcactcgattcagcctgttgcttcagttcaggaatcgtttttgtttttaattcctccagcttcagttctcctgcagcaatataaacattcagcgctgcgaaatattctttatttttttcatataactgctctaacagcttgttgtcactgattaaagcatttttagagtgctccagcttcaagctgattctgtctatctgcacactggtcttttggtatttagacagcacctcttgaagagaacttgatactcttccaaacatgcgtgccaaaaaaccctttttcttagattggagatcatcaggatttacttgctccagctttttcatcagctctccaagtatttcgccaatctccccgacatccttcttttgaacatgattaatcatatcatgagaaaagttcagcagtttagattgagcttgtgaaccgtataagacaatgctttgcatatttttatgatcaatctgtccagcaagctgaattgctttttccttgttttcctcaggaagaacatcaacaagccgtacttgctctttctctgcttttacagcctccgaacctggtatctctatgttaccaccaaaaggatctgccaataattcatctatatgaaggtcgctttggtctcggttcatcgctcttaccctcttcccttatttctttaatgaatgttttgctgcgtctaattcaaactgcaactcgtcaatttcatcacccattgcttgagttaaatcttcctctaaacgcttggtcaattcagtaagagtgatgcgtgtctcacttaacgacatcgacagttctttgctttttttgggtgagatgatagaaaagcatacttctctgtcaattcaacaaccgaatcgagagtttgataaaaaaatcgttctgcctgataaaaccgctttggctcttttttggtgaggagataaatccttctcacaatccttagcatttctgcattttgcttaaacatttgaatgcttttagcctgaaacaaggctttcctaagacggaccattttctgccttgcttcctctaagtttttcttaatgtaagcatactctcttcctgtcaattcatgctttttaagaaataaccgtcttgcattccagatgccagctatatatacggctgctccagaagcaagcccataaacaatagataaaaaaatcgactggtttaaaccaaaaaagctcaatattccaatgaaaacaaaagtcgcactgctagttaaactccacaccaaaaagtgaaaaaatctctgcatgagataatcgactcctgtgtctatactcagttttaatattattatctactacgttcaatccttaaacaagtttcatcttctttttattattaagagtacaaaaaaagaccttttcaggtctatgaatataatggcggtgtatgaatgctctttagtttttttacgtaaaacgcatagtcaggatcagaagttgatgtagaaattacttttctctcacaatctaagcatatgaatttcgtataaagatgaatgcctctattcttctcttgatcacaaatcacacatgtatgattaagtttaactgtttcgtccatcttctccacctccgtacagttagcctccccttaaaacggatattgtatacactatttagacctttttgaaactttaaatcagtatatgggctatataagccctcggtgtttgtatttgtttgattttctcgatcttgagtaaacaaaaaacccagctcattaagctgggtttaagcttgcttggcggcgtcctactctcacagggggaaacccccgactaccatcggcgctgaagagcttaacttccgtgttcggtatgggaacgggtgtgacctcttcgctatcgccaccaaacaaatgccttcaggatgaaggtactgggcgtttctcacaggatgtgagagcccttagcggagtttccttaccttccgcctttagagaggtgttctctcaaaactagataacaggtgtgacatcattcaaaatgtggttaagt

SEQ ID NO: 41 - DNA, 2966 bp, Bacillus subtilis WAUSV36
gccacacttccacctcagacctatcaacctgatcatctttcagggatcttacttccttgcggaatgggaaatctcatcttgaggggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactatatttcgctcgccatcacagctcagccttatgggaaacggatttgcctatttcccagcctaactgcttggacgcggatatccaataccgcgcttaccctatcctcctgcgtccccccattgctcaaatggtgaggaggtggtacaggaatatcaacctgttgtccatcgcctacgcctttcggcctcggcttaggtcccgactaaccctgagcggacgagccttcctcaggaaaccttaggcattcggtggaggggattctcacccctctttcgctactcataccggcattctcacttctaagcgctccaccagtccttccggtctggcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcattggcattcggagtttgactgaattcggtaacccggtaggggcccctagtccaatcagtgctctacctccaagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcatgcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctaatcccgtttcgctcgccgctactcagggaatcgcatttgctttctcttcctccgggtacttagatgtttcagttccccgggtctgccttctcatatcctatgaattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactatgtgatatcttgtattactaattgaatgtgatgtctactgttatctagttttcaaagaacacgttt

SEQ ID NO: 42 - DNA, 1527 bp, Bacillus subtilis WAUSV36
aacgttctgtttataagacccaaggtcttatattccgtataatatccttagaaaggaggtgatccagccgcaccttccgatacggctaccttgttacgacttcaccccaatcatctgtcccaccttcggcggctggctcctaaaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtaccgccctattcgaacggtacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgttgccttggtgagccgttacctcaccaactagctaatgcgccgcgggtccatctgtaagtggtagccgaagccaccttttatgtttgaaccatgcggttcaaacaaccatccggtattagccccggtttcccggagttatcccagtcttacaggcaggttacccacgtgttactcacccgtccgccgctaacatcagggagcaagctccca

SEQ ID NO: 43 - DNA, 15443 bp, Bacillus subtilis WAUSV36
ttgctgtgcgatttataaaaatgaattaacaggtacgttttgtcttgtttagttttcaaagaactttgtttaccgctcgtttaagcgactttattatcataacatttaccgccgctactgtcaacaactttttagcattttcttttcaaaaaagctgttcgtcatcagcgacgtatattagaataacaccttcagttgtctaagtcaatacataatatcaattaaatgataaattgcttaatgacgactaacgcagctattccgggtattcctaaaattccgctgatagctgttgtaaccagattaatcggcacatgaatgccaagactgccgccaaacatatttacacaaaccagcagcaaagcacctgccacaaatttaacagctgtgatgccaatccactttaaaggcttcgctgctgaacctgataaaaaagaagaataaccagtcctaaaataatcccaataataaaaataggctccatgaatcttctcatctccttcgcttgttctagtacaagcttatgagaagatccaggagtttagaccacttacttccaccggctgatttttaaatttcgctgcttcgcttcccttaagtaaaaaaatacttcgcttcagctactttcagttcgtataacacttcagcagacggttctaagcttttttcaaccagctttttttgcctgttccactcttccttttgcttaaaaagctgctcggttagtttttcatcaaactctcttcttaatgttttcttgcgaagaaaacccatggatcgctttttcctccttacaattcacgtcttccttcaagtgctttagaaagagtgacctcatcagcatattccaaatcaccgccgacgggcagtccgtgggcaatacgggagagcttaataccagacggcttgaggagccttgatatatacatcgctgttgcttccccttctatattagggtttgtcgcgaggatcacttctgtcacttgatcatcctgtaatcgttttaacaattctggtattttaatatcctccggtccgatgccgtccattggagaaatagcgccgtgaagaacgtgatactgtccgttgtattccttcattttctccatagcgataacgtctttagggtcttgcacaacacagataacagacttatccctgcgcgtatcttcacatatatagcaagggtcctgatctgtaatatgcccgcaaactgaacaatatgtcaggttgcgtttcgcatttactaatgctttcgcaaaatctaatactacatcttctttcatacctagaacaaaaaaagccagacgaaccgctgttttcggtccgatccctggcaatttcataaagctgtcaatcagctttgatattggttcaggatattgcatgttcttttatccccctagaataaacctggcatgttcattccctttgtaaattgacccattgtttcgtttgtgatttcgtcaacttttttcaaagcttcattcgttgcagcaagcactaaatcttgaagcatatcaatatcttcaggatcaacgacttcttctttgatgataacatccaggatttctttttggccgtttgcttttactgttaccataccgccgcctgcagttccttcaacaaccttttctgcaagctcttcttgagccttcgccatgtccttttgcattttttgcatttgtttcatcattttttgcatattacccattccgccacgcatagcattcactctctttcattttgttagtcttttatttcaattaaatccgctccaacaagctttttcgcttcggcaataagcgggtcttcttcagccggttcatttgatccttcattttcctgctgatgatcttctaaaaattcttctcttattttaccccattgtgcttctggaacgccaatcaaatccattctttttccgagcatcgattctaaaatctgctcaagattagtccggactccgttgttatcctcagcgaccattttacaatgaatttcatatttgaatttcagaacaaatgccgccgatccggcagccacaggttcactgtcattcagcaaagcggcatgtgatactttgttttgctgtttgagatgagcaagaagcttgccccaactgtttctgagcagatcaagatccggtcttgtggcttccttcaaaatctcatgaattctgcctactggcgctttgtaattggatttcccgccctttggcacacgcggcgcttcttttttcgggctttccgcagctgcttttatgcccgttgttttgagccgctctacttcctgttcgagctgctggatttttttcatcagcatatccacttccgggagatcagcagcagattgatgtgaggtttggcaaatcttcacaacggccacttcgaaaaagatacgcggatgatttgtccatttcatttcctgatggctcttgttcagaatatcaatcatttcatatagggcctgagccggaatttgttcacttagttcccggaacgtttcatcgacttttactttctcaagcactccctctaagccaggggctgttttgtacagcagcatgtccctgaaatagaaaatcatatcttctatcagcttagctggatcttttccttgctgaagcaattcatttaatgtttccagtgcgtcagaaacgtttttatcatgcagggattttgcaagcttcccgatatataattgagaaacagcacccgtaattaaaagcgcatcttcgactttcaggatatcgccgctgaatgatatggcctgatcaagaaggctcagggcatccctcatccctccgtctgcagcactcgcgatgatttccagcgatccttcctccacttgcagctgttcagcatcaacaattttattcatgcggcctacaatcgcttgggaggtaattcgtttaaagtcaaaacgctgacatctagagataatggttaaaggaattttgtgcggttcagttgttgctaatatgaaaatacaatgctcaggcggctcttctaatgtttttagtaatgcattaaaagcgccgatagaaagcatatgcacctcatctatgatatataccttatatgtgacggccgatggggcaaacttcactttatcgcgaatgtcacgaatctcatcaacaccgttattagaagcggcgtcaatttctatgacatcggatattgacccgtttgttatccctttacaggccgcacattcgttgcatggctcatcaacaggagcatgttcacagttgacagccttagcaaatattttggctgcactggtttttccggttcctctaggcccggaaaacagataggcgtgagaaaactttttttgcaaaagggcattttgcagcgtttttgtaatgtgttcttgtccgaccacatcttcaaagcgctgaggcctgaatactcgatataaagcttggtaactcacgggtttgccctcctccgttattcatcattcccattatacatgaaccttgtttcgattccaaaagctctttttacataacaaaaaactcacctaatattaggtgagtctgaaaatttgatgattgatttaccgtgcaccttctgtcgattcgctaccctaagcgttacttaagcagttagctcggcccaggcaaccctgcggcacatgagaggtttcacttaatgctgcttccttccggacctgacatggttcatgaattcccattgcgcaggacccaaacgtcaacaccacttacttaaggcaggccttaaagtaaacgaacctcgagaagggattcggccctgctagagcggattgcaggtacagggcaccgctacctccccgcttagcacggcaaaataaatatcaaattttatgttgcatctattacgatgcacacttaagtatatctgtttcccctaaaaattgcaaccgtactattcagacaagtttttcctggcggctttcttcttttttcttagttctctgaaaaacgcactgagcattccgccgcattcttcctcaagcacaccgctcaccacttcagcctgatgattaaagcgttcctcctgaagaaggttcattagcgtgcctgaacagccgcctttcggatcaaatgcgccaaaaaccactttttccactcgagaaagtacgactgcaccagcacacattggacaaggctcaagcgtcacataaagagtcgcaccttccagccgccatgttccgagtgccttacacgcttcatcaattacaagcatttctgcatgggcaatagatcgctgttcagtctctcttaaattatgcgcacgcgctataatttcaccattaatgacaagcaccgcacctattggcacttcacctttctcttcagcctttttcgcttctttaattgcttctttcatataaagttcatcttgtgtcataaggataagctctcttttcaaagttttttcattgcctaaaaaggctacatattaactataactgaaacggaaaggagactgtcgattgtccaaagcagataaagcccttctcattgtagacatgatcaataattttgaattcgatatgggggaaaccctcgctaaaaaaacagaaaaaatcgttcctcatattttatcattaaaggagcacgcgagacaaaatgaatggccgattatttacatcaatgatcattatggactttggcaagctgacattaaaaacatacagcaagaatgcacaaatgaaagaagcaaggatatcatcacaaagatagctccggtagatgctgattattttttaatcaaaccgaaacattccgctttctacgaaacagcacttcacacccttcttactgagttgcaggtgagacatattatcataacaggtatagccggcaatatatgcgtgctgtttaccgctaatgacgcttatatgagggaatacagcatcacgattcctaaggactgtatcgcgtcaaacagtgacgaagataacgaattcgccttaaccatgatggagaatgttcttttcgcagaaattacgacggaagaacaaattatagaaaaataaacatgatcagcgcttttctttcatacattgatagcgatatgaaaggaggcgtttttcattcaaatttatgtggtaaaacaaggcgacactctttctgctatcgcttcacaatacagaacaaccacaaatgacatcactgaaacgaatgaaataccgaatcccgacagccttgttgtcggacaaaccattgtcattccaatagctggccagttctatgatgtgaagcgaggtgataccctgacatccatcgcccggcagttcaatacaacagcagccgagctcgcaagggttaaccgcatccagttaaataccgtgcttcagattggtttccgtttatacatccctccagctcctaaacgagacatcgaatcaaatgcttatttggagccccgaggaaatcaagtcagcgaaaatctccagcaggcggccagagaagcgtcgccctacttaacttaccttggcgcattcagcttccaggcacagcggaacggaaccttagtcgcaccgcctttaacgaatttaaggagcattacagaaagtcaaaatacaacattgatgatgattataacgaacctagaaaaccaggcattcagcgatgaacttggccggatccttttgaacgacgaaactgtaaaaagacggcttctaaatgaaatagtcgagaatgccagaagatatggcttccgtgacattcatttcgactttgaatatttgcggccccaggatagagaggcctataatcaattcctccgcgaagcaagggatcttttccatcgagagggcttagaaatttctacggctcttgctcctaaaacaagtgcaacacagcagggcaggtggtatgaagctcatgattacagggcacatggcgaaattgtcgactttgttgttctcatgacatatgaatggggctatagcggcggaccgcctcaagcggtttctccaattggacctgtccgtgatgtcatagaatatgctttgactgaaatgcctgcgaacaaaattgtcatgggccagaatttatatggatatgactggacgctgccatatacagcagggggaactccagcaagagcagtaagccctcagcaagccattgtcatagctgatcagaacaatgcttccattcagtatgaccaaaccgctcaagctcctttcttccgctatactgatgcagaaaacagaaggcacgaggtatggttcgaggatgcccgctcgattcaagcaaaattcaatctgattaaagagctgaatttaagaggcatcagctattggaagctgggtctttcctttccacaaaactggctgctgctgtctgatcaatttaatgttgtcaaaaagacgtttcgataatttggaaacgtctttttttcatgggggcacccaagggttgtgatacaatatgaaggtcggtaactgacgcacgtttttcagatataaggaggattccgatgaatacagccccttttattgcaatagaaggtcctatcggggcaggaaaaacaactctcgcaacgatgctctcacaaaaattcggattccctatgatcaatgagattgtagaggataacccgtaccttgataagttttatgacaatataaaggaatggagcttccagctcgagatgttttttctttgtcacagatacaaacagcttgaagacaccagtgatcactttttaaaaaagggacagcctgtaatagctgattatcatatttataaaaatgtgatttttgcggaacgaaccttgtctccacatcagctggaaaaatacaaaaagatatatcacctgctaacggatgatctgccaaagccgaatttcatcatttacataaaggccagtctgcctacattgctacaccgcattgaaaaacgcgggcgcccctttgagaaaaaaattgaaactagctatttggagcagctgatttcagattatgaagtcgccatcaagcagctgcaggaagcagaccctgaacttacagtgttaaccgtagatggtgattcaaaggatttcgttttgaataagagcgactttgaacgcattgccgcccatgtaaaggagcttatcgtatgaaggaacatcatatccctaagaattcaattattacagtagcaggaacagtaggtgtcggaaaatcgactttaacaaaaactttagctaaacggcttggatttaaaacatcgttggaggaagtcgatcataatccatatttggaaaagttctatcatgattttgaacgttggagctttcaccttcaaatttacttcttagctgaacgcttcaaagaacagaaaacaatttttgaagccggcggaggttttgtacaggatcgttcgatttatgaagatacaggaattttcgcaaaaatgcatgctgataaagggacaatgtcaaaggttgattataagacttacacaagccttttcgaagcaatggtaatgacaccgtatttcccacatccagatgtgttgatctatttagaaggagatctggagaacattttaaaccggattgaacaacgcggccgtgagatggagcttcagacaagccggtcttattgggaagaaatgcatacacgctacgagaactggataagcggttttaatgcctgccctgttttaaaacttcgcattgaagattatgatcttctgaacgacgaaaactcgattgaaaatattgtagatcaaattgcttcagttattcatgataatcaaaaaaagtgaatctcagtcgagattcactttttctttaaaataaaaaatccgccgcaccgaatgcaacggacaaaacaatctccaatatatgcttgtgtttcattagaattaaaatcaatatggcggaggaagagggattcgaacccccgcgggctttgacacccctgtcggttttcaagaccgatcccttcagccggacttgggtattcctccgtatcgacaagactaactatatcacgtatgttctcgtgtggtcaagcatttttaaaaacttttttgtttttatgaaaatgccgtgtttacataagcaaaaaggcgcaccttgtcaggcacgcctttccataatttacggtttcattacttctctattccccatataaggacgaagcactttcggaatcacaacgcttccgtcttcctgctgataattttctaagatagcagcaactgttcttccaaccgccagtcctgagccgttcagtgtgtgtacatgctcaggcttgcctttcgcttcacgtctgaaacgaatattcgcacgtctcgcctggaacgcttcgaagttgctgcaagaagagatttctcgatatgtgtcttggcttggaatccaaacttcgatatcgtattttttcgcagccgtaaagcctaagtcacccgtacacatgctcatgacacggtatggaagctcaagcagctgaagaacccgttctgcttggtttgtaagtttctctaattcttcataagaatcttcaggcttcacaaactttacaagctcaactttattaaattggtgctgacgaattaatccgcgtgtgtcacgtcctgctgaaccagcttcagaacggaagcaagcactgaatgccgcatagttgatcggcaggctgtcacctgaaaggatttcatcgcgatgcatgtttgtaatcggcacttccgccgttggaattaagaaataatcttcttctctgattttaaatgcatcctcttcaaatttaggaagctgccccgttcccgtcatgcttgcgcggtttaccatatatggcgggatcacttcagtgtagttatactcatccacatgcagatcaagcataaagttataaagcgcacgctccagacgagcacctaagcctttatagaacacgaaacggcttcctgttactttggcagcacgttcaaaatccagaatacccagctcatccgcaatatcccagtgcggcttcggctcataagcaaatgaaggcttttcaccccatttacgcacttctacgttgtcgtcttctgtttcaccgacaggtacagactcatgcggaatattcgggattgagagcaggattgtatcaagctcagcttccactgtccgtaattcttcatcgagctttttaatttcctcgccgacttcacgcatttctttaataatgtgatccgcgtcttttttctcacgcttcagcacagcaacctgctgagaaacttcatttcgttttccttttaactcttcaaccttgccgataagctctcttcgtctatcatccagcgcctcaaacttatcaaaatcagttaagtcttcgcctttgtgtacaagctttgctttaatttcttgaaaatttgctctcagcattttcgtatcaagcatgcgaaacactcctttttttattgatttatcgaaaataaaaagagccctcatccccataaagggacgagagctctcgcgttgccaccctgattgaaaacaaatcaaagactcgttttccactttcaaacataacggttatcccgtaaatgcctactcgcttcagcatttcgctcaaggatggattcagacagcatctttcaccgattcgcaccaaccatcggctctcttagaaagagaggctccctactagttcctatcaacgcttttcgatctttatttgtgcttataatgtactataagtttccacagctttcaactgttttatacaagtgccttttgcttatattcctcaaccatttcaacaaacagctgcgtcactcggtgatcttctgtcagctccggatggaatgagcagccaaggaattgcccctgtttcgcggctacaatacgaccattatgctccgatagaacttcaacattttcaccagcttctaaaatatgcggagcacggatgaataccccagtaaaaggctcgtccaagcctttaattgttaaatcagcttcaaagctgtcaacctgccggccaaatgaattacgttctacaaccacattcagaagacctaaatgaggattatctgaaccggcaatttcttttgctaatataattaatccggcacatgttccaaacatcggtttgccctgagcagcgaattcacgaagcggctccatgaattgatacgtatcgatcaaacggcgcatcgtcgtgctctcaccgcccggcaaaatcaacccgtcaacttcgttcagctgctccggacgttttacgacaagaccagccgcgccgcatgcttcaatcgcatggatgtgctctctaactgctccttgaagtcctagtacacctattgttaacatgtcagcagcgctcctatgttcttaccagccgcgttcttgcatacgctgttctggaagtaagtttgagatttcaatccctttcattgcagtaccaagctcttttgacaactcagcgattaatttgtaatcagtaaagtgagttgttgcttccacaattgctttcgcaaatttagcagggttgtctgatttaaaaataccagaaccaacaaatactccgtcagcaccaagctgcatcatgagagcagcatcagctggagttgctacgccgccagcggcaaagttaacgacaggaagcttgccgtcttttttaatttgaagaagaagctcgtaaggagcacctaggtttttcgcttctgtcattagctcatcctcactcatcgcaactactttgcgcacttgagcgttaactttacgcatatggcgaacagcctcaacaatattacctgttccaggctcaccttttgtgcgaagcatagaagcaccttccgcaatacggcgtgttgcttcaccaagatcacggcagccacagacaaaaggaactgtgtattcatttttatttaaatgaaattcttcgtcagccggcgtcagaacttcactttcatcaatatagtcaacacccatagcttcaagcacacgcgcttcaacaatatgtccgatacgcgcttttgccattaccgggatagatactgcattcattacttcttccacgattgtagggtcagccatacgggcaactcctccagccgcgcgaatatctgctggcacacgttctagcgccattacagcgacagctccagcttcttcagcgattttcgcttgttccgcattgatgacgtccatgatgacgccgcctttttgcatttctgccattccgcgttttacacgttcagtacctgtttgagccatttcttggtccccctaatcaaggtatagttatatgatttctaatccttattgtatcctagaaatccaataattcatatgcatatatactattttattcggtttttagcgctttgaaaatcattttttattaaaaattgggttttttcagtatattacgcgaaagagccctaacatccatcagagctctttcaattgattaaaaccagccggttaccgtatcaacaatgcttccccaaattccggcaaaaaatccgccgatactgcgcattgtcaaaacaaaccagtttgctttttctacattttcttttgtaacaaggtctacgccagccagatcgctgttaaggaatccgtaatccttttcatcacctgtgtattccgcagtcagcttcccaaccttggttccttttttcacaggagcagttaagttgtctttattcagtgtgaccttcgctttgtaattcttttcttcaccatttttgacaggaagagagaacgccttgtttgtcacaatgcctacttctttctctttacccttatcaactgaaattgttttatggccttttacttgatcgccttcagcataaatttctttcatggagaaattgtcgaaagcataatcaaacatttttttcgtttcatcgaaacggcctgtatgaaggttgccctttgcgtttaaaacaacagtgatgacacgcataccgttgcgttcagctgttcctgtaaagcatgaacccgcagagtcagtagaacctgttttcagtccgtctacagtcgcttttttatactcgctgacaagccccttcagcataaaattccagttcggcatgtccatttcatcatcggtgccttctctgaatttcgttttggcgatactggaagtctccagtatctcagggtagtcagtaatcaagtgatccgcaagaaccgccatatcctttgcagaaacttcactttcttcatttacgcttgtcccctcaggctgatgcccgtgaagatctttgttttcaagacctgttgcgttaacaaatttgtaatctgttaagcctagttcttttgcttttgcattcattttttcaacaaacttagtttcagaaccggcaacgatttctgcaatcgcaatagcagcagcatttgcagaataaattgctgtagcttgatataattcttttactgtgtatttcccgtctttccgaagaggaacgtttgataagctgttatcttgggaaatttcatacacatagtcatcaggcgtataggtttggtcccatttcactttaccttgatcaattgcttccaataacagatactctgtcatcatttttgtcatactcgcaattggcagtctcttatctgcatttttactgtaaagaattttacctgaagaagcttcgatcataatagcagcagatgcattgatatcaattggatcgctggctgctttcgcttttgacattggagccagacacgtgacagctagagttaacacaaccaatgacatcagtagctgtttacatttcttgatgttcaatcgtacgacctccgtatttcattttcttcatctataattaagccgttaaggacattttcaatgcacaacagtataaattttatcataatcagtataaaaaaaatagacagagtcagagaccctgtcaaatgtttttaatttgtaacaatttattatgaaattgtatagttaggtgattcttttgtaatctgtacgtcatgcggatggctttcgcgaagtcctgcgccagtcatgcgaatgaactgagcttcttctcttagcgcacgcagatctttggacccgcaataccccataccagaacgaaggcctccgactagctgataaacggtttcttcaactggccctttgtaaggtgtgcgtccttcaattccttcaggaacaaattttttgttttcttcttggaagtaacggtctttacttcctttttccattgcagcaactgatcccatgccgcggtataccttaaatcttctgccttggtagatttcagtttcaccagggctttctgatgtgcctgcaagcaagcttccgagcataacagcatgtccgccggctgccaatgctttagtgatatcgccagagaatttaatcccaccgtcggcgatgattgttttgccgtgttttcttgcttcagtcgcacaatcataaattgctgtaatttgcggaacacccacgccggctacaacacgtgtagtacaaattgaaccaggccctattccaactttgacaacgtctgctccagcttcgataagcgctcttgtcgcttcagctgttgccacgtttccagcaataatgtttaattcgggatacgtttcacggatttttgtgactgtgtttaaaacgccttgagagtgtccgtgagctgtatcgataacaatcacatcaacattggcttcaacaagctttttgacgcgagtcattgtatcgccagttacaccaactgccgcgccaacgatcaggcggccgtgaatgtctttagatgagttcgggaactcaatgactttttcaatgtctttaattgtgataagaccttttaatttattctggtcatctacgagaggaagcttttcaattttatgtttctgcaaaatcttttcagcttcatccagagtagttcctacagatgcagtaactagctcttctttcgtcatgacgtcgctgattttcattgagtagtcagaaataaaacgaaggtcacggtttgtaataattccaacaagcttctggtcttcttcgttatttacaatcggaacaccggaaattctgtatttccccatcaaatgctccgcatcaaatacttggtgatcaggagttaaaaagaagggatttgtgataacgccgcgctcagaacgctttactttatcaacttgttcagcctgctgttcaatggacatatttttgtgaatgatgcccaagccgccctgtcttgccattgcaattgccattgctgattctgttacagtgtccatacctgcgctgatgacaggaatatttagctttaacgtttttgtaagttctacagataaatccacatcacgcggaagtacctcagactttgctggtacaagcagcacatcgtcgaacgttaagccttcttttgaaaatttactttcccacattagtaaatccccctcttttcggcaaaatattatatgtagattatcaactagccaagagcatgtcaaggaagcgggaaagagttgaaatatttagataacggaaaggattaagaaatatacatgacatatcatgagtggaaagacttagcgctattttactccgttgaatcaacccagaaatttctagaaaaggtttatatcttaaacggtattaacgatgcgaaaaaaaactcttttaaaaacagtgaacggtttatttatttcttaaagcatgccgaatcgttttataaacaagccgcatattctcccttagaaatcaaaccgattcttttattttatggaatggcacagcttatcaaagcatgcttaattacacgtgatcctcattatccaagccatacatcagtactggcacatggcgtaacaacaagaaaacgaaagaaacaaaattattgttttagcgacgatgaagtgaaaatacaacggaatggcctatgcgtacattttatgaaacatttattcggacaatcggatatagtagatgaacggtataccatgaaaaaattattaatggccattccagaacttagcgatattttctactttcagcagaaagaacgatttatgacaaaagttgagaaggataagaacgaaatttttgtaccggaggaagtagtaatcaattacaaaatgtctgattcaaggtttgctgaatacatgtcccatcattatcaatggtcttttacaaaaaaaatgaacacgggctgctgttcgaaatttcaccacaagacaaggagccatggacatcgaccagcttattgtttgacatggaaaagaaccaatattatatcccttctcaaagggagcaatttctgaggcttcccgaaatgacaattcattatttgattttgtacaacgttgggatgattgcaaggtatgaaacagaatggtggtatgagttattaacacagcatataagtgatgactacgtgttaattcagcagtttttattagtatcagaaaagaaattccctaaatacgcttcacagtttcttcttcatttttaacaaacaaaaaacccagctcattgagctgggtttaagc

SEQ ID NO: 44 - DNA, 2966 bp, Bacillus subtilis WAUSV36; identical to SEQ ID NO: 41

SEQ ID NO: 45 - DNA, 1527 bp, Bacillus subtilis WAUSV36; identical to SEQ ID NO: 42

SEQ ID NO: 46 - DNA, 1049070 bp, Bacillus subtilis WAUSV36
tttataaaaatgaattaacaggtacgttttgtcttgtttagttttcaaagaactttgtgtgcttctctcaaagcgactacttaatagtaacatttttagttaactaggtcaatacttttttgaaaaagtttttactagtcataatggtcatgcttgtgtctttaaaaagacaacagaaatgattataccataatttttatgactgtaaagggttatgacacaaaaaagcgcagctatttcagctgcgctttttttcacacttcttcttgttcttcttcattctcatcttcttcgtttttctcaactaaagctactgtagcaacatgctcttcttctgccattctgatgagacgcacaccttgagtgacacgtccggtgatggagatatcattgatgtccattctgatgagtacgccgctagctgtaataatcattagatcctcttcacctttagtagctttcactgctactagttggccgttgttctcggtgattttcgctgttttgagtccttttccgccccggctttgggttctgtactcttcagcaggagttcgttttccgtaccctttttcagttacgataaggacgtgtgattcttcctctaaaatctccatgccgacaacaacgtcgtcatccgtcagggtgatgccttttacgcccgccgcagttcttcccatctctcggacatctgtttcagggaaacgaatcagtaaaccgtttttcgttccaatgatgatttgttttgtgccgtcagtcagacgtacacccatcagttcatcatcttcacgaagactcagagcaattagaccattgttgcggatattagcgaattgagatagcgatgttcgttttgaaaccccatgctttgtagtgaagaagaggtaaagctccgcattgaattccgtgactggaataatcgcgttgatccactcacccttttctacctccagcaggttaataatcgggattccttttgccgttctgccgtattcagggatttcatacccttttgcacgatacactttccccttgttcgagaagaagagaatcgtgtcatgagttgacgtagagatcaaatgttcaacgaaatcatcttcgtttgttcccataccttgtacaccttttccgccccgtttttgactgcggtaagttgatgcaggaagacgtttgacgtatccgttgtgcgtcagagtaactacgatattttctctctcgatgagatcttcatcttcaattgtctccagtccagaagtgacgatctcagtacgtctttcatcgttaaaacgctctttgatttccgtgagttcttcacgaatgatctcaagcactttatattcatttgccaagatgtcttttagctctgcaattaatttaacaagagactggtattcttcttcgatcttttcacgttccagtcccgttaaacgctggagcctcatgtcaaggatcgcttgtgcttgcttctctgtcagtgagaattgttcaattaaacctgttctcgcaatttcagccgtttgagaattacggataagggagataactgcatcgagatgatccagtgcaactctcaatccttccaagatatgagctctcgcttctgctttacgcaattcataagcagtacggcgtctaatgacaactttttgatggtcaaggtaatgctccaggcattgcttaagagttaaaactttcggctggccatcaacaagcgcaagcaggttgatgccaaaagatgtttgtagagcagtttgtttgtacagattgtttaagataacattcgcattggcatcgcgtctgatttcaatgacaattctcatacctgtacgatctgactcatcacgcagatctgtgataccctctatctttttgtcccttacgagatcagcaattttctcaattaatttcgccttatttacttggtaaggtaactctgtaacgataattctttctttacccgaagatgtttgttcgatctcagcttttgcccggatcgtgatagagcctcggcctgattcgtatgctttccggataccgctgcgtcccaagatttgacccgcggtcgggaaatcaggccctggaatgacttccataagctctggaattgtaatgtccggattctcactaacagcaagtacaccgtcaatgatttctcccagctggtgcggaggaatgtttgttgccatacctaccgcaatgccggcagcaccgttcacgagcagattcgggaaccttgaaggcataacgacaggttctctttctgacccgtcatagttatcctggtaatcgattgtgtcttttgtgatgtcgcgaagaatctccattgagattttagacattcgtgcttctgtataacgcatggccgccgctgagtctccgtcaacagaaccgaagtttccgtgaccgtcaacgagcatataacggtagttgaaatcctgagccattctgaccatggattcatataccgctgaatcaccgtgcgggtggtatttcccgataacttctccaacgatacgcgcggattttttataaggcttgtcacttgtcatgcctaaatcattcattgcatacaaaatccgtctatgaaccggttttaaaccgtcacgaacatccggaagagcacgggacacgataacgctcattgcataatccaagaaggacgtacgcatttcctgactgatatttatttcacgaacttgtggtgtgttttgttcactcattaaaaaacctccctgaagtatcacatgaaatatgtgggagtagattgtccattatgaccttcaatacgatttcactattctccattatatcaataaacttatgattatacacattaaattgctagaatatataggtattgcaggcatcgctgcatctgatcttgttcagaaaaaagccttatttcttattggaaataaggctttttatgattagatgtcaagatttttaacgtatctcgcattcgcttctatgaagtttcggcgcggttctaccttgtcgcccataagcatttcaaaagtctcatccgcatccattgcatcttcaagagttacctgaagaagtgttctggagctaggatccatggttgtctcccatagctgggtggcattcatttcaccaagacctttgtaacgctgcagtccaggcttaggcgtttgaggaagagtttttaacagctcttcaagctccttgtcattgtatgcatattcaacgcgtttcccctgttgaaccttgtagagcggcggctgcgcaatgtacacgtagccattttcgataatttggcgcatatatctgtaaaagaacgttaacagcagtgttctgatgtgcgcgccgtcaacatcggcatctgtcataatgacaactttgtggtaacgggctttctcaaggttgaagtcttctccgatacctgtgccgagcgctgtgatcatagagcgaacttcgttgttagaaaggattttatccagtctggccttttcaacgtttaggattttacctctaagcggcaaaatggcttggaaatgtctgtcgcgtccttgtttagcagatcctccggcagagtcaccctctacgatatataactcggagatgctcggatcttttgaagagcagtccgctaacttaccgggcaggtttgaaatttccaaagcactcttacggcgtgttagttcacgcgcttttttcgcagccattcttgctcttgccgccattaaacctttatcgacaatttttttggctgcatctggattttccagcataaatgtttccatcgccgtagaaaataacgtatcggtgatcgtccgtgcttctgagttgcccagctttgtttttgtttggccctcaaactgcggatcagggtgtttgattgaaataatcgctgtcagcccttcccttacgtcatctccgcttaggtttggatcattttctttaataagccctttttttctggcgtaatcgttgataacacgagtcaggcccgttttgaagccagcttcatgggtaccgccttcgtacgtgttaatgttgtttgtaaacgagtaaatgttgcttgtgtagctgtcattgtattgcaaagccacttcaaccgtaatgccgtccttttcgccttcaatgtaaatcggctcttcatggacaacctctttagagcggtttaaatactctacataacttttaattccgccttcgtaatggtattcatttttgcgctcttgtccttcacgtttatcttcaatcgtgatgtttacgccctttgttaaaaaggctaattcacgcacgcggttggcaagcagatcgtaatcatactcggttgtttctgagaaaatttcagggtccgggacaaaatgtgtcgtcgttcctgtatgatccgtttcgccaatgatttcaaggtctgtaaccggaactccgcgtttataggtttggcggtgaattttaccgtcacggtgaaccgtcacatcaagctctgttgatagtgcgtttacgaccgacgcacctacaccgtgtaatcctccggatactttatagccgcttccgtcaaattttcctccggcatgaagcaccgtcataatgacttctaccgcaggacggcccattttttcatgaataccgactggaataccgcggccattatctacaaccgtgatactgttgtctttttcgatttggatattgatatccgtacaataaccggcgagggcttcgtcaatactattgtcgacaatttcccataccaagtggtgaaggcctttgctgtttgtcgaaccgatatacatccccggtcttttacgaacagcttccaatccttctagtacctgtatctgattttcatcataactgttttgctgctgttccatagccacgtcattcacctacacttttctaaacgatatattcgtgataaaaaatttctaagaatctatttcaaacataaattgcgcacgtttttttaatgtgctggaagataagggagagtaatatatattctgaaccgtgactacgatagatttgggcgtgccgtttacggaaggcaccaccttgtgtttctgttttttcagaaattcttcaacaataggcgacatgttggctttaaagtcaaaaatgccgacaatatctcgtgttgaaaccacaaagtcatcacctaaatgaatatacaattgctcacctcatttcttcacttcactaacgcaccattttgcacacggaacattcctgcttgacgtaaggtttcgtgatcaatgccatcaacgcttgtcgttgtgacaaacgtttgtacacggccttggatcgtatgaagcaagtgtgactggcgataatcatccagttcactcagtacatcatccaatagtaaaatgggatattctccgatttcttcatggatcaggtcaatctccgccagcttaagggacaacgccgtcgttcgctgctgtccttgagaaccatacgtctgcacatcgcgtccgttcacatagaaaagaacatcatcgcgatgaggccctgacagcgtcacaccacgctcaatttctttttctcttaatttagaaaacgcttcttgatagctatctcctattttcgacaaatctaggggatctgatacatcaagagctgtatggtatttcagggtcagttcttcaagccctcttgagatgcctgcatggatgggctgcgcccatttctcgagctgtgctgtaaactgcaggcgttttacgacgacttttgctgcaacttctacaagctgatcggtcagaacatcgagcatcgtccggtcagtttgttttcttgtttgcagctgtttcaaaaaatgattccgctgggaaaggattttctggtaaagagaaagatcatgaaggtagacgggagaaacctgtccgatttccatgtcaagaaaccgccttctcacttgagggcttccctttacaagatttaaatcttccggcgcgaacataatggtgttgagggccccgacatactggctgagcttttgctgttcaatatgattgaccttgccctttttaccctttttggagatgacgagctgcatcgggatcgccccgttttgcttcatcactcttccctctattttagcatagtctttgtcccaccgtataagttctttgtcatttgatgtccggtgcgatttcgccatggacaagacatagatcgcctccatgaggtttgtcttcccctgggcgttttctccgatgatcacatttactttattttcaaattgaagttcagcatggtcgtagttgcggtaagatgtcagttctaagttctggatatacaatcagtgtcacccgctttaattgacgacttgaaatgaaccaaatccttcaatctctaccacatctccaacatacagctttctgccccggcggttgtccggctcatcgttcacaagcacttcatgctcgcttaaaaaccacttcgccataccgccagactgaatcacatcggctaattttaagaattgtccgagtgtaatcatctctgtatcaattgaaatcggatttgccattatatcgacctctttcaaatatcactaatatctaattgtactaaaaaaaacgaattagggaaagggaaaacttgtcggagcagataccgaatagaaaagctgccgacgggtcggcagcagtgtatcggattaataggttctgacaggaaggataagctgtacaatcgtttcatcattcggcgtgcgaattaagaaaggtctcattgcgcctgtaaagcttacgcgtatttctgctccttcaagcacctttagtgcatccagcatatattttggactaaaagagatatttaattcctcaccttcaatttgatccgcaacaattgcttccacaactttaccgatttctggcgaattggaagaaatttcaatggattcagccggttttgcggacagttttacaacgttgttgcgtccctctctagctaaaagagatgcacgatcaatggcctgaaggaattcttttgtgttcacaatgatttctgttttgctgtcttgcggaatcaggctggttgtgtctggataattcccgtccagaagccgtgagaagaacaagacgtttttcgctttaaacagaacttgggtttctgtgatgacgatatctacaagttcctggttgtcatctaaaatcttgctgagttcagttaaactttttcccggaatcacgacgttataagatctgtcttctggaatatcaagtttcgcctttcttaatgcaagacggtggctatccgttgcagtgcataataattcactttgctccactttccagtttacacctgtcaagatagggcgtgtttctgaggtggacactgcaaatactgtttgtctgattagattttttaacaaatcagttgggatctgaatcgcatgatgctcttcaatctgcggcaagtgcggatattcatcagcatccagtccgtttagattaaattcagctttaccagaacggataatcgtcaaatactgattttggacttcaatttctacagttgccatcggcaatttttttacaatttcactaaaaaagcgagcctgtaaaacgatgcttccgggctgttcaatagtgacgatttctttatctccttcttcttttggaatgaaggattcaatagaaatatctgagtcactccctgtaaaggatactccatcatctgatgcaacaattttaataccagtcagaatgggaatcgtggttctggatgaaactgcttttaatacatcttggacactttcaacaagacgatctttttgaatcgtgaatttcatttttatcctcctaacggataatgtattaatatatatatttataaaaaatagtagaagtaatagtagggcctgtggatttgtggataagttgtgaaaaagacaggaaacacagcctatccacatgtggacagactgtgtatgacttccgaaaagttattcacactttccccgattgatccccggtcctgctatttaagctgttctttaatttcttttacatgctgctgaagctgttcatcatctgccagcagttttgaaattttttcatgcgcatgaataacggtcgtatgatcacgtcctccaaactcttcaccgattttaggaagagaggaatcagtcatttcccttgataagtacatggcgatttgacgcggaaaagctactgactttgtccgtttttttgctttgaaatcctcgagtttaatattaaattgctggcctactaccctctgaatttcttttatcgtaatgactttcggttttgaggaaggaataatatctttcaacgcctcagcggccagatcagcattaatatctttattaattaaagatgaataagcgacaactctgattaatgctccttcgagttcccgaatattgctgtcgatttgattcgcgatgtaaagcataacctcgttcggaatatcgaggccctctgctttggccttttttcttaaaattgcaattctcgtttctagatcaggcggtgtgatatctgtaataagtccccattcaaaacgtgagcgcaatctgtcttcaagtgtcggaatttcctttggcggccggtcacttgaaatgacgatttgtttgctttcttcgtgtaatgtgttaaatgtatggaaaaattcttcctgggtttgttctttccccgctaaaaattgaatatcatctatcaaaagcacatcaacatttcgatagcgattgcggaagtcgacggctttattatctcggatagagttgatgaattcgtttgtaaatttctcagaagacagataaaccactttggcagaaggattatgatctattacataatggccgatcgcatgcattaagtgtgttttccctaagccgacgcccccatagataaataaagggttgtaagctttcgcgggcgcttccgctactgcgagggaagcagcatgtgcaaatcggtttccagatccgatgacaaaagtatcaaaagtatattttggattgagcatattttgaggaaaatcagatgtatcttctttgaccgcttttttgacttgcggtttcggcataaagtcctcaacatcttgattttgaggaatgacaaacttaatgctcaattcttccccggttaattcatatatagtatctgcaatcagatgcaagtatctggactccagccagtctctggcaaattcattgggagccgtgattgttaatgtatcgccttgcagtgagtgggctttggttgacttcatccaagtctcaaaactcggtttgctcaactttttttcgatttgagcaagggcttggttccacaggtctaatatattttccatcttccggcacgtccctccttttcttagaaaatggcgtctttctctgttatagaacacaaaaaaagagcaaatggcgcttaccattcgtacacattaaatgttgaaaacatataatatagtagataaatagcttttcgacaaatttcacaacttgtggacaaccttctacacaagctgtgtgaaatcaatccacaacttatccacactttgtggataaagaggaaaggtaggattagtaatcaagagttaaaacacaaatataataccaaaataaacgagagcttgcaatggttgtcacaatcttatccacaaagcggacaacctgttgaaaaaaccttgtccacaggggttggtaatgtgaaaatgttgtcgataacctctgtggatactaaaaaaagccgaaaaagatatccacatgcgtgattttaggggcaaattgtttgaatttgtcttttttccgtaaaattaaggaatctaaaaaataaggtttcgaaagttgaaaaggtatggtatcctattatggttgcaagaaataaaagcactagtgaagttgacaatgaataggtaacgcaaatataataagtaagactgtctttaacagctattcctcgagggaggtgtcataaatgaaaagaacattccaaccgaataaccgtaaacgcagcaaagttcatggcttcagaagccgtatgagttcaaaaaacggtcgtctagttttagcacgccgtcgccgcaaaggcagaaaagtattatcagcttaggccactgaataatgtcagtggtcttttttcacgttatgggaaaagatagatgtgatgcgtaatgaaccggggcatgcttcctggttcagatgcatctcatgttcataataaattttaaaagtttctgccagccagtatcggagtgagtcatttgaagaagcgaaatcgtttaaagaaaaatgaagattttcaaaaagtgtttaaacatgggacatcagttgcaaaccgccagtttgtcttatatacgcttgatcagcctgaaaatgatgaactgcgtgtcgggctttccgtcagcaaaaaaattggcaatgctgtgatgcgaaatcggatcaaacgtttgattcggcaggcctttcttgaagagaaagagagactgaaggaaaaggattacatcattattgccagaaaaccggcgagccagctgacatatgaggaaacgaaaaaaagtctgcagcatctattcagaaagtcttcattatataagaaatcttcgtcaaagtaggcatcaccactgctttcttacaacttttaaaagcgcttcctttctggttgatcagaaaaagacaccatttaaaactgaaagatgctaaaatacatacaagtatgctttgcaataaaagagtgtaaagattaattataggaggaaatgttgttgaaaaggagaatagggttgctattaagtatggttggcgtattcatgcttttggctggatgctcgagtgtgaaagagccgatcactgcagatagtccgcatttctgggacaagtacgtagtatatccattgtctgagctcattacgtatgtagcgaaattgacgggagataactacgggctttcaattattctagttaccattttaattcgtttattaattttaccgctgatgattaagcagctgagaagttcgaaagcgatgcaggctttacagcctgaaatgcaaaagcttaaagaaaaatacagctcaaaggatcaaaaaacgcagcaaaagcttcaacaggaaacaatggctttattccaaaagcatggtgtcaatccattggcgggatgtttcccgattttgatccagatgccgattttaattggattctatcatgcgatcatgagaacccaggcgatttcagagcatagcttcttatggtttgacttaggagaaaaagatccttactatattcttcctatcgttgccggtgtcgctacatttgttcagcaaaaactgatgatggctggcaatgcgcagcaaaatccgcaaatggcgatgatgctttggattatgccaattatgattatcgtatttgcgatcaacttcccggcggctctttctctttattgggtagttggtaacttgtttatgattgcgcaaactttcctcattaaaggacctgatattaaaaaaaatcctgagccgcaaaaagccggaggaaagaaaaagtgaggaatgtgactgctgcagggcgaaatgtcgatgaagcagtacagtccggattgcaagagttgggattaacgaaggataaggtagaaattactgttattgaagagggaaacaaagggtttctcggtattttcggtaaaaagcctgcgatcgtaaagctggttgaaaagattgatccgattcagcaagcgaagttatatcttcaaacgattgccgaagccattgccgggaagtctgatgtgactgttcaagaaagcaaaaagacagtgagatatcatataacaggtgaaaaggcagcattgttaattgggaaaagaggacaaaccttaaatgcccttgaaactttgacacagcttgcccttaaccgttatccaggccaatataaaaatgtgacggtggatgcagaaaactatcgtttgaaaagaaaagaaacactgagccagctggccatcaagcttgctgaccaggttttgaaaacgaaaaaatccatccagcttgagcctatgccgtccagcgaaagaaaaattattcacgatactctttctggatatgcaaaccaccagatcaaaacatattcaatgggagagggcgaaaatcgtcatctcgttatttcccataaaagatagcataaaaccgaagtccgataaaaattggatttcggtttttttgtatccgaaaaatccacttttcctagtaatatcaaggttttgccgtttaagtttttctttttaggtgtatcctgttgataaaaaggaagttcaggaaataaaattaattgttattcacatgtggataagttaaagtaataagggacgaatttctatttctgtggataacaaatcttccacttcgaaccaaactatgttatcttttagttttggcataataaaaatttttttatatagatgaagtataagtaaagagaggtgaacaacatggatacaattgcggcaatttccacaccgatgggagaaggtgcgattgcgattgtacggttgagcggaccagaagccattcaaatcgcagataaaatttataagggaccgaaggggaaaacactcagctcggtcgaatcacatacgattcattatggtcatatcgtagacagaccttcggatcgtgtcgttgaggaagtaatggtatcagtgttaaaagcgccgagaacttttacacgggaagatgttatcgagataaactgtcacgggggaattgtgactgtgaaccaagtgcttcagctcgcattgagagagggagcgagactggcagagcctggcgaatttacgaaacgtgcgtttttaaacgggcgtatcgatctttcacaggcggaagcggttatggacttaattagagcgaaaacggaccgggcaatgaacgttgctatgaatcaaatggaagggcgtctttctgctttggtgcgccgtttgcgcagtgagattttagaaacactggcccatgttgaggtgaatatcgattatccggagtatgatgatgtagaggaaatgacgcatcagattttagtcgaaaaggcaaccgccgtgaaaaaggaaattgaggcgctgctgaggacttctgagcaaggaaaaatcttgcgtgaaggtctttctaccgtcattatcggccggccaaacgtaggaaaatcatctcttctgaacagcctcgttcatgaggcaaaagccatcgtaaccgatattcccggaacgacacgggatgtgattgaggaatacgtgaatgtaaggggcgtcccgcttcgtctggttgatacagcaggtattcgtgaaacagaggatattgttgagcgaatcggtgttgaacgttctcgccaggtcctaaaggaagcggacctgattttacttgtgcttaattatagtgaagagctttctgaagaagacgtgaagctttttgaagccgttgagggcatggatgttatcgtgattttgaataagactgaccttgaggcgaagattgacactgaacgtgtccgtgagcttgccaatggacgtccagttgttacgacatctcttttaaaagaggaaggcatcaatgatctggaagaagcgattcaatcattgttctacacgggtgccattgaaagcggtgatctgacttatgtcagcaacacacgtcacatctctatcttacagcaagcaaaacgcgccattgaagatgcgcttagcggcatcgaacaggatgtcccgatcgacatggtgcaaattgaccttacaagatgctgggagcttttaggggaaatcattggagattctgtccacgaaagcttaattgatcagctcttttctcaattctgtttaggaaaataattaaaggaggaactagaatcatggggtatgaagcaggccaatacgatgtgattgtgattggcgccgggcatgccggtgttgaggctgccctcgcatctgcacgccaaggcgccaaaacgcttgtcttgaccatcaacctagatatggttgcatttatgccatgtaatccgtctgtcggcggccccgcaaaagggattgtcgtccgcgaaattgacgcgctcggcggagaaatgggaagaaacatcgataaaacacatattcaaatgagaatgctgaatacaggaaaaggtcctgcggttcgtgcattgcgtgcgcaagcagacaaattccaatatcagcacgaaatgaaaaatacacttgaaaaagaaccaaacttaacattgctgcaaggaattgtggagcggctgatcgttgaagacggcgaatgccgaggcgttattacacaaacaggcgcacattatcgtgcgaaagcagttgtcatgacgacagggacatatttaagaggacgtatcattcttggcgatctgtcttactcaagcggcccgaataaccagcagccttctattaagctttctgagcatttggaggaactcggttttgaccttgttcgttttaaaacaggtacgccgcctcgcgttaaaagcgacacgattgattacagcaaaacggaaattcagcctggtgacgatgtgcctcgcgctttctcatatgaaacagtggaatatatcacagatcagctcccttgctggctgacatatacaagccctgagacacacgagattattgacagcaacctgcaccgttcaccgatgtattccggtatgatcaaaggtacaggcccaagatattgcccgtccattgaagataaagttgtacgatttaatgataaaccgcgtcaccaaatcttccttgagccggaaggcagaaatacacaggaagtctatgtccaaggtttatctacaagtcttccagaagacgtacagcaaagaatgcttgcaacgattcctggacttgaaaacgtgcaaatgatgagagccggctatgcgatcgagtatgatgcaatcgtaccgacacagctctggccgacacttgaaacaaaaaaatcacaaacctttacactgcaggtcaaattaacggaacttccggttatgaagaagctgcgggacaagggattatggcgggaatcaatgcaggacgaaaagcgcttggaaaagaagaagtgattttaagccgttctgacgcctatattggtgttctgattgatgaccttgtgacaaaaggtaccaatgagccatatcgtcttttgacatcacgtgcggaatacagattgctgcttcgccatgacaatgctgatttgcgtctgacagaaatcggacaccgcattggattgatttctgatgagcgctatgtggcttttgagaagaaaaaagcggcgatcgaggcggagaaaaaacgtcttcattctgtaattatcaagccgtctccggaaaatcaagaatatatccgttctcttggcggaagcgaattgaaagatggagttcgcggcacagacttgatgaagcgtcctgaaatgaactatgaaacagtcacaaaactggcgccgccagaagtgccagttcctcaagacgtggcagaacaagtagaaatccaagtgaaatatgaaggatatattgaaaaatctcttcagcaagtggaaaaactgaagaagatggaaaataaaaaaattccagatcgaattgattatgacgcaatcaaggggattgcgaccgaggcgcgtcaaaaactgaaaaatgtacggcctttgtctgttgcccaagcttcccgcatttccggtgtaaacccggcggacatttcaattctattggtgtatttagagcagggacgcattgcgaagatagccgaatagaaaggatgacggcatgaatattgaagaattcacttctggtttggcggaaaaagggatctccctttctccccgtcagctggagcaatttgagctgtattacgacatgctggttgaatggaacgaaaaaatcaatctgacttcaataacagagaaaaaagaagtgtatttaaagcatttttatgattccattacagctgctttttatgtcgacttcaatcaggtgaacacgatttgtgatgtcggagcgggagcgggttttccaagtctgccgataaaaatatgctttccgcacctcaatgtcacaatcgtggattcactgaataaacggatcacgtttttagaaaagttatctgaggctttgcaattggagaatacaacattctgccatgatagagctgaaacgttcgggcaacggaaagacgtgcgtgaaagctatgatattgtgacagcgcgagcagttgcgagattatctgttttgagtgagctttgcttgcctctggtgaagaaaaacggtttatttgttgctttaaaagccgcatcagctgaagaagaactgaatgcaggcaaaaaagcaatcacgacgcttggaggagaacttgagaatatccattcttttaagctgcctattgaagaaagcgatcgtaatattatggtgatacgcaaaataaaaaatacacctaagaagtatccaagaaaaccgggaactcctaataaatcgccaattgaagggtaatttagacagcctgatatgacaataccatcatattttcatcaaaattgatggatgtacagcaggaaaaaccatgagaaaatagaattataaaaatggcagtttttaaaggtggtgtaggtacatgaagcattcattctctcgtttcttcgggcttggtgagaaggaacaggagccggagattgctgaacatgatacaaacaaagaagagattctggaaataccggtaaatgctatcgttcccaaccgttttcagccacgcaccattttctcagatgaaaaaatcaaagagttagcaatgaccattcatacacacggcattattcagccgattgttgttaggcatacagaagaagaaggccaatacgaactcattgcaggtgaaagacgctggagagcggtgcaatcgcttgagtgggaaaagattccggcaattattaaggatttttccgacacggaaaccgcttctgtggcgttaatcgaaaacttgcagcgggaagaactgtcttctattgaggaagcgcatgcttatgctaggctgcttgagctgcatgatttaacacaggaggcactcgcacagcgcttaggaaaagggcagtctacaatcgcgaataagcttcggttattaaagctgcctcagccggtccaagaggcgattatggagaagaaaatcaccgagcgccatgccagagcactgattccgctgaaacagcctgagctccaagtcacactgctcacagagattattgagaaaagtttaaatgtaaagcagacagaagaccgcgtggtgaaaatgctggagcaaggccagagaaagccaaagccgagacgcaaagcattcagcagagatacaagaattgcgatgaacacgattcgccagtcactatcaatggtggaagacagcggtgtaaaattgaatacggaagaagaagaatttgaagaatatattcaattaacgattcgcataccaaaatagaagctctcctgaaaagcaggagagctttttatatttttaataaaaggtaatcacttacttttagtgaatattattatattagaattcttttctttgagcttgtggataaattcttcagatttttgcggtgaaatcactgcatgtccccatcccccctgataatatattgtgatggcatggcgagagccgatcagacgaaaaccggaccacagtttctttttttgaacgactttatcgatgttttcataaggaatttgatgtttgatcaatccggctttaatgatcagatggtgttctttcaatacatatttcaggtcaataaagctccaaatgatgagtccatttaaaagagtcagcagaataaaaatgatccagccggaaactctcatatttcccagcacaaaaggaacaatggcatctgcttgtatcagtaatatgagaaacacaatcatcagcgtaacgggtacatctctcttcgtttgataaatcattttctcaccatcctgtttccacgttctgtactgtgacttcttcttttttctttaagaaattccttttttaagtcaaaaaaacatagaaattgcagaatttataagagaaagcataaagcgtgcttgaattttcaattatttcccttctgattcggaacaaaatgatgaaaaaaatgaaacgctttaatctttttttgatagaatagaagcaagatagtacatgttcatgtgaaagtaggtgacatcgtgggaaaaatcatagcaattacgaaccaaaaaggcggggtcggcaaaacaacgacgtctgtcaaccttggggcatgtttggcttacatagggaaaagggttctgctggtagatattgatccgcagggaaatgcgacaagcggattagggattgaaaaagccgatgtagagcagtgtgtgtacgatattttagtagatgatgcagatgtaatagatattattaaagcaacgacagtagagaacttggatgtgattcctgcgacgattcagcttgcaggggctgagatcgagctggttcctacaatatcaagagaagtgagattgaagagagcgcttgaagcagtaaagcaaaattatgattatattatcattgattgtccgccgtcattgggcttgctgacgattaacgcccttacagcctcggattccgttgtgattcctgtacagtgcgaatattatgccttggagggtctcagccagttattaaatacagtacgtcttgtgcaaaagcatttgaatactgatttaatgattgaaggtgtattgctgacaatgcttgatgcccggacaaaccttggcattcaagtgattgaagaggttaaaaagtattttagggataaagtatataagacagttattccgcgtaatgtccgtctgagtgaggcaccgagtcacggaaaacccatcattttatacgatccgcggtcaagaggtgcggaagtatatttagatttagcaaaggaagtggctgcgaatggctaaaggccttggaaaagggattaatgcgttatttaatcaggtagatttgtctgaagagacagttgaagaaattaaaattgccgatttacgccctaatccttatcagccaagaaaacactttgatgacgaggcattagctgaactaaaagaatctgtgttgcagcatggcattcttcagccgcttatcgtcagaaaatctttaaaaggctatgatattgttgcgggtgaacggcgttttcgagcggcaaagctggcaggtttagatacagttccggccattgtccgtgaattatcagaggcgttaatgagggaaattgctttattagaaaaccttcagcgtgaagatttatctccgcttgaagaggctcaggcatatgattccttgttgaaacacttagatctcacacaagagcagcttgccaaacgtcttgggaaaagcagaccgcatattgcgaatcatttaagactgctgacactgccagaaaatattcagcagcttattgccgaaggtacgctttctatgggacatggacgcacgcttcttggcttaaaaaacaaaaataagcttgaaccgctggtacaaaaagtgattgcggagcagctcaatgttcgccagcttgagcagctgattcagcagttaaatcagaatgttccacgtgaaacaaagaaaaaagaacctgtgaaagatgcggttctaaaagaacgagaatcctatctccaaaattattttggaacaacagttaatattaaaagacagaagaaaaaaggcaaaatcgaaattgaatttttctctaatgaagaccttgaccggattttagagcttttgtctgaaagagaatcataaatgaaaaaaccatctttcaaacgaagatggttttttcatttatatgcgcccagtgagcctttgtagcgggttaaggcgttcttgcctccactctgtccgatctgttaaactcaaaccttccgctagaacatttgccatattcatgaccaagttgagtctagtattttgcaatacaaaatattccataaaaccgctcacattcacgattccgttaatatgaagatctcccacttcaggaaggtctttttgtacaccggctccgggctttaatggcccgtccccgatttgaaatgaacccacactcttaacgcggcctaagcatgcatcgactgctataacaaatgggtttttatgtaatttatgaatgtcattgattttatccttcatgttcacagcatggacggggtcagataaggttccgtagacatggaatctggtgagctgcatctgtttgagtttcattcctacgagcgggcctaatgagtcaccggttgaacggtctgttccgatacaaaccacgacaattggtttgccagcagctttacgtaaggatgaagaaaggatggtttggatttgttttgccgctgcagcatctgtatgtgaaacatattgctttactcgttcctgagaagaaaaaagcccgccttttcgattcatgggtttcacttccttgttatagtaggtaacagaattgctatggtgtgtgtagttatgtaaggttgtttacagtatatccagcagtatgattttttatgctttgtgtatggcaccagagattttaaaaaagtagagggcatgatatgaatggttagtgggcgattacaagtattgtcccccattgcctcgatcatgatcaagcaatggtctgcttatgaaacacttgaataggtaggaatggttagaaaaaagtgaagagtgaagttcacttcttcattccgcggacaaacaaataaatatctctttttagactgccgtattagcagtcttttttatgtgtatttcgtatgataatttcagcttgtgttcaaatgtctatgaaaatatggcatgtttgctttcctttatttatatagtaacaataacgggaacaagctgaactttgtctatgaggtgatagtgttgtggagagccggaatgaagtggatgctgctcatattagggagcctgatcggggccggatatgcgagcggtcaggagatatggcagttttttggggcggaaagcggacttgctattgtgctgtttacaattatgttcattttctcgtcttatattgtgatgaaaatcagttttaaggttcaatccactcattttctgccggttctggagcatttaatggggccatggctggcgaaaatttatgatgtcctcatcattttttatttgttttcgacgactatggtgatgattgccggaggcggtgtgaccctgcaaatgtacaagcttcctttctggtggggaatcacgctgatttgcatcgtgacagtgtgcttgtttttgtgggatgtgaaaggaatattatctataaatagtattttgattcctgtgttagtagcggggcttttatatgcgctgatctcctttcagagcacacatcaccatacgtggacgattgatttgtcccagcagtataactggcctgcgagcattacgtttacctctttaaacatcctttcagttgttgcgattttatcctctgttgggaaagagatgaaagggctcggagaagcaaaaatcgcaagtgtggcaagcggtcttatttttggcgtgatctcatttgtttataatgaaacgttggtggagctggcgggctccctttctcagtttgaaataccgctgtttgccgttctggagggtgcgccttatttcctttttttatgtatgacggcggtgctgtgcctggcgatttacacgacgacggtagctggtttgctgggtttgtccagccggctgatggcgtttattcatatgccgagatggatgattgtgttgattttgttagtgttaatggtaccttttacttctttcggattttctgatttgatcgcgttcttgtatccgatatatgggatgctcaatttgtatttgttagtttgtctgctcttatatcctattttgagtaaatggaaataagaggatgtatttcttttcgggtatcttgattgctcttatgatcagtttttttgtacaatagatacagcagtttaggaaaagaggtgaagggtcttggcggataaagactttggcctgaatgatatcgtagaaatgaaaaaaccgcatccatgcggagcgaacagctggaaaattatacgcatgggaatggatattcgaattaagtgtgagggatgctctcacagtgttatgattccgagaagagaatttgaaagaaaactaaaaaagtactagtcaagcatgaggagcctacttcataaataggccgacactcatgctttttcatatagaaggtaaggagaagacggcgatgagcaaagtgcatcagtcggcatgtccgctgaattgttgggacagctgcggctttttggtgactgttgatgatggaaaggtaacaaaagtggacggagatccaaaccatccgattacggaaggtaaaatctgcggccgcggcagaatgcttgagacaaaaacaaattcgcctgatcggcttcgctatccaatgaaaaaacaaaatggcgagtttgtgcggatttcttgggagcaggcacttgatgaaattgccgataaacttcgggaaatcaaggaaacgtcggagacgactgctgttttgcacagccatgattatgcgaataacggtctgttaaaagcgcttgatcagcgtttttttaatggatatggcggcgtgaccgaaatcgtcggaagcatatgctggggctccggtatcgaggcgcaaagctgggattttggccgttcgtacggtcacggaccgcttgatatttacaacagcaagcatgttgttgtgtggggaagaaatgtatcaagaacaaatatgcacttataccatcacttgcagcaggtgaaaaagaagggcgccacgattacggtgattgatccgatcttcaacccgactgctaagcttgccgaccgctatatctctgtaaagcctggaatggacggctggcttgcggcagccgttttgaaggttctgattgagatgggaagaacggatgaaacgtttatttctgagcattctgtcggttttgatgatgtgaaagagcttttgaagaccgtttctctggaagagtttattgtgaaaacagaaacttctatggaggagctggagtatttggcaggtttgtatgctgatggtccggtgtctacttttatggggcttggcatgcagcgatataaaaacggcgggggaacgattcgttggattgatgcacttgtggcggcaagcggaaatgtcggaattaagggcggcggcgcgaatttcggaaatgtccagattggtgagagctttgcaaaaacaaagctgacgctgccggaattaaaaacaacatcccgttctttttcaatgatgacacaggctgaagaagtgttgaccgctgctgatcctgcgattgagatgattattgtgacgtgcggaaatccgctgactcaggtgccgaatacaaataaggtgagacaagcatttgaaaaggttccaatgacggtcgcgattgattccattatgacggataccgcagagctgtgtgattatgttttgccgactgccactgtttttgaagaagaagatatctactattccagtatgtatcatcattatgttcagtacgggaagaagcttgtggagccgcagggtgaagcgaaatcggacagctggatctggtcagagcttgcaaaacgtcttgggtttggcgagctgtttgaatacagcactcaagaatttttagagatggggctttcttcattggaagcagaggatgtgacacttgagcgtttaaaagaaaaaggccacctccctcttccagtaaaacaggtgccgtgggatgattatcagtttttgacgccgagtggaaaatttgaatttacttcgtcgctagctgagcaaaaaggatttagcggctcgcttcaattaaatgtgcccgaagaatctgttttccataatgaggagttagctggaaagtacccttatacgctcttatccattcatccgcagcgttccaatcattcacagcatgtgccgtttattgaaaagcttcagcacgttcaggtcgatatttctccagatatagcggctgggcaggatcttcaggatggagacgaagttgtcatctttaatgaccgcggaagcatgaagggcaaggtgaaagtgatgaagcaggctcatgcgaagacgattaatatagatgaaggcatgtgggcggcttttggagggtcagtcaatgcactgacaaatgatacaaattctgataatggaatgggaagtacgctttttgactgtttagtaggcttgaaaaaagcataatcaaagggattggcaagctgaaaatgcttttttgtcagcttgtcttttccagtgaacctccttataattgctctaggttcaaaatacgttcatacaatgacggttttatatagaggagatgaaagaatggctttaacagctggaattgttggtttgccgaacgtcggaaaatcaacactatttaacgcaattacacaggccggtgccgaatcagccaactacccgttctgtacaattgatccgaacgtgggaattgtagaggtgccggatgatcgtctgcaaaagctgactgagctggtcaacccgaagaagactgtgccgactgcttttgaattcactgatattgcagggattgtaaagggcgcatctaaaggagaaggactcggcaacaagttcctatctcatattcgccaagttgacgcgatttgccacgttgtccgtgctttttccgatgacaacattacacacgtttccggaaaggttgatccgattgatgacattgaaacgatcaaccttgagctgatcctcgctgatatggaaacagttgaaaagcggattacacgcgtcagcaagcttgcgaagcaaaaagataaagacgctgtatttgagtttgagattttatctaaactgaaagaagcgtttgagagtgaaaagcctgctcgatctgtagaattcactgaagagcagcaaaagcttgtgaagcagctccatttactgacttcgaagcctattttgtacgtggccaacgtaagtgaagatgaagttgctgatccatctggcaatgaaaatgtagcgaagattcgcgagtacgctgccggcgaaaacgcagaagttatcgttgtgtgtgcaaaaatcgaatctgaaatcgctgagcttgaaggcgaagaaaagcaaatgttcttggaagagctgggcattcaagaatcaggtcttgatcagctgatcaaagcgtcttactctcttctcggcctcgcaacatatttcacagccggagaacaggaagtcagagcttggacattcaaaaaaggcatgaaagcccctgagtgtgcaggaattattcatagtgactttgagcggggcttcattcgtgctgagacagttgcttatgaggatcttcttgcgggcggcggtatggcaggagctaaagaggcaggaaaagtccgccttgaagggaaagaatatgtggtccaagacggagatgttattcatttccgatttaatgtataggatgcagttgtaaagggacaagagctttggtataatataaaattgtgagtaatagaattattgctccttgcccattatgggccgcttagtccaaaaggaggtgcaaacagatgagaaagtacgaagttatgtacattatccgcccaaacattgacgaagagtctaaaaaagcagttatcgagcgtttcaacaacgttctgacttctaacggtgcggagatcactggaacaaaggattggggtaaacgtcgtcttgcttacgaaatcaacgatttccgcgacggtttctaccaaatcgtaaacgttcaatctgacgctgcggcagttcaagaatttgaccgtctagctaagatcagtgacgatatcattcgccacattgttgttaaagaagaagaataagcaattttgaaatatataatggtaaaaggtggtctttcttatgcttaaccgagttgtattagtcggaagactgacaaaagacccagagcttcgttatacgccaaacggtgcggctgttgctacgtttactcttgctgtgaatcgtacatttacgaaccagtccggagaacgtgaggccgatttcattaattgtgtcacttggagaagacaagccgaaaacgttgcaaacttcttgaaaaaaggaagccttgcaggcgtagatggccgtttacaaacaagaaactatgaaaaccagcaaggacagcgtgtcttcgtgacagaggtccaagctgaaagtgttcaatttcttgagccgaaaaacggcggcggttctggttcaggtggatacaacgaaggaaacagcggcggaggccagtactttggcggaggccaaaatgataatccatttgggggaaatcaaaacaaccagagacgcaatcaggggaacagctttaatgatgacccatttgccaacgacggcaaaccgattgacatctcggatgatgatcttccattctaatgtgattatcgcctaaaatgaaaaagaaaggagggaaatgacaatggcaggaggacgcagaggcggtcgtgcgaaacgccgtaaagtgtgttatttcacttctaacggtatcacgcacatcgactacaaagatgtagatcttcttaaaaagtttgtttctgagcgcggtaaaattttaccacgtcgtgtaactggaacaaacgctaaataccaacgtaaattgactgcagcgatcaaacgcgcacgtcaaatggctttacttccatacgtaagcggtgagtaagctgatatgtaaagagcaaggaccttcgggttcttgctcttttttataggggggaggatgaaacatgaagttgatttcatggaatgtaaacggcctgcgggctgtgatgagaaaaatggatttcctctcttatttgaaagaagaggatgcagatattatatgtcttcaggaaacgaagatacaggacggccaggttgatctccagcctgaagactatcatgtgtactggaattatgcagtgaaaaaaggatattccggcacagctgttttttctaagcaagaaccgctgcaggtcatctacggtatcggagtagaagagcatgaccaagaaggcagagtgattacgctggaatttgaaaacgtgtttgtgatgactgtttacacgcccaattccagaaggggattagagcggattgattaccgcatgcaatgggaagaggctttactgtcttatattcttgaattggatcagaaaaaaccagtgattttatgcggtgatttgaatgtagcccatcaggagattgacttgaaaaatccaaaggcgaaccggaataacgctggattttcagatcaagaaagagaggcattcactcgtttcttagaagctggctttgttgattcttttcgtcatgtttatcctgatcttgaaggcgcttattcctggtggtcgtatcgtgccggcgcccgggacagaaatattggatggcggattgattattttgttgtttctgaaagccttaaggaacagattgaagatgccagcatatcagcggacgtcatgggttccgaccattgtcctgttgaacttatcatcaatatatgatgagatagcagtaaggattttacacttactgctttttttatatgaaaaggagaaagagatggcaaatataaaagagatcgcaagactggcaaatgtatctgtttcgactgtctcgcgtgtattgaatcatcatccgtatgtatctgaagaaaagagaaagcttgttcatcaagtcatgaaggaattggattatacaccaaatcgaaccgcaatcgatctcattcgcgggaaaacccatacggtcggtgtgattctgccttatagcgatcatccctgctttgataaaatcgttaacggaatcaccaaggcggcttttcagcatgagtatgcaacgacccttctccccaccaattataaccccgatattgaaatcaaatatttagagctgttaagaacgaagaaaatagacggtctcatcattacttcccgcgccaatcattgggacagcattttagcttatcaggaatatgggccggtcatcgcttgtgaggataccggagacattgatgtcccttgtgcttttaatgacagaaaaactgcttatgcagagagctttcgctatttaaagagccgcgggcatgagaatattgcttttacgtgtgtcagagaagctgataggagcccgagcacggctgataaagctgcggcctataaagctgtctgcggaaggttggaagaccgccatatgctgtccggatgcaacgatatgaatgatggtgagctggcagctgaacatttttatatgagcgggcgggttccgactgctatttatgcaaatagtgatgaagtggcagctggaattcatctatttgccaaaaagaataattgggatgttgaaatcataggcgagggaaatacttctatcagccgtgttcttggttttccgtcgcttgatttgaatcttgagcagctcggcatcgcagcattttctctatttttgcaggatgaacccgctgatatcaaaattcagcataaatttaagaaaaaagcttgaactgaaatgcatttcataccttataacttcattgaaggcgaaggaggaggaagaaatgcagattgaacatacagcggtctgggtcaatgatttagagcgaatgaagtctttttatgaatcgtattttaatggcgaagcgaatgatttgtatcataatgagaaaaaagattttaagtcttattttattacgtttgattccggagcaaggctggaaattatgaaaaaagggaatgtgaccgatccgccctcacaaacaatgacaggctgggcacatattgccttttccgttgggagccgggagaaagttgacgaactgactgatcgattgaaggcggatggtttcgcagtagtaaacggcccgaggacaacaggagacggctactatgaaagcgtgattgaggatgatgaaggaaatttgatcgagattacaatctgacatctggagtgacttaaatgctgaggacagaaaaagaaaaaatggcagccggagaattatacaattcggaagatcaacaactattactagaacgcaagcatgcgagacagctgattagacaatacaacgaaacaccggaagatgatgcagtgcggacgaagcttttgaaggagctgctcggttcggttggggatcaagtcacgattttgccgacattccgctgtgattatggctatcacattcatatcggagatcatacatttgttaattttgactgtgtcattttagatgtgtgtgaggtgcgtatcggctgtcattgtttgattgcgccaggtgtacatatctacacggccggtcatcctcttgatccgatcgaaaggaaatccgggaaggagttcggtaagcctgtgacaattggagatcaagtttggattggaggccgggcggtgattaacccgggagtgacaatcggtgataacgcagtgattgcttctggatctgttgtcactaaggatgtacccgctaatactgttgtaggcggaaaccccgcaaggattttgaagcaattgtaatgagatcagtgcggcagatccgcactgacttttttaaatctgttttgcattcgtattaggaccgaagaagattaacagcaaggagcatgcgagccaacagcccccaataaataagaagacgctgatatagccgagctgaacggcaataaatccgacaagcaatgagccaaaaatgtttgaaaaacggccaagaccataggctaaaccgctgccagacgagcggtattcagtcggataaggttcagatgtataggcgtataagttcgaggtaaagacccgttctgtgatattcacgataaaaccaaatacaatgatcatgatgggaataaaagtcataccatataagagcccggcgatggccgtcagaaacgcactcgcagctaaaatccattttctttgaaatctttcggaaatcatggagccgagcagtgcgccaagtggagcgccgacggaatgcaatacgttataccataatgtattttccatggttacgccattgctttttagcaggcttggaacccatgaagcaaatccgtaaaacccaaacgtttcaaaaatccatacagcagataatacgatggtaattttgaggtttctgcctttcaataagcctgcgtaacctgcattctgcttaacagtttcgcttactttaggctgggatgctgccggaagcgggcctttctccttttcaacctgttcttcaattcgggtgaggatcgcatcggctttcgcatattccccgcgattttcgtgccagcgaggtgactcttccagacggtggatgaagaaaaaataaataaggccgacggcaccccatacaaatactagcctccatccccatgaaccaagaggaatgacaaaggcagacacaatgttggtgatcggaaccccaatcaatccaatcatggcacaaaaagaaatatattttccacgtacacttgaagggaaaaattccgccaaatagctattcgtaatgaccatggcggctgcaacgccaaatccggtgaggaaacggaatgtcattaaagatggaatgtcccatgccgcagcattgcatagcgatgcgattgagaaaacaaagacaaatagatttaaggcttttttgcggccgattcgatcggacagccgtccgcccagtgaagcgcctaaaaacatgcctaaaaacgaagcggccgttacgttagcaatagttgaaagcgggatgccccaatgctcgatcagtgccggcgctacgttgctgagggtaaataaatctgcgagatcaaagaaataaacaatgccgagagcggttaacacttggaaatgaacgcgtgaaatcggaaggcggtctaaacgattcgctgcgtttgagaaaggatgtgtattcttttgtttgaagatcgtattcataaaaaacccccttttgagtagtagaaaagactgaaaattcccctcttgggactattataagtatcttggttcattggcaacagagttcaaatcactagatggaagaactaaattcacactttatattttaattttgcttaaaagatttccaaaacagtagattcatagaccaatttatgcaaatatatagtaatattctcattgaaaggaagagacatagaaggaatgaattcatttatccgtcctatagaaggaaacaatacgttgtggagatattttttcgcttttttggtgatggtagggttatatgtattagggaatatagcttaccttttcgctatattgttcacggttattgtgaatcccaatatcacgtttgatttggatgaagctgtgctgagtgatcccctcgtagatctttatttgtcccatgtgatttatttattcgccattccgggagtttggctggctgtgcgctttattttgaagcggcctttccgaacggtgataacaccaaattcaaagatgaattggcggagaatttcctttggttttattgcttatttcttgctaatgatcgccgtacaattgattgattttgtgattcatcctgatagctattcaatgcaagagtttaatgcatcacgatttatctggctgctagcggctgccctcattttggttccgattcagacatcagctgaggaactatttttcaggggatttttgcttcaagctttcgggagattgacgaaaaatcctctatttttgacactgattgtcggaggattgtttggcgtattgcattttgcgaatccagaaatgaacaatggcgctgtctgggcaggaattgagtacttaacatttgggtttgtgtggacgtattacacgattaaaactgggagcatcgaaatatcacttggcgcccatgccgcgaataatatgtttttgtgtatgtttattacagaaaaaaacagtgtgtatggaggaattccttctctgtttaccgttacgcgggggaacccgatgtgggaggctttctttacgatagcggtcaaccttgtgtttgcggggatcgctttatggtaccataagaaatcaaaaagtaagcagcaagggtcttaatccctgctgcttattaatgtgtggatcgcttcttcaatatttgttgtcggttgctggcaggcgaagttttcacaaatataaacggttgttttgccgtctatgatgcggtagtctgctgcaaatggcgcaatgtctttgcattgctcgggctgctctgccaccagaatggagtcgttgggcttaaaggctttttgaagctccgctataatttgttttctggctggatcgtctgcgctgccaaaaatcacgatttcttttttaggcatcagatgccttaacacactttgcataaagaaagcatggccgctcggatacgcttctatgtctggcttgaacacggaaaacattgtttccgctttttcgatcagtgataagtcgcctgtgacttgcccgagacgcagcagctgaacagctgccacactgtttcctgaaggcacggcgccgtcgtacacttctttttcccgtacgattaaggcttctgcatcgtgtccggtgaagtagaatccgccatgctcctcatcccaaaataagctgatcatatcgtctgtcagtttcttcgctttttgtaaataagaaagatcaaacgaagcttcatagagatccagataagcccataggagaaaagcgtaatcgtcgataaagcctttgtttttcacttcgccatcacgatatcggaccatcacacggccgtcgatgattaatttgttttcaataaatgtgatggcgtctttcgctaggctgagatatttcggctcctggtatacctttgccgctttcgcaagacccgcgatcatcagcgcgttccatgaggtaagcactttatcatcgacatgcggataggttctttcctcgcgtgtcttcaagagctgctgtcttgcgtcttcgagtttgagactgagctctttttcggttaacccggcatcctctttgatttgttctcgctttgtgtgaatgaggttaggaatatttttgccttcaaagtttccttcttcagtgatgtcatacacttggcaatacagcgttccgagatcgtccccgagcgtttttagaatctcttcctttgaccacacgtagtactttccttcttctccttctgtgtccgcgtccaaagccgagaaaaagcttccgtcttcatgagtcatttccctctgaatgaacgtaatgatctgctcacaaatctctttatagcggctgttttgcgtgacctgataggcttctgtataagcggtcagcagcagcgcattgtcgtacagcattttttcaaagtggggaacgagccactcgtcatcggtcgaatagcgggcgaacccatagccgatatgatcgtaaatgccgccattcgccatgctgtccaatgttttcgtcacgttgtatagagcgttctcctgccctgtattgtgatcataacgtagcaaatacatcagcatatgaggcattggaaatttcggtgcctgcccgaaaccgccgtagatcgtgtcaaacccgctggcaagctgctggaatgtccggtgaatcgctgattcgctaaggccctcaccagtttttgcagctgttttggtctgcaaatgtttagcggcgttctccgcaatatcctcgacatgctcgcggtcgttcgcaaacgtctcagacagatgctcaagcacatcaacaaaaccgggacgattgaatttgctcgtctttggaaaatatgtacccgcgtaaaacggcttttgatcaggcgtgataaacacattcagcggccagccgccctgcccggtcatcagctggcagattctcatataaacagaatccacatcaggccgctcttcccggtcgactttaatcgccacaaaccgttcattgagaagacgcgcgatttcttcgtcttcaaagctttcgtgggccatcacgtggcaccaatgacatgtgcgtgtagctacccgagctagctatacccaatagatacgagaacaggtttgttttcgcgtttcgctttatcaaatgcttcatctccccaagggaaccaattcacagggttatgagcatgttgaagtaaataaggagacttctcagcgattaatctattgggtttattgttagtgggcatgggatcaccttctttcaatacttagttaaatttatcatatcctaaagtaacacagtgatgtatataatattcaggtttttttcccacacaacaagattctatacaccaaataaaaactgtaatagtttaaatttgttttattgacttaaagttaaaaatcgatcataataaccctataaaagttaaatatttttttaactctattggagggttattcaattgtatactataagtaaaaataaagttagattacatatgaaaaaacatgggatttcaactcaaaaacaattagcagagcagctaggaattagtaaaaatcagctttccatgctgttgtcaccaaatttcaatcctataaagtcaaatgcattaaaattatgtgaaatattaaatgtgaattttgaagaaattattgattctgaacaaatggagttatcactagatggaacggataatttaatagattctaatatagatgaggaaataaatgtttcaagttttgaaggtaatgagtttttagatataagagatattaaagctaataaagattattcagtagtagaactttttgctggagctggtgggttagcattaggactagaacaagctggatttaaatctagaggtcttgttgagtttgataaatatgcttgtcagactttgagaaaaaatagacctcattggaatgttattgagaaggatatcattgatgttgctgaagaagggattaaaaactttgtaaatgttccaattggagaattagacttactatctggaggttatccttgtcaagcgtttagttatgcaggaaagaaaatggggttatccgatgcgagaggtacaatgttttattactatgcccaagttttaaaacagttacttccgaaaatgttcttagctgaaaatgtaagagggttagttaatcatgataatggtcgaactttagctcttatgttaaaagtattctctgatattggttacacagtaaaatggaaagttttaagagcattagattatgatgtagcacagaagagggaaagaatagtattagttggtattagaaatgatttagtagagaaatacgaggcgaattatttcttcccgcaaccttatggatatgagcttacattaaaggatgttctaaaaaaatgttccagaatctgagggagcaaaatatccagaatcgaaaaaaagagttttagatctcgtccctcctggtggctactggagagatcttcctgacgaaatagcgaaagaatacatgggaaaaagttattactcaggtggtggaagaacggggatggctagaagattatcttgggatgagccttctctgactttaacttgctctcccgcacaaaagcaaacagaaagatgtcatccagatgaaaccagaccatttacagtaagagaatatgctagaatacaaagtttccctgactcatggaattttgattgttcaacaaacaatgcttataagcaaattgggaatgccgttccagtaaatatggctaaagctattggtttatctataattagcacactaaatcagctaacatgagcattctgctttttctgtggaaaaattaacagggatgaaaactatacatccctgttttcattactattcttccaaagactcttgttcgtttaattcctcttctatttgtttggctagactatcaattacttcttctatatgttttgatccatcaaactctgatgcaatttctcctattgcatcagttaatcgcttatagaagttttcttcacctgtaagtctataccaaaattcagcacctacaattactggatattcttctttgatttttttgtagtgaccacttaatttatcatcggaaccataaaacacacctacaacaaggtcattaaatccaatactcaaattatttgttcgagcaagatttttgatccctaaaaagtgatttttaatagttggaacatcgtcagcattaattgtattggggccagcctttatttgacagtactttctattgccgtctaacttatcaacgaattcaatatcaattccagatgtagttgaggcgaaaccatccaagacgtcactacagaatttctgcaacttgtttccaaatgttgtgtttaaagatgtgcctaatactcttggataaactaatgctcttgcaatgtttttcggatcatcattccctgctaaaaagttagctctgtacttatctaaaaatggattcagtgataaatgtttcaattctttcaactttaaagtgttcgcaagatgactttttgctatttcgtttctaaaaaaatcttttgctttctcaataatatcatctggatgttgtgtattcattattctcccccatttctctttgacacttctattatagggtcttttgcactatctgtaaaattaaccatttatgtatcattctgttcaaatacttattttaatatttgatatgtaaatggagaatcaagatttgaaagtttgacgaaggaaaaagatgtgttagatgcgttttaaattaaaaattaaatctagtggtgtctgttatggcaccaatgacaagtcgaataaccgatgctgaccagaaccggcttgttttcgcgttttgctttttcaaaagcttcttctccccacgggaaccagtccacagggttgtgggcgtgttggagtaaatatggtgatttctcattgattaatctattgggtttacttttgtttggcatgggatcaccttcttcctataattagtgtatatttaacttaacacattttctcaaaaatactccctatttctttatatagctgactgttctttagtattgtacttaggaatacgtattacccccgaagcggttaaaacgcctaatataactagcacagccccaataacttgaaatacctttattggtgttccaacggcaaatgaaataatcatcgttacaacgggaacaaggttgaaaaataaagatgttttactagctccaatctctttaatcccctgattccaccataggtaacccaaaacacttgtaaaaaaagccataaaagcaattgccccccaaactccaatcgggatgttcgataaagaaacaggtttggatgtaaataaggaaactactattaaactaacagcaccaataaccatcgtataagtggttgtagatagcggtgtaccatcctttacaaaccgacgtccaagtacgccataaagtgcccaacaaacgttacctgtaaagattattaagtctcctcctgaaattgataaggttttaatggtttcgatagaaccttgtgtaatgactaacaatacaccgatgaatgcaaagaatatgccgagtacttgtttttttgtcatgttgtcctttaagataattcgagcgagaattgctgttaataaaggattcagccccattattaatgctccgttaacgggagatgtatattttaaaccaacaaaaacaaggcattaaatccaaagattcctataattccaagaacaatgtatgaaacggcgtttttccgtaattgactcttctttataccttcagtaaaaatcaaaatgatgagcatcactgcagccgctaaaccgaaacgccatgccgcagaagacgatggagaaaaatatccaactgtatattttgcaagattaaaagtagctcccgtgaaaatagagaagccaagtaacattatgtatatatttaaatgtttcatttgttttccacttcctctttcaaaattgaataatatgtatccagttttccttttgtagtagaaatcacttcttccagctccctttttttaatttccattttctctaagtgcttggttaaaatctcaatacgtttatttatagatggggagagttgtgccgatttaacatccgaattgattttttccaaaatgcatccgtctttgacaaactcattaatatcctccaaagacatacctgtttcctttaaacttttcaggaataacatgaactgaatatcagtctccgtataaaaacgccttccactgttttttcgttttggtggtggaagtaacccaatcttttcgtaatatcttaatgtatacgaactaatactagtcttctcagcagctttactaatggaatacaacaacatcatccctctcatttaattaaagttagtttacaatttagagttaactctaagtcaagcaaataaaaaaacctgctaccgcgtggttacggattacaggttttagaaaatgaatgaaataaaaggtagactgtattgtttgaacaaatagtattatcgtttaaaatggcttctgttatcttttaatggagttccacacgatttgattatcccaggccaccaatgacaagtcgtcgaataaccgatgctgaccagaaccggcttgttttcgcgttttgcttttgcaaatgcttcttctccccacgggaaccagtccacagggttgtgggcgtgttggagtaaataaggagacttttcagcgattaatctattgggtttacttttatttggcatgggatcaccttcttcctaagttggttatattcaggttaccacagttatcctaaacaaatacaataactgactgcttatcgataattgtgatgtgaaaatataaactaatgtttcattttgccacttgagataaatgcgaataacgtttttccttgtttcgcaatctggtcaaatttttataaaaaaagtaaaagtttaatccttagtctatatataataagatcatatcaatcaaatgtagggggagttattatgaagtgcaataaaatgaacagggtacaattaaaagagggaagcgtatcaatgaccctataaactgcgtctgccctcattaatggaggggaaattgtgaatacgtcttattcacagtcaactttacggcacaatcaagttttgatttggctttgtgttctatcatttttcagcgtattaaatgaaatggttctgaacgtctcattacctgatattgccaacgagtttaataaactgccagcaagtgcaaactgggtgaatacagcctttatgttaaccttctccattggaacagctctatatggaaagctatcagaccagctgggcatcaaaaatctgcttctatttgggattatggtaaatggcttagggtcgatcattggatttgttggacactctttctttcctattctcattctagcccgatttattcaaggaattggtgcagccgcattcccagctcttgtgatggttgtcgttgcgcgctatattccaaaagagaacagggggaaagcatttggcctgatcgggtccctggtagcaatgggagaaggtgttgggccagctattggcggaatggttgctcattatatccattggtcgtatttgctgcttattccaactgcaacaattatcaccgttccattccttataaaattgttgaaaaaggaagagagaataagaggacacattgatatggcagggattatattgatgtctgcaggtatcgtattttttatgctgtttacaacatcttatagattttcttttctgatcatcagtatccttgctttcttcatatttgtgcaacacattaggaaagctcaggacccttttgttgaccctgaattagggaaaaacgtcttttttgtgattggaaccctttgcggaggactaatatttggtacagtagcaggatttgtctctatggttccttacatgatgaaagatgttcaccatttaagtactgcagcaattggaagcggcattattttccccggaacaatgagtgtcatcatctttggttacattgggggattgcttgttgatcggaaaggttccttgtatgtactaactattggaagtgcattgctttcttccggctttttaatcgctgccttttttatagatgcagcaccatggatcatgacaattatagtaatttttgtttttggggggctatctttcacaaaaacagttatatctacagttgtgtctagcagtttgaaagaaaaggaagcgggcgctggaatgagtttgcttaatttcacgagctttttatcagagggaacgggtattgcgattgtaggcggtttattatctatcggcttcctagatcataggctgctgcctattgacgttgatcactctacctatttgtatagcaatatgctcatactttttgcaggaatcattgttatttgttggctagtaatcttgaatgtatataaacgttcgcggagacatggctaaatgagtgaaaggatcaatcttgtgaaagtaattcaaggttgatccttttttgtaaaatgaataaacatggcatcaatagcatgttctttagattagccatcgttagctatacccaatagatacgagaacaggcttgttttcgcgtttcgctttttcatatgcttcttctccccaagggaaccagtccacagggttatgagcatgttgaagtaaaataagtagatttctcagcgattaatctattgggtttattgttagtaggcattggatcaccttctttcgtttttttataaatacaaaacttagccgattacttaaaagagggagaagaaaatatactataatgcttaatgatgttaattgaggagacatcgtccttttcaatcctcttttattacagaaaatttgatattgataattccatagtatattaaggggaacccattatttatggattcccctttagttcaataagaaggattactgtcgagtgttactttacaatgttagccattccaatgataaacgatttgcacaacgccagaggaaaatgttcttgtattcaccatttttaaatttatcctctgttttacatcaataaacaacggttttccttctcccaaaacaacagggtgaatagataatctaaattcatcaacaagccccaaatttataaaagttgtaatgagactcgctccaccatatagccagatgtctttaccaggatttttcttcaatttatttacttcttcaagaatattatcatttataaatatggcttgattatcaatctcattttgtgttctggaaaaaacatatttctttttactatgaaccaatttccaaagttccttttctgtatcagggtcttcattttttggaatgtattgtccccataaatcgaagctttttctaccatataaaatagtatcaatttgatttaaaaaatcagtaaaccccatatcagggtccataatacaccaatcaacttctccatttttcccttcaataaaaccatctaaagtaactgctaaatctaaaatgattcttctctgttttaagttatttgtcataactattcatccttttacataagaagttggttgaaattcttctcccactctcgcaccagatgaactaagttgcgtttgtggacagagtgaagaacagtatcctaaaatgaaagtgcccactactcttcgcagcttgattagcaggaacactctttatcttcacttggttaaatgaaagctctgctcgattaagttatagatttcgccttctggatctgtccgttctaaaacaattgaaatccaatgttccttatccatatgatatccgggtaagatattttccccgtttcttaagcgatcacttatttcagggggacattttagatttagaatatctatttcgccatgaccatccaagcctaatttttctgggagaacattcatgataagaccgtaccattttttgtttgatgtatgtctcaaagaagcatagtttgggtatttctcccacgggtaatcaggcgatgtaccgtatttttctttgacgtgtttaaagatatcttctcttgttaacatactcaatcactcctttattcactctactttcttcttgaaaaagtcaaagagcgatccttggttgtcctttggatacttcaatagagatgtcatcaatggcagaagctgtgtcaaagcttcctctctccacggatactagtcaacagggttgtgggcgagttgaaggaagtatgatatttctcattgagtttattgttagtgggcataggttcatcttcttttctcttgtttctattcctttttactgtaccacaagcctctgttgaaatacctcattaagatagtgaaatatataaggtaatggatgccttatctaatgctgttctcttaaagagtacacttttggaagctgttgttgaatagtatcgaaacgagtttactaaatattatctcgattggcggagattgatatgatcatgaaaatgactcatttgaatatgaaagatttcaataaaccaaacgaacctttcgttgtttttgggagaatgatacctgcttttgaaaacggtgtttggacatatactgaggaacgattttctaaaccttattttaaacaatatgaagatgatgacatggatgttagttatgttgaagaagaggggaaagcggcttttttatattatcttgaaaacaactgcattggccggattaagatccgttctaactggaatgggtatgcactaatagaggacattgccgtggcaaaagactatagaaaaaaaggtgttggaacagcattattacataaagcgattgagtgggcaaaggagaatcatttttgtggtcttatgcttgaaacccaagatattaatatttcagcttgtcatttttatgccaaacatcactttataataggtgcggttgatacgatgctttattccaactttccaacagcaaatgaaattgcgattttttggtactataaattttaattgattataaaacctcaacagtaccagagataaagaattgacaacgaaacggggcttgttttgcgtttcgttttttggatcgagaagaggtttcttaataacctcttctattctttgataagaaatgtctttccacaataggcataaaaacgtgaaggagcattcctcccaaacaaaccgttaaaagagttccgatgccgatagggcctttaaagatgatggctaatactaagaaaagagcgtataccaatgtccttgaaaacaatattgttcttttggagagatctcggataataagtgttaaatgatcgatcggtgttgatgcgaatttcgtctgaagatagatggctgttccaagaccgatgagcaccaaaccaattccaaaacaaatcagtttgcttaacaacgagtttagatagatggtgttttttacaacaaacaaccataggtcaatgcctattccagtaatgaatgctgtaatcaagcccagcaaaataggtttttttctcgttaatatagcgttgcagattaagaggatcacagaaataaggacctcccagcttcctacggtaagaccgattttttttgacagaccaaccaaaagggcatcgaagggtgatgtgcccagtcctgattgtatggttaaggaaatgcccaaacttaatatgagtatgcctattccgtaatacatatatttcatgttatattccgcgatatttcttttgtcatcaagacgtgagggatgccgtcctccataaattcctgtgaagaaatctggtagcccagtttttgataaaagcctgccgcttgtgtttgaccatgcagcttatatgaagtcagtcctttttctttcatgatttcctctaacccgcttacgatgatcttccccaatccgtacttacggtaaggttttaggatgcagattctttccagctttgctgtatggccaacgatgcgcgcgcgtccggtgccgacaggctgattctcatgatataccaagatatgctggcattgttcctgaagcgtatcaaattcatcgaactcatcggcttcagacacatgttgctcctcaatgaaaacgcctcttctaatctttaaagcttcatgtaaatcagcttcagttgttattctttttatattcattatgaatcaatccttttctgatattagtctggactgtacagcacgcatgtggtcttataatagtaaggttaaaacatttttgttgtaattgcaacaaaaatacgtgaggggttttaggaatgaatgatattttgcgtgagatcggcatgatagcaagagcgttggattccataagcaacatcgaatttaaagatttagacttaacaagagggcagtatctctatctcgtgcgtatatacgaaaatccgggaattattcaagaaaaattggcggaaatgataaaagtggaccggacaacggccgcgcgggccattaagaagctggaaatgcagggatttattcaaaaactgccggatgagcaaaataaaaaataaaaaaactgttcccgactgagaaagggaaaaaggtatatccattgttaagaagagaaggagaacattccacggaagtggccttgtccggttttacttcagaggaaaaggaaaccatttctgcactccttcatagagtgaggaagaatatagaacgtgattgggaatatgtgaagaaggggaacaaaagggattattaatggacaacgttaacaagttgagctgatgctggcgaaaatcggcgtttcctctcaagaatccagtcagctcgagcgtgggtgaaaatagtccgttcacttctgttttctttaaaactatcaaaaaatttccacaggagatggtttgcgtgaatttgagacaactatcagaacatgtctttcaatgtgaatttgagcttgatgtgcctcttcgtattccggttcatacctggtttatcaaagatggtgatgatgtttatattgttgatacgggaatagaacgttttgctgatgctcaaattagggcagcgttagcgatcggcaatccaaaagccattttgcttacccatggccacagtgatcatatcgggggtgcatcaaaatggttagagagatttgatattccgatttttgcgcaccagaaagaactaaagtacatcaatggggaagagccatatccgaacaaaaatgaagtggagaacacaggggtagcccatattgtacagccgctgacggagcaaacgcttgctcatctgcctctgaaatactatttaacacctggccattcgccggggcatgttgtgtattatcataaaatcgatcgtacgctattgacgggcgacctttttatcacaagtaaggaggatttacacccacctataagaagattcagtgttgatataaatgagaacatcgacagcggctcaatcatagatcaaatcaaaccaacgctcatttgctcttcacatggcgaagaaatcctttataacgaagaattgtataaaaactatgtggtaaggtatagggattaatggaagtgaaaaacataagctgaaaaatctccagcatggtgaagccctcgatccgatttactcacacccaaaaagaaaaaatggcagctgcctgccgcagaggcttttgcggagcttgttttacattcgattcatgagcaaaaggagtgagtgtcaggctcactccttttctatttaaattgcggctgtgagctttggttttacaaatttcatgaaaactcctctgactaatgggcccataatcagtaattgcaacggataggccaggatgaaatttttcaacacaatcataagataagcactgaagaggctgtccccgttcagcccatttgctagaaccgctgtcactaaaccgaacacagacatacaaagtaccatgccaatcaccatacaagttgacatggcaaggatgacataaatttttttagtcttgtcgaacggcatgcggaatgcaatcttcttggcgagggggcccactaacagtaaatctaacaggagggcgatcataaaaccgatgaccatttcaaaaacggtcatcagtgaaaaatcgtagatggctcggttgatgatggcattgtaaatcgacatgacgcaaaccattccaaagcacatcatcacgccaaatataaggccttcttttttatttgctggcatacaatcattccttctctccataatcggtgattagtataccaatgaaccgttcatgctcataagtgacaaatttgtgaacaatctatagcgcagaatcgtcttgttttgtcatcagcacatgcggaatgccgtccagcataaattcttctgatgcagtccgatagccgagcttttcataaaagcctgccgcctgtgtctggccgtgcagtttgaaggcagaaatgccttgttcttttacaatacgttctaatgcatcgacgatcacttttcccaaaccgaatttgcggtaagacttcagaatgcagattcgttccagtttccccgtgtggccaacgatacggacacgtgcagtgccaacaggtacattctgatgataagccaggatgtgctggcagtcaccgtggagtgtatcgaactcatcgaattcatccgaaatgggacagccttgttcctctacaaatactgcctttctgatttcaaacgctgtatgtaaatcctgttctgacgtgatttttttgacattcatgcttgaatccttcctactcagaaaaatggctgatcacatattgtttaaaggtctcagcaaccggtgataaaaacctgccttttatccaggcaattcctatgacacgctgacattccggccagctgacgcggattttggtgattttgctttggtctaagcctttcaggtctgggagaatagatatgcccagaccggctgccacaaaacctgcggcagtagttgcttcttctccttcaaacataatgttcggctgtatattggccttctcaaacagctcatcgaccgtcatccgaagcgcatagccctttttcaataaaataaaacgctccccggcaatctcattcagggtaatgctttcgcgactggctaatgggtgatcatttggcacaaatacaaagagttcttcactccacagcttgatccattggatcggattttcaggcttaatcgaagcgaggagacagaggtccagatctccggattttaatcgttcaagcagccaataagagtggttttgcttcagctggaaggaaatgttggggtattcctgctgaaaggagccgatgagatcgggcacgagcgtggtgcctaatgtatgtaaaaaaccgagagagactacgccttggtctggctttaataaggcttggatttcttcttttccttcggtatactccttcatcatcgcctgaacccgtcgtaaaaaaatgtgtccgtattgatttaagctgatggatcgtccttgcctgtcaaatagcgggacgcccaaatgattttccagcctggcgatagagcgtgaaagtgcaggctgtgtgatggagaggctttttgcggctttcgtgacgtgctgcatccgggccagtgtttgaaaatattcaagttgttcccattccaattatcatctctccttattacatataagcatgaaaaggatattttatatgcattatacaacatatatcaacggtgctaagataataatataaacagactcgaggatgtttgaattcgtaagaaataaaggatgattgtttatgaatggcagtgctccacaacatgatgagggaccgataaagtcccgatgacatacattcgaaaaggcacaccggtttttcgaaaaattacgtttgctttcttcgctgcgggtttcaatacatttgcgattctatattgcgtacagccgctcatggaggaattcacgcgggaatttcatgtaacgcctactgcggcgagtctttctttatctgttaccacaatgctgttagctgtgagcatgcttgtctttggttcattatccgaggtgtggggacgcaagcctattatgggtatttccatgctggccgcatcggttctctgtctggcatcggcctttagtccgagctttcatacactgctcgtattgagaaccattcaaggcgttgcgctcgcaggccttccgtcgattgcgatggcttatcttggggaagaaattgaacccggaagtcttggatcagcgatggggctatatatcagcggaaatgcaatcggcgccgttttcggaaggatcgtttccgggctcctgagcgagtacttgaattggcatatggcgatggggacaattggtgtcattagtttgattgctagtgttatattttttataaatttgccgccatccaggcattttacgccaagaaaattgaagctcgggaaattgggaatgtctctgatcggccacttgagggaccgtaaactattcagcttgtttctcattggttttttgctgcttggaagcaatgttgccttgtttaattacattgtgtatgtgctgttgggcccgccgtattcgcttaataaagcattttccagctggatctttattgtgatgattgtaggcattttcagctcgtctttcattggaagaatggttgatcggtatggctatccgaaaatattggtgatgaatattttcatcgtcattgcaggtgcgttatttacgataaacaatatgctggcagtgaaaattctggggattgccctctttacattcggttttttcggagggcattcagttgccagcagctgggtgggcaggagagcccttcacaacaaagcacaggcttcatcgctgtatttgttcttttattacgccggttcaagtgttttcggaacaatcggagggctattctggtctggttttcactggctgggcgtcgtcggtatgatcaccttcatgctgctggttgcgttatggctgtcgggatacttggcaagaagtgtgaaaatgccggataagaggaacgaaaaaggattgaattgatcagtaaaaaaggaccgttagcgggtccttttttatttccaatgggcaggggttcgtacagacagcggcagctttgtattcgaatcgccgttggcggcgttcacctgtgcctgtgtcaaaaagatgctcccggtcaggtcggcgccgctgagatcagcgtctctcatatctgcaccgataaagtctgtcattctcaaatcggcatttctcagatcggcggctatgagcagcgcccctcttagatttgctcctcgcagatcaagccctttcagtttcgcgccgatcaggacacttccccggctgacctttttcgggagttttggatggcgggcttgggcacgcaccagttcacttgtttttaacagccattcattgacctcagctcgatgctcgtccacctgcagtgtcagcaagcgttctttgctgagtctggtgagcctttctattttttcgaaagtggttctcagttcagaatgaatcggcttggctatatctatagaaagagcttcatgtaaataccagagcatttcgtgcagctgctgcatgataggaaaaacgtcaaacatctggttggccgtttcggggctgtttcgccaatcctttccctcataagtgatttgggatactttttggccggcgccaaagcattcatatgcagagcagcctcgaaatcctttttctctgagatctttatgtatagaacattgatagtttgattgtaagttgcggcaaggcgtgcccccgtctttatcaaaagcaaaatctgccgacttcgcataaggcaaggcgacacagcacaggccaaaacagtgctggcaatccgcacttaaatcataatgtatattgtcatgtaacgttacttccgcagacaataatgttcaccccttcacttgggtactttgttaaatatatctatttgattatataggaaaaaaggatacttttcattttgttttcaaggtttcagtggtctagcgatgtataatatatccaatcatgatgattgggggaattcatttggaacagcaattgaaagacatcatctctgcgtgtgatttggcaatccaaaatgaagattttgatacactgatgaattattattcggaagatgccgttttagttgtgaagccgggcatgatcgcgcgaggcaaggaagaaatcaaaaaagcgtttatcacgattgcgaactatttcaatcatcatattgtcccgacacaagggaaaatgatcctgttggaagcaggtgacacggtactcgttctttctcagacactgcttgattcggataaaaaggactccgagtatgcgatggaaagaagggcgacctatgtatttaaaaagaatgcgcaaggcgagtggctttgtgtaattgataattcatatggtacggatttaattggtgtgtaagatatgtctttgatgtgccattcctgcatataatgattcattcagctgattagggaaggtgacacaattgaatgtgtatgacatcagaatggctccttattggttttatgaaggcagaggacttgttcaacatccatacgtatttcggcagcctgtctcctcacgtgcaatcattgtatctacccgcggcgatgtaacgggagacggcgttattgacgaggtctttctaactggaaatcaaatgcccggcagcccgttatggagaaatatcacattggtgatccgtgatggcagaacccatcaggagcagcggattcagcttcaaaacaatatgggatacaatccgtcactttttctgggggatatgacaggcgacaagattgaggatgtggcagtagtaatggacacagggggaagcggcggtgctatttatgcatatgtgtttgcctatctaaacaggcagttccggcgaattttcaattcagatgtattgaatgatgaattaaagtacagtgtgaggtatcaaaatcaatataaagcgagcgttatcagtcatcagcaaaacgaaacgtatatcctcgaccttacttacaagggcagggaatatttgaatgagatttataacagccaaggtgtgttaaaaatgccgatagaaggatgggtgaatcctttatcgggcttgtatccggttgattttgacagagacggcgtatacgaattattggcgtaccagcggatagcgggaaggtataacgccgactcattgggatatgttcaaaccgtattaaaatggaacgggcagaggtttatgtttaaccgtcagactgttacgatttttgggagtgacttatcttaagtattctttcgatgcagaaaaagagtgcttttcagcaagcactctttattccagtttaattcgttttacatcccctaatacaaacacataaaaaaccaatcccagcaacaacacaaaaccggcaccagaaagctgagcgtaaggagcctgtcacatcaaataaatatcccgtcagtgaagtagctataatgcctccgaacaggttgtttgccaggtttattagaaatattgatgaatttactttttctttttaagatttgttttctgactgatcatatctcttcgcaattatcagcatttcattggattttctagcattacagcagttgaacttgtctgcagtctatcattggataagaaatagccagtttaaactaactatctttcttatatattactttttctgaagtttctagacgtccatgattcatttctaatgcaatgtcacataaagatataatatcttccttgtgatgactagtaataataatggtagctcccctttttttctcttgtaaaagaatgtcatgaacaaatgcaactcctttttcatcaatcgcatttgttggttcatcaagtagcaatatatcaggtttttcaaaaatagcctgtgcaatatttaatcgttgtttcattcctaacgagaatttactaacctttacactattaaaattttccaaaccaactctactaatagaatctaatatatcattatctgatgcgatctttttaatttttgacaaaattttaaggttagtaaaagcatcatactgaggaagtaactgcatattttctataattaatcctacacttttaggaaaagagatatctttatgtaattgttcacctttaatagttatactcccttcagtagggactattaacccggataatgcacgaagtagcatggtctttccagaaccattactcccaaatagtccataaattgttcctttttcaaatgtataagagatattatctaaaactgtagtctttttaatttttttgttaggtttaatacctcaatcattgtaagccctcactttttagcatatctatttttttgaactttaagacagataatataactattgaaatctgtaaaatgattataataaacaaacctaataatggttcaataatagcagttccagattgggaataatagcttaacccagttcttaatccattactgtagtttggaattaaaaagtagtgaataactttcggagaatttaattgcactaacttctttgctaaaattaacgaaaaaataatataaacgcttatatttaattgtgctatttgagatttataataaagctccataaataattgaaaactaaataagttaagtaaggttagataatacatgagtgtcatcataacaaatcttttattgataacggaattaatatcaaggttatgaagagatacaagtgaataaatataaaatatagcaatctgagataaagtaaagattaaaagtacaactgtaattattaagaattgagatgttacccatttaactctactatgttctcttactaactttaattgctcatacgaaatgtatgtatctctaatactcccagagaaacaaaaacttagggaaacaataggtacaaaccacaataaaatattttgatactcataatgacccgaggtgcttattggtatgccatctaaaaaaggaaagacatttttattattattataactcgataatgacgcctgaaatattatcgcaactaaagttatgaaaaagcctttaatcctcattttttataatccttattcaaaaaaattgaagatccaactaaataaaaataaaaactattattatctgtctaatataaactattataagatttgaagttgaccaatatctattgagcatatttgtgaatatagccaagtctctaaagggttcccaatatccattaggaagtaataatttaacgccgaaatacaagctatctaaaattatatacacaataaaaattgctaatgctactgaattaaacagatcgtatgtaagtctaaacataatacctactgataagtagaaaaacactaaactaatcatgtttaataaacaaattgataaaaagtttgcttcgaccaacaagtttttactaaagaaaatatgtgtacacgtaatattaataacagtatgtattgaagaaaaaagtaaagaaacaaacccaatctccataattttagacttgtagtaatttttacgcttaaccatcctcattactttgtaggggttttctgaatgaaaaaagttactaagtaacataagaaacgggacaatataaaacaaggtatatgcaaatattgaactatatccgaatgtactattattcatatatagtaatgacgcgatagaattctttccaagataagtgtggttctggttgaaccataaagtaactaaaaatagtagtaaacataaaattaatagtagtcttttaattttcattgtattttgcctcatataaaacaatactagaaattattattagaaaaataaagatagacaaacataggatagggagaagtacattataaccgtattctgtaaacggttggaataaaaacattaatgatttgttttttagtataagtacgaaccaaataaaaaaacttgctgggtaggcatacttcttatcacgaaaaagtaaactgaggcttgaaccaagtgctccaacaaatccagacataatacaacaaataatagaaaataacacaattgctatataaggatgggccatactaaaagtataaaggctgttatcagggaatttaatttggtctaagtcatttttaaatgtacctttaaaaaagaaaacctgaaccaataaaaagtttaatattagtgacaaaaacattgtcaaaaatgaaatgataaaagaggtaaatattttttccaaacaatatttttttctgccaactttgcttataagaatgtaatgatatcctgttttataatcttgtatagaatcgtcagcacatagtaacaaaaaataaagcggaagaaaccataataggatcatttgtgaagcatgccctacggaagtgccagaaaggaaaaacgcatatgcaggatggtattctgtgttagtcattaacaatagtgatatatcaacacaaggaattaatatgattatagtaaatattattatagttaatttatttttgataatgcgataaatatgactttccatgttctcactcaattcttaatagaataaataaaaatgataatcttataaaaagattatcattctaaattttttcgcgtggctaaaaggtgccaacgtttttagaaggttcttgtttaccaagtttcttcatcccatacaccatctataccataagaacttgcactgtaattgttgttttcaactgctaaggctacatatgtatggcttccctggctatttgcatgataataatgagctccgcttccttgttttacgttatgtattttagaagcttttggaattttactattccctgtgttaatcaaccaaaatgtcatgattgtacctttaccttctgccgatttctgtaaatttactttccaaggattatctgtatgagtggtctgtctaaatgcatcatttgaataggcattaccatagccataaggtacaagtaaatggaatttatagttatcattgctggcttttataaaattactactagcaagtaatgatatgcctaaagcagccgcaagaaggaaacggaaattgctcttcaggaatttattcataattttacaatcctttcaatatatattttatactatcggttagttaaaaataatgtgaaattttcgtttttatatctaactaaataaaactcaggatgaaattaaatgaagaccgtaatggggagatggagttactcctatttaaaacttcaacacaagtaataaaaacctccttttacgtaaaagattaactatattatatcttaactgtaataacctgtaaagaattttattgatagtattggattttatgttataaaggaaaaagggtgggcgatttgctcaattgagaatatttttattataaatttaatgaggacgattaatagtttgcaactccagaaaagtccatgattctgttccaagccctaccttgaccgattggatcactaaattgcatgatttgattttcaagtagaagccgtcgctctagattccggctacttaacaactctcatctctaaaggactatttgacctccaagtttttggtgccatcgcacatagacgttatcacccagtcaggggtttgcttccaaaatggaaatttcattataaagtgaacaatacagatacatttgttgaatcagcatacacttacgtactcaacaattgatcgcaaagactatcggtcatataaatcaaatcctgaaatatgtttgagaatattacacaaaatcaacgaaacgccagaaagtcgttactcggtatgtatggcaaaaccataaagaaaaggttagaaaagattgcttttctatttcaggaaatctctaaaaaaagaaaagaaaaaatagaacgaagctttgtaggttcaaaacaactgcacgggcttagctatcgcaggttcagggggtgagcaaacaaatcctcctcacagctgcatgccagaacatgaagaagaacgccacatacctagccggtatgtgggagctcattttctttttatgacagctgaatatcttgaaaaacagcacaaaactaaaaagcttgtagaaagaacaacgttttctctacaagcactctttattcccgcttaattcgttttacatcccctaagacaaacacgtaaaaaaccaatccaagcagcagaacaaaactggctaccagaaagctgagcgtaaaggagccttgtcacatcaaacaaaataccccgtcaatgaagccgcaataatgccttcgaacaggttgtttgccagatttaccatggagctcagcatggatacggaaccgatcggcgccagctctgcggaaatggaccagcgaaaccgtaaaaacaaaaatgaaaaggatccctacgtgtcaaacattgtataatatatccaatcatgatgattaggggaattcatttggaacagcaattgaaagacatcatctctgcatgtgatgtggcaatccaaaatgaagattttgatacactgatgaattactactcggagcgcatcatgtgtaaacctcggaaacaacctccccagcggttttgtgaattataaaaaacaaaaccagggattcggctccatttcaggagaccataatgatatccacgatattttagcgacaatagaggaaaacggcacacaggatgcttttcattatgaaggtggtcttcaaggaaaaaacgagcaggtgctcgaacagatagagcaggaaatgctagcttcggggcttgatatagaggaacaggacgaggagaaggtaaatggggacgggccgattctttgatgtaaagggagagctgccaactggcagctctctttttcatgttctatagtttaattcgttttacatcccctaatacaaacacataaaaaaccaatcccagcaacagcacaaaaccagctaccagaaagctgagggtaaaggagcctgtcacatcaaacaaataccctgtcagtgacgcagcaataatgcctccgaacaggttgtttgcgagattcaccatggagctcagcatggatacggaaccgatcggcgcgagttctgcggagatggaccagccgaccggagcggttgcggaaattccggcgagtccgatggaaatgcaaataatggctacggtaatattgttcgtcagaatggatcctaaaaagaaaaagccaaagctcattccgactatgattacggttcggtacaccttggtattaggatagcctttcttaataaaataatcgacgagccagccgccgacggcaattccggaaatggttgagatcagccacggcactgccgtaaataaaccggacgacatgagatccataccgtatgtatgtttaaagaaagtcggaagccaggtgagcagcaggttgaatgtatacccgtaccctgtaaatccgatcattaagccccatacttttcgattggtgaaaagcttttttaaaagcgggcccgttttgtaagggatttgctctgttgtaatggcattgtgtttttgaatatagtttagttcacttttagaaatgcgtttgtgccgttcaggctgttcataatactgccagaaaaagatcgtaaacagcacattgatgcatccaatcgtcaaaaaagcgacacgccagtcaaatgttgtgacaagaaaggcgaccaatggcgcgccgattacatttgaaaacttggcggccgaatcgaacagtgagtttgccaatccccgctcacttggaggaaaccagagagcggttgctttagaggcagcagggaacgcagaggcgctcgtcagcccaatgagaaaccggaacagatacaacagcaattttccttgcaaaaaagcaagaaggatcgttaaaaagctccatattgtcattccaaccctcgtgacccatgcgaccccaaaacggtccagcaaacttccgacaggcagctgcatcagtgtataggaataggtgtaaatggaaaacacgatgccgagttcagttgcagtaaggtgaaacgaatcttgtatcgcaggggccgctaccgagatggccactcggtcaaaataattaagaataataatgccgctaagtaacgaagatatgtaccatctggtatgcccaggccgtttcacgcgctcttgactcatgatgaaaacctcctctgtcatagcatgatctcctgatagaaaaaccattcaaattttaaataccacagcgcgcttttatataaacggcaggaatttgactggaacagatcggtgctttagaatgaaagtaataaaaatgaacactccaaaggggagtagctttcacagtaaagtcgtcattacgggacaaggtgtcctcggctttgctggcaatctcattgttagcgagacctttgccaaatctgatttggtgaaggtctttttgtttcaggaacttcaccaaattggtggagttttttcatttttatcaaaaagggagaggagcatcagaatgtctaagctgaaaaagtggctgaagcgtgaattggtgaggaaagggctgccgttagcgaaagagaaattgattccgatcttaaaagaaaaaatgaaaaagaaacgatgagggggctgaagatgaagatcattttgacagtacttgccggagtgggacttttgagtgcaggcggatgcggcatgcttgatcaggtgaacgacggattgaactatacgagtgaagcagctggttatgtggagaaggtgaagacatttgcagaggaagcgcctgaattggctgagaaagctgtaaatgacaccgaggcgaaagaaaaacttgaagcgcagcttgagtcgattcagaaggctgccgctgattttaatgaattaacgccgcctgatgccgcagcggagattcatcgaaccattcaggagcataacgaaaccttgcagaaaagcgctgaagatgtgttgaaacaagccgaggaaggcaaggtatcgcttaaagaattggagcagtcagacctggtccaaaacgcaaagcaaattactgatgtgatgggacaaattgagaagctgggtgaataagaaaaagcatcccgacgcgggatgctttttgcttattcagccattgcgtctgttaagacaggaacgacttgttttttacgggaaacaacgccttttaagagggctgtgttgttttctaatgtaacgttgaacgctttttccactttcgctgcttcgttaccgattgcaagagcaagtgaatcattttctaagatatctgtgataacgagaaggaacagatcaagattcttctcagccacaacttttgagatcacagcttctaattcagcttggcgtttttttacatcttcaatgtccactgtgtttacttgtgcgatttcgactttcttgctgccgagtgtaaattctttcgcatcaagagaaatgagctcttccactgtttttttgcttagatcagcgcctgctttcaacatgttcaagccgtattcttcagcatctactccagcgatctccgcaagctcttttgctgctgctacgtcttggtccgtgcaagttggagatttaaataacagggaatcagaaatgatcgcagacagcataaggccggcaatttctttctcgattttcacgttattctctttgtacattttgtttaagatggtagccgtacagcctacaggctcagcacgatagtaaagcggctcagctgtttcaaagttagcgatgcggtgatggtcgataacctctaaaacctgaacctcttcaatgtctttgatgctttgctggcgttcgttatggtcaaccaggataacgccgtttacttcgtttgcagctgtttcaacaagacgcgggctttcttgtttgaaatagtcaagcgcgtattgtgtttcgccgttgacttgtccgaggcggacaggctcagcattgaagccgagtttgtttttcaaatcagcataagcaatcgcagaacaaatcgtatctgtatctgggttttggtgtccgaaaataagtatcttttccatgatagctcctatccttttttaagtagtgtaatctttatatagtttaacacgtcttgctgcaggtgtaatcatgcaaacccttaaaaattgatgtgaataagaagcattttctttgagctaaggagaaaaggtgtgtaaaatactgggtagattagttgcaaaatgtaatgtagtatcaaaaaaggtactattggagggtcaagaatgagtgaaaaaaagaatatatacccgaacaaagaaggctgtccagttgaattcactctagatgtcattggcggaaagtggaaaggaattcttttttatcacatgatagatggcaagaaacgatttaatgagtttcggcgaatctgcccgagtattactcaaagaatgcttactctccagctgagggagctggaagcggacggcatcgtgcaccgtgaggtttatcaccaggtgccgcccaaggtagagtactctctgacggaatttgggcgcacgcttgaaccgattgttttgcaaatgaaagaatggggagaatccaacagagacgtgctggaatcttatcgttcgaacggcttagtgaaggatcagcagaaatagcagcaaagggaactcctttgctgcttgttttatttcattgaaatggctctgttggcgtttctgacatcgtttttcaacagttcagaaaggttgtaagacggataatatccatgctgatacatgtatcgataaacttgggcgtgcagctggatggcagcattcagctgtttgaccagtacgtttcttaattgaggtgttgctgtttctgtaattgcgatggcatagctgcggacagatgttttggcaaaaccgagcaggtcaccgctgtaaaatgggttatctgcgcgttcttcttcctcatcctctctgtgcggagcctgtggaaagaacggaagaagctctctcaaattttgctcaacaccctgaatagacacgttataaagctgtctgagctgagggtcttttacttctcttatcattttcttcagtttaatgagtccgtttgattgaaaagcaaccagctcgtgcatttctaatgtttcatgccaagccaatgttctgcgttcatccatgtgaaaattctcctttatcgatcagattccatatcagcatatgcccaacgctcaatgttgttcatgatgttttgaagtttttaaaaagggaaattcaccttatataggatacgggttgagaacatgcacaaagaggtgaaacacaatgtgggacatgataaagaactttttcttgtttagcagcggcgttctgcaagcaacaacccttttactggtgatcttaatttttatgtatgtcagaaaaacgaaaaagaaaaacaaggaatcttctggctttatggatgataaacattaattgtgatgggcattcttttcaaagaatgtcttttcctttttcatgtttcacatgaaacattagcgtcattttacttgcgatttggacttatgttaaaatataaaagtaaaatttagagatgatataaaaacattcggtgcaaagcatgttgcagcgatgaacaaaagagcagtcgtttatgctgctcttttctattcgtatgttcaggatgatacgaggtgactaagtgaaacaaacgagagctttaatggaaggtgctattttaatcagtctgtttgcgatcattacgcttctggtcgtttatgttcctgtgattggaacaattctgttatttgcactgccgctgccaatgatcttgtatacgatcagacatggattgaagctagggatatggatgggcgctgtcagtcttccggttgtttttattgtcgggtcctttaacgggcttattgtagcttttatgtcagcttgcgccggcattgccatgggacattttttcaaaaggaaagagcccgggcacgccattatttcgggcgctcttatttatatgcttagtattgtcttctattttgtgataagcattcagtttttgggtatcaatatcattgatgaggcaatgacacaataccggcaatctcttgatattgtagaaactgtagcgaagcagtcgggcaatgctgggcagtttgagaagcaattaaaactgatggaagaacaattgggtatcgttcaatatctttttccaacagctattgtgatggtaggagttattttttctttcctcagttaccttatcgctaagccgctcttaaggcgattctcccccgatattcctaatctaaagccttttagagagttgaagtttccgcaaagtgttgtagtactgtatttgattattgtcatgctttcatttttgcctttagaaaaaggccaaatgctgtactctatcgctttaaatggggagtttatactcgggtttctgattttcatccaaggtttatcatttatctttttctattgccataagaaacaatatccaaaggctgcggctgtgattgctgtcatacttgggtttgtgcatccggtcttcatggcggccattcgcattttaggcgttttagatatgggctttcatataaggaataaggtgaagtgaacatgagttttactcacatggtggggagtgatagaaatgccaagcttttatgaaaaaccgctgtttcggtatcccatctatgcattgattgctctgtcaattattacaatcctcatcagcttttattttaactggatattaggaaccgtcgaagtgctgctgctggcagttattttgttttttattaagcgtgctgattctcttattcgacaagagattgatgcttatatttctacgttgtcctacaggttgaaaaaagtcggtgaagaggcattgatggaaatgccgattggaatcatgctttttaatgaccaatattatatagaatgggcaaatccgtttctttcctcttgttttaatgaaagcactttagtggggagatcactttacgatacttgtgaatcggtagtgccgcttatcaaacaagaggtggaatcggaaacggttacattgaatgaccgcaagtttagggttgtcatcaaacgggatgagcgtctcttatatttctttgatgtaacagaacaaatccagattgaaaagctatatgaaaacgaaagaaccgtcctggcatatattttccttgataactatgatgatgtgacacaaggattggatgaccagacgagaagcacgatgaacagccaggtgacatctttgctgaacgcttgggcgcaggagtacgggatcttcttgaaaaggacgtcttcagaacgctttattgctgtacttaatgaacatatcttaactgaactcgaaaattcgaagttttcgattcttgatgaagtgcgggaaaaaacctcgtttgacggtgtagcgctgacgttaagcgtcggtgtcggggcttcagtctcttccctgaaagaacttggcgatttggcgcaatccagcttggacttagcactgggacgcggcggagaccaggtagccattaagctgccaaacggcaaggtgaagttttacggcggtaaaacaaacccaatggagaaacgaacaagggtgcgggcccgcgtgatttctcacgccttaaaggaaatcgtcaccgaaagcagcaatgtgattatcatggggcataaattccccgacatggattctatcggcgcagcgatcgggattttaaaggtggctcaggcaaataacaaagatggttttatcgtgattgacccaaaccaaatcggatcaagtgtgcagcgtttgattggggaaatcaaaaaatatgaagaactgtggtcaagatttattacgcctgaagaagcaatggagatttccaatgatgacacactgcttgtgatcgttgatacacataagccgtcactcgtcatggaggaacggctggtcaataaaattgaacatatcgtggtcatcgaccatcaccgaagaggtgaggagtttatcagagatccgctgctcgtttatatggaaccatacgcttcttccacagcggaattggtgacagagctgcttgaatatcagccgaagcgcttaaaaatcaatatgattgaagcaacagccctattagctggtataatagtggatacaaagagcttttctctccgcacgggctcgcggactttcgatgcggcttcttatttaagggcaaaaggcgccgacacggtgctggtgcagaagtttctgaaagaaaccgttgattcctatattaaacgggcgaagctgatccagcatacggtcctctataaagataacattgcgattgcttctcttcctgaaaatgaagaggaatacttcgatcaagtgctgattgcgcaggctgccgattcgctgctatcgatgagtgaggttgaggcttcatttgcggtggcgagacgggatgaacaaacggtttgtatcagtgctcggtcgcttggcgaggtaaatgttcagatcatcatggaggccctggaaggcggagggcatttaacaaatgcggcgactcagttgtccggcatttcagtttctgaagcgctggaacggctgaagcacgccatagatgagtattttgagggaggcgtacagagatgaaggttattttcttacaagatgtaaaaggaaaggaaaaaaaggcgaagtcaaaaacgtagcagacggttatgcgcataactttctaattaaaaaaggcctcgcggttgaagcgaacgcgtcaaacatcagcgcgttaaacggacaaaagcagaaagagaaaaaagaagccattgctgagcttgagcaggctaagagcttgaaagagacattagaaaaactgactgttgagcttagcgcaaaatcaggtgagggcggccgtttatttggttcagtgacaagcaagcaaatcactgaacagctccaaaaagaccataacattaaagtagataagcggaagcttgaactgccggacggcattcgtgcattaggatatacaaacgtgcctgtgaagctgcatcctgaagtgcaggctgtgttaaaggtacatgtaaaagaagaagcttaatagaaaagaggcttggattcatccaagcctctttttttattccacgagataaagagtttgctggctttctccgccaggtcctcttcgcattccctgcacgctgtttgtgctgctggaggaaccgctgtactcgtcagatgttatttcttttccgtttttcttaatccaggaaacaagttcgctgttgcctgagttgttttctgacagaaggaagtatttcactttgccttctttgatcagttttttcagttccgacacagtcagaatgggatccgtgccgttaaacccgcccattgccataacagattcattttcgtaaatgatgtatggcgcagctgttacggttgtcaaagtagcaaataaatactcttcgccggtattgtgttttctcagataggacaggagcccgctgtcgacctctgaagagaacatgttcccgccgtttgctgagcctttgagctgcgggccggattcaggaaggacgctgttgccaccgtatagaagcggcgttgctgaccagtaaactggtgtgagaagcagaacgcacaagctgatgatggtcagcagcttactgaacggatggctgcgtttaagcatcagaagtgcaagggtgatgcccagtcctaagagccccaggacatacatccatacactgccgatttggcttgtataagcgctcagaatatacacctgaaacacggctgtgatcaagacggctgccggcagaagatagctggaccagtctttattatttttgtataagcggtgcatcgtataccatccgataccagaaagggcggcaatcggcggtgccagcataatcaaataatactggtggaagaatcctgcgatgctgaagaaaccagccacgggaacaagccaagccgcccagaatagcgtttctttcattttagcagcatgtccgcggcgatcacggtaccagctgatgattgcgcccagtaatccgatcaatgagaatggaagcatccagctgatttggccggaaagtgctgattggaagagacgaagcggtccaggatcaccggtgccgaacatattcacgctttttccgcctccgccgccaggccctccatttccaggtccgttgccacctgtgggaggtgtgcctccgcctccattgagagcgccggtttgtccgttaggcggctgaggcgcctgtgaatggtttccgaatgattgattaccgttctgagaaaaagatgaaccgttgccatttggcgcttgcatgttgtcttgattctgcatgttccctccgccagcagcattcatatcaccctttgcaaggcccgtagtttgcccaaacagacgctctgtgccgttgtagccaaaggccagttctagcactgagttagtctggctgcttcctacataaggccggcttgaggaagaggctgaatccactgcaatcgcccatgagagtgaaaggcctgtcagaaggacaagagacagaagcagggacccgatttttttcttcagagaaacccgagatgcaatcaggtagaataacacaaatgcaggcaataccataaacgcttgcatcatcttcatattaaaggcgagcccaatcagggcaaatgccgtcagcagccaaaccagcttgccttgttttactgccctaagcagacaagttgaaccgagcaataaggtaaaaacaagcatgctgtcgatattgtttgtccggctgacagctactgcgataggggtcagtgccatgacaagtgcggcaatgcgggccgctccaactccaaaagtcggcttaaccattctgtagagaaggaagacagatccaactccggcaagagcctggggaatgatgacactccacgtgtgaacaccgaaaatcagtgcgaaaatcgtttgaatccataacacgacaggaggcttatctactgtcacaaatccagaagggtcaaatgacgcataaaaaaagttatggaagctttgcgtcatgctttttacagccgccaaatagtactggtttgctgtatcatcctgccaaatgtgatacgtattcaaaaaagctgctgctagcaaaataagaataagggctgcgtcgaatcgtttggttttcatcgtttttcacctctttatggtgtctcattgtaaaaaacaaatatgaaaaacttatgaataaaccataaatattcaaagaaaaaagcggagatatcttccccgctttatgctgaatttctttgtttttctgactggaaaatgtatcgatctcgtccggctccctgtccggctgctcccattacgatcagggcagcaatgagaagcacaatcggcatcgtccaagaatgcgtctggtcaaagagatagccgacaaagattggcccgactgctgccagcaggtagccgaatgactgagacatgcctgacagcgcagcggcctgttgggcattttcactgcggagaccaatcaaagtaagggccagactaatgctggagccttgtccgataccgataatgatcatccagatggcaagcaatgtatggcttccgcccgctaataatccgcaaaggccgatcagataaactgaggccagcgccgcaacgataccgcgctgctgtttcacacggtcagctaaaactggcgtcagaaaagtggaaggcagactcgcaaattgcatgagtgataccatccatccggctgttgccgtatcaatcccgtgtgaacggagaatttcaggaaaccaagcgatgctgctgtaaaataaaaacgattgcaggcccataaagatggtgacataccatgccattttggaagcccaaatggaactggattgcagcttcattgtctggtttgccgtatctcgatggcgcagctgaggtatccagattagcaatgcaagtaaagccagcccgccccataagagaaaggcttgtttccatccgccattcatctgggtcgctaaaggaacgctgacacccgatgctaaagctgcgaatatattcattgatgtcgtatacaggctgatcatgatccctggcttttcagggtatttatgtttgattaagcttggcaaaagtacgttaccaatcgcaatcccgacgccgataagtgctgttccgaaaaacaaagcggcagtatagccggtagaacgagtcagaacaccgatcagcagtatcacgagacctagccataaagttcgctcattaccgaggcgctgtccaagcttaggtgcaagcggagaaagaactgcaaacgaaagcagcggcagtgcggtcaaaaaaccggctgccccattggacatgtgcagctctgcccggatagagctgatgaccggaccgactgaagtgatcgcgggccgtaagttaaaggcgataaagataatgccggtgatcagccaaaatgattggatttttttattatgtggatgtggcaaagcagttactcctcttttctaacatatacatgatattatcccgaaacaggtaagcaagtatgtgaatgaaggctatgatttgtcctctttttgcagttcagccattttggcaagcagaatatgctgaggcatatgcatgatctgttcaagcggcagattcaaggactctgcaagcttttgtgcagtttcggcagaaatttgcaaaggtctcacaaaagatccctcctctcttctgtccattgtacaagaatcagatgtgaaatgtaagaagatgtcacaaaggaatagagcaatcggaaaatgaccgttataaaagaggtaaggagggttcttatgcacgcaccgttatccttattaaaacaaatgctgaaggaacaccaaatagacactgaaaaagctgtcactttcgaagaatatatagcaatgaggttaaagcttcaggagctgatggggaaatttgcttcgatcggggagtgggatctgtatcaaaaagcggcagatttgatgatgcacataggcatccaatggatgaaataaaccgataaccgctaaaaaaccctcgctgcagcgaaggctttcattcattaaaatgagtgttcttcttccacatttttaaactggtcataaattacaagcttagacggactgttttccttagccacctgtttggccttttcaatagcggcgtctttagacgtatacaaagctgtcggcgctacattctccacctcaataaaccagccgtccgcatcaacattaggtgtaatcgcatatttctttatcatctttcattcctcccttatgttttattgcatttttcccgccttgttactgtccgaaacgatccaatctgctaactgaaaaaaacaggaaacagacaatttttctattttttttctgtagaaatggtagaatggaggttggagattttttaatgagaggacggtgcttagcatgacagaccttctgaatgaccggcttcctccgcaaaatatagaagccgaacaagccgtgttaggcgctatttttttacagccgtctgctttaacactggcttcagaagtattgattccagatgatttctatagaatgtcccaccaaaaaatctataatgcgatgctggtgctcggtgaccgaggtgaaccggttgatctggtgacagttacatcagagcttgcgaacacagacctgctggaagaagtaggcggtatttcatatttgacagatatcgcaaactcggtgccgacagcggctaacatagaatattacgcgaaaatcgttgaggaaaaatcgattcttcgccgattaatcagaactgcgacaacgattgctcaagacgggtatacccgtgaggatgaggtcgaggatttactcagtgaagcggaaaaaacgattatggaagtggcacagcgcaaaaacacgagtgccttccaaaatattaaggacgtccttgtccagacctatgataatatcgaacagcttcacaatcgaaaaggtgatatcacgggaattccaacagggtttacggagcttgaccggatgactgcgggtttccagcgcaacgacttgatcattgtggctgcccgtccttcagtagggaaaacagcctttgccctgaacatcgcacaaaacgtggcgacgaagaccgatgagagcgtagcgattttcagtcttgagatgggtgccgagcagctcgttatgcgtatgctctgtgccgagggaaatatcaatgcccagaatctccgtacaggtaacctgaccgaagaggattggggcaagctgacgatggcaatgggaagcctatcgaacagcgggatttacatcgatgatacaccgggtattcgagtgagtgaaatccgtgccaagtgccgccgcttgaagcaggaaagcgggctgggcatgattttgatcgattacctgcaattgattcagggaagcggtcgttcaaaggacaaccgtcagcaggaagtatctgaaatttcccgtgaactgaagtcgattgcgagggagctgcaagtccctgttatcgcgctttctcagctttccaggggtgttgagcagcgtcaggataaacgtccgatgatgtctgatatccgggaatcaggaagtatcgagcaggacgcggatattgtcgcgttcctttatcgtgatgactactatgacaaagaaaccgagaataaaaatattatcgaaattattatcgccaaacagcgtaacggcccggtaggaaccgtgtctcttgcgttcgtaaaagaatacaacaaattcgtcaacctggaacggcgttttgatgacgcaggcgttccgcccggcgcataagccccaagagctgctcttggggttttttttcattcgaaagatggaagaaatgacgttcgctcagcggatgaaaaattgaaagcgttttaataaaatggtgcaaaaaggagatggtaacaatatgggaaaacgtttttcgtcttttcaagcagcacaaatccgaattgcgcgtcctacgggccagcttgatgagattattcgtttttacgaagagggactgtgtttgaaacgaataggagaattttcacagcataacgggtatgacggtgtcatgttcggccttcctcatgccgattatcatttggaattcacccagtatgaagggggaagcactgcccccgttccccatcccgacagccttcttgttttttatgtgccgaatgcagttgaactggcagcgatcacttcaaagctaaagcacatgggctatcaagaggtcgaatcagagaacccgtactggagcaatgggggcgtgacgatagaggacccggacggctggcggatcgtttttatgaattcaaaagggatatcaggcaagtgattctttcttatgctaaaggatgaaagtttcgcaagctttttatgacaaagcagtgagaaaacgcttataaaacgaatggaagcgaacgaatatagatttacaataaattaatgttcggatttacaattgactttctgtttcttcactgataaacttgatttgtttgaatagaatcgttttgaaaggttaacggaggtgcacggacatgtcttcagtagttgtagtaggtacgcaatggggcgatgaaggaaaaggtaaaattacagatttcctatcagaaaatgcagaagtgatcgcccgttatcaaggcggaaataacgcagggcatacaatcaagtttgacggaatcacatataagcttcacttaatcccgtctggaattttctataaggataaaacgtgtgtaatcggaaacggaatggttgtagatccgaaagcattagtcacagagcttgcgtatcttcatgagcgcaacgtgagtacagataacctgagaatcagcaacagagctcacgtcattctgccgtatcatttgaaattggatgaagtggaagaagagcgtaaaggggctaacaagatcggcacaacgaaaaaaggaatcggccctgcttacatggataaagcagcccgcatcggaattcgcatcgcggatctgttagaccgtgacgcgtttgcggaaaagcttgagcgcaatcttgaagaaaaaaaccgtcttctcgagaaaatgtacgagacagaagggtttaaacttgaggatatcttagacgaatattatgagtacggacagcagattaaaaagtatgtttgcgatacatctgttgtcttaaacgatgctcttgatgaagggcgccgtgtattatttgaaggcgcacaaggggttatgctcgatatcgaccaaggaacatacccgtttgttacgtcatctaacccggttgccggcggtgtcacgatcggttctggtgtcggcccgaccaaaatcaagcacgttgtcggtgtatcaaaagcatatacgactcgtgtcggcgacggtccttttccgactgagctgaaagatgaaatcggcgatcaaatccgtgaagtcggacgcgaatatggaacaacaacaggccgcccgcgccgtgtcggctggtttgacagcgttgttgtccgccacgcccgccgtgtgagcggaattacagatctttctctgaactcaattgacgtcctagcaggaattgaaacgttgaaaatctgtgtggcgtaccgctacaaaggcgaaatcattgaagaattcccagcaagtcttaaggcacttgctgaatgtgagccggtatatgaagaaatgccgggctggactgaggatattacaggtgcgaagagcttgagcgagcttccggaaaatgcgcgccattatcttgagcgtgtgtctcagctgacaggcattccgctttctattttctctgtcggtccagaccgctcacaaacaaatgtccttcgcagtgtgtaccgtgcgaactaaatagaatatgtctgcaagcccctatttaaggggcttgttttttgtttgaaagccgcatataagttggtctgagaaaaaaatatgaaaaaaaccaaaaagttattgccacttctatttgttcgtgatattataaatctcgttgttacggaaactgcttcaatagagtacaagatgagaactagatttaagtcgtttgctctatagaaattccgacatctttaagagccattagctcagttggtagagcatctgacttttaatcagagggtcgaaggttcgagtccttcatggctcaccatttcgtgaaggcccgttggtcaagcggttaagacaccgccctttcacggcggtaacacgggttcgaatcccgtacgggtcattgatttactttagcgttattgctaaattccttatttgtctgtgagagctgacacgacagctctccgggcaattactgtaaggtccggtagttcagttggttagaatgcctgcctgtcacgcaggaggtcgcgggttcgagtcccgtccggaccgccattttactttacttagtagagaaaaataaaacatttggctcggtagctcagttggtagagcaacggactgaaaatccgtgtgtcggcggttcgattccgtcccgagccacttaccaaacgcatctgcaatcgtaggtgcgttttttcttttaggaaaaaggcaaacatgaggagtgttataatagaagaaaaagggagaaccggccctgcggccggttcaaagaagaagacgtcattgataaagacgcactccggtgaggggaggtttcaataaagttatcttttttaaaaaaagttgaccagcatgacaatagataaacaactggcgataaaggtgaaacatgtgtttttttctaaacctttatttttttatcttttgaccttaaaccgttataatagacaaggacccattctttacatgggccataagtgatgaaacgaatgttatatagatgaaatgaagtcattcggcaggaggaaaatcaaaatgatggataaaaagatccttgtagtagatgatgaaaaaccgattgcagatatattggaatttaacttaagaaaagaaggctatgaagtgcactgtgcccacgacggaaacgaagccgttgaaatggtagaagagcttcagcctgatttaattcttttagatattatgctcccaaataaagacggcgttgaagtatgccgcgaagtcagaaagaaatacgatatgccaatcattatgctgacggctaaggattcagaaattgacaaggttatcgggcttgaaatcggtgctgatgactatgtcacaaaaccattcagcacacgcgagctcttggcgcgtgtaaaagcgaacctgcgccgccagctgacaacagcgcctgcggaggaagagccttcctctaacgagattcatatcggctctctcgtcatcttccctgacgcgtacgttgtatcaaaacgagacgaaacaatcgaattgactcatcgtgagttcgaattgcttcattatttagcaaaacatatcggacaagtgatgacccgtgaacatttgcttcaaaccgtttggggctatgattacttcggcgatgtcagaacggttgacgtaacagtccgccggcttcgtgaaaaaatcgaggacaacccgagccatccaaattggatcgtcacacgccgtggtgtaggttattacttgagaaacccagaacaggactaatgcccatatgaataaggttggtttttttcggtcgatccaatttaagattaccttgatttatgtgcttttgattatcattgccatgcaaatcattggtgtgtattttgtcaatcaggtagagaagtcgctgatcagctcttatgaacaatcgctgaatcagcgaatcgacaacctttcttattatatcgaacaagaatataagagcgataacgacagtaccgtcataaaggatgacgtcagccgtattttgaatgacttcacgaaaagtgatgaggttcgggaaattagctttgtagataaaagctatgaagtggtcggttcttcaaagccgtacggtgaggaagtggctgggaaacaaacgaccgatctgattttcaaaagaatcttttctaccaaacagtcgtatttaagaaaatattatgacccgaaaagcaaaatcagagttcttatttccgcgaagcccgtcatgactgaaaaccaagaggttgtgggcgcgatctacgttgtcgcgagtatggaagatgtctttaatcaaatgaagacgatcaacacgatactggcgtccggcacaggtttggcacttgttttgacggctcttctcggtatttttctggcaagaaccattacccacccgctttcagatatgcgaaagcaggcgatggagcttgcgaaagggaatttctcgaggaaggttaaaaagtatggacatgatgaaattgggcagctggccacaacgtttaaccacttaacgagagagcttgaagatgcccaggcgatgactgaaggagaacgcagaaagctagcctctgtcattgcttatatgacagacggcgttatcgccacaaaccgaaacggagcgattattctcttaaacagcccggcgctggaactgttgaacgtttcacgtgaaacagccttagaaatgccgattacgagtttgctggggcttcaagagaattatacttttgaagatttagtggaacagcaggattctatgctgcttgaaattgagcgcgatgatgaattaacggtgcttcgcgtgaatttctctgtgattcaaagggaacacggcaaaattgatggtttaatcgctgtcatttacgatgtaaccgaacaagagaaaatggatcaggaacgcagagaattcgttgcgaatgtatcacatgagctgcggacgccgcttacgacaatgcgcagctatttagaagcgttagctgaaggcgcgtgggaaaataaagacattgctccgcgcttcttaatggtgacgcaaaatgaaacagagcgtatgatccggcttgtcaatgatctgcttcagctgtcgaaatttgacagtaaagattatcaatttaaccgggaatggattcagattgtccggtttatgtcacttattattgaccgttttgaaatgacaaaagagcagcatgtggagtttatccgcaatctgccggacagagatctgtatgtcgagattgaccaggataaaataacgcaggtgctcgataatattatttctaacgctttaaaatattcaccggaaggcggacatgtcacgttctcgattgatgtcaatgaagaggaagaacttctctatatcagcgtgaaggatgaagggatcggcattccgaaaaaagatgtcgaaaaagtctttgaccgcttctacagggtggataaagcgagaacgagaaagcttggcggcaccggtctgggattggcgattgccaaggaaatggtacaggcgcacggtggagatatttgggcggacagcatagaaggaaaaggcacgacgattacatttactcttccatataaagaggaacaagaggatgattgggatgaagcgtgaaaatataaaaacgatattacttacggtactcgtcgtcatcagtcttgtttttacatgggggatatggacgttccagccaaacttttctgaaggctcatcctcaacagagtctactgttcgtgtgaaacataaaatcgaaaaaaccacccaaaagctgtctgaaacggtaaggccaagggacatgtttatccatgatgacggcgctcattacaaagtggatgacaatgccctctatgaagaaatttggtctgacttgccgcattgggatgtgaaaggaattaaagatatttcggatcagtatgacaaggctggattcaaaagctggttttatggaataggcggttctgaagccaagcttgacttgcaattcagcgatacgatcccgattgatattttccaaacgctgtttaaatggtctaatcagtcgtttgaatacagttcgtttgaccatattctgatcccgttcaatgaaacaaaagcgaacaagaaaatctatttggtgtcatacagcaagcagctcattcttgaagtgacggttgaatcagcaaactaccggaacattatgaacgacttgaaaaacaggcaatcaaatatgccggcgttcagtttgttctccattggctcaaagaaagagttcttgctgccgaacaaaccgcttacgatggacaaaaaagaatttgtcacagaatcgattaaaacaaatacctttaagcaggctttgtttagtgatccgagcattgtaagagaagattcgaattacaacaacagaaatgtgctgacagatgggatcagccggttagatgtgaatctaagccagagacaggtgcaatttcagcagcgcaatttggtgcagagcacatcctatcaaacaggtgaattaatcaaaaagagccaaaaataccttgaggataccggaagctggacggatcactatcaatttttcaatatcaatgacagccagcagttgagcttctatatttttatggatcagatcccggtcattaacagcaccgccaaacctttcggggcgacatcggcgattacggtgcaatgggcgaatgatgatattctcagctataagcggccgaattacagtctcggaacgaatccgattaaaacaagtgaaacagagctcatgggcggcagcgaagtgaagatgctgctttcgaaacaaaccgcttatgatacggacaaaattgatcagatcttccttgcttatcaattggtatcaacatcaaccaacgatgatcctctcgttgaactggaaccggtttgggcgatgaaagtaaatggaaaaattgtgccgattacaaaggatttattgaggaaggagggggctaacagtggagtggaataagacaaaatcaatcttcatcgttgccttcctcattttagatattttcttaggctatcagttttttcaaaaatggcaggctaccggcaaagaatatgaagtcattaaaaatgatgtcgagcatgacatgaaggccgatcatatcacgtatgaaggcttgaataaggaagcaacagaaggctatcggatcacggcaaatcaaaagtctttctccaaggaggaaattgaggcgctgaaggatcaaaagcctttgatggacatgcctagtgatgatcataaagtaacgagcctgaaaatgaagtttgcaaatccaatcgcactatcaaagaaggatatcgaggacgatgctcaggcacttgtttcttcgaaaattcaagatggcgaaaaatataagctttggaaggttgataaatcgaagaaagaaattattttcttccaaacgtacgaaggtcattatatttaccaaaagaccgacaatccctctaatatgatcgggcaagtggtgctgcacttaaacggtaaaaacgaggttgtgtcatacgaccagactacgcttgagaccttcaagcaaatccagaaagaaagcttaattactgaaatggatgcggttgagctattgtactatcaaaatcaattaaaagaatacagcactgtgaagagctgtaaattcggctatgtagcacaatatccgctgacaagtacgcaggtgctggcgccggtatggagaattacggtcgagtacgagaaaaaagtgaacggtgagaaaaagacagtacaagagtattttactgtgaatgctttggagagtacgattttagatacagatcaatgaaaataatggagtgagacaaacatgagcttgcaatttagcgtacttgcgagcgggagtacgggaaatgcgttttacctcgaaacagaggatcacgcatttttagtggacgccggtttgagcggaaaagccatggatgggctgatggcgcagatcgggcgtaagctggatgatgtagacggcatttttgtgacgcatgagcatagtgaccatattaagggccttggtgtcgtcgccagaaagtacaagcttccgatctatgcgaatgagaagacttggaaagcgatggagaatcaaatcggcaaaattgacaccgatcaaaagtttgtatttccaatggagacggtgaagtcgttcggcggacttgatgttgaatcgtttggcgtttcccacgatgcggcggaaccgatgttttatgtattccattatagcggccgaaagctcgcgttaatgacagatacgggatatgtcagcgaccggatgaaaggcattatccgttcagcgaatgtatttgtgtttgaaagcaatcacgatgtcggtatgctgcaaatgggaagatacccatggagcattaagcggcggattttaagtgacgtcgggcacgtgtcaaatgaagatgctgccttggcgatgacggatgtcattggcgatgagacgtctcgtatttacctggcgcatttgagccaggacaacaacatgaaggagctggcaagaatgtctgtgcagcagacattggcttctaaaggatttgtgacgggtgagacatttgacttatacgacaccgatccgaagaaggccactccgctttgcgctgtataatttttctatgtaaatcatgactattctaggagtttctaacccacaatataaccatattaacgttcttggaaaggatggaatatggtggattacgaacgtgaggaagaacatactactcctgaacagccaaagagaagcaaaaaaggatattttctttcgagtctgattggcgtgattgtcggtgccgtattaatggcgtttatcatgccgtacctttcaaatgaagggctggatacaggcgccttagatcagcagcaaaacaacaatggccgggaatcaatcaggacggtgaatgtcagtgtcaacaatgccgtcaccaagattgtcagcaatatgtcgcccgccgttgtcggtgttgtgaacatccaaaaatcagatatttggggagagagcggcgaggctgggagcggctctggcgtcatctataagaaaaatgaccattccgcttatgtcgtgaccaaccatcatgtcatcgaaggcgcttcccaaattgaaatcagcttgaaagacggctcacgtgtatcagctgatcttgtcggcagcgaccagctgatggaccttgccgttttacgggtgaaaagcgataagattaaagcagtcgctgatttcggaaattcagataaagtgaagtctggggagccggttattgcgatcgggaacccgttaggccttgagtttgcaggctctgtcacacaaggcgtcatctcgggtacggagagggcgatcccagtagattcaaacggtgatggacagcctgactggaacgctgaagtcctgcaaacagatgcggccattaaccctgggaacagcggcggcgctttgttaaatatggatgggaaggtcattggcatcaattcaatgaaaattgccgagtcagcggttgaagggattggcctgtccattccgtctaagctcgtgatccctgtgatagaggatttagagagatacggaaaggtcaaacgcccgttccttggcattgagatgaaatcgctaagtgacatcgcaagctatcattgggatgaaacattaaagcttcctaagaacgtcaccaatggagcggttgtgatgggtgtagacgccttttcacctgccggaaaagcggggctgaaggaactggatgtcatcacggaatttgacggatacaaagtaaatgatattgttgacctgcgaaaacggctttatcagaaaaaagtcggtgaccgggtgaaggtgaagttttatcgcggcggaaaagaaaaatctgttgatatcaagctgtcctccgcagaccaattaggcagttaataaaagcagtctggcatcgttgccaggctgttttgatatgcaaaaaaaactgaacaggggtcacgcccgttcagttgaaaaaggatatatcgaatatgaagaaaaatacaagatggatgttacacgtgaaacagcaaatggcagttagctgcaaatacttccgttatttgcatggactttaatggtttgtaccgtgtggttgctggctgtgatacacataggtgccattttctttcttcaatgcataagaagtgacgttttttagtgtttgaccggttttacaaggcagacccatcccgctcccggaaatatggaggttcgggattaggccttgccataacgaaatcgattatcgacaatcacaatgggacgattgaagtgaaaagtgaaatcggcagaggcactgtttttctgatcaggcttcctgctccggattattcgttagacgagtgagaaaatttcttcagccgatattggaggctttgtctgctgatgccaagctcctgagcagctttcgagatgttatggccgtgttttcttaacacgttctctatcacatatttttcgaagctttccattttttcttttaagtccgcggctggctggtgtcttggtgtttccggctctgggatgtcagccggcttgattttcatgcggtattgatagggcagatgggaagccgtaatcgtttgctcgtccgtcatgaaattcattgcgccttcgatcatatgctcaagctcgcgaatatttcccggccagtcataagaaaggaaaaattgcttcacgtcatcgctgatgtgttcaacattcatttggaacagatggttgtttttctggatgaactccgacgcgagaagcaaaatgtcttcttttcgttcccgaagcggcgggatgatcagtgtgacgacactcagcctgtaatacaagtccttccgcattcgttcgcctgcaattgcatcaattgggtcttcattcatcgtggcaataatacgtacgtcaatcggtgtatcctttgttgaaccgatgcgcctgattttccgttcttgaagggcgcgcagcagcttcgcctgaaggctgagattcagcgagttgatttcatctaacagcagtgtgccgccgtgggcttgttcaaacaggccgggctggtcgacagcgccggtaaacgcgccttttttcgtcccaaacaaaatgctttccacaaggctgtctggcagtgccgcgcagttttgcgaaataaacgggccgccagaacgatcgcttccattatggatactttgcgcgaacagttcttttcccgtgccggtttcgcctgctagaaggacagatgatgacgtacgggttgcccgcttggcgttttcgatgacgtcttgaatggccggactggtgccgagaatactgtcaaacgtataggttgtgctgccttttttgttcatattctccctgatcagccgttccagctttgtcacatccttggcaatttcaacggcgcccctgattttgccgtcttggacgatgggatatgtatgattgatcgtcgtaatttcctggcctttattattgaaatagctctgtttgacgtttttaatcgtcttgccttcctgaagagcctgtaccagtgtgctgtcctgctgctttgaaaacataaacacatccatcaggtttttattcaagacgtcatgcttctccatatcttcaatctgcatcattttattgttataaacgattgtgtttccatgctcgtctaccacgtgcaggccaacatcgatttcatctaaaatactctgaaaaaccaatgtgaggaattcgctgtctttgaccactgtatgaacctccctcaattattttcttaatattgcttctattttataaaaaaacggagaggatatgcaaaagaattttgcacttgctgaaattttcgctcgaaatatcagaatgtttttgcaccttgtcctcgaaaattgtagaaaacacacgaattcttgatttggcacagaacttgcatttatataaagggaaagcaggataacatgttgaaacagaaaacaagggggaattcaaatatgacagctttatctaaatccaaagaaattattgatcagacgtctcattacggagccaacaattatcacccgctcccgattgttatttctgaagcgctgggtgcttgggtaaaggacccggaaggcaatgaatatatggatatgctgagtgcttactctgcggtaaaccaggggcacagacacccgaaaatcattcaggcattaaaggatcaggctgataaaatcaccctcacgtcacgcgcgtttcataacgatcagcttgggccgttttacgaaaaaacagctaaactgacaggcaaagagatgattctgccgatgaatacaggagccgaagcggttgaatccgcggtgaaagcggcgagacgctgggcgtatgaagtgaagggcgtagctgacaatcaagcggaaattatcgcatgtgtcgggaacttccacggccgcacgatgctggcggtatctctttcttctgaagaggaatataaacgaggattcggcccgatgcttccaggaatcaaactcattccttacggcgatgtggaagcgcttcgacaggccattacgccgaatacagcggcattcttgtttgaaccgattcaaggcgaagcgggcattgtgattccgcctgaaggatttttacaggaagcggcggcgatttgtaaggaagagaatgtcttgtttattgcggatgaaattcagacgggtctcggacgtacaggcaagacgtttgcctgtgactgggacggcattgttccggatatgtatatcttgggcaaagcgcttggcggcggtgtgttcccgatctcttgcattgcggcggaccgcgagatcctaggcgtgtttaaccctggctcacacggctcaacatttggtggaaacccgcttgcatgtgcagtgtctatcgcttcattagaagtgctggaggatgaaaagctggcggatcgttctcttgaacttggtgaatactttaaaagcgagcttgagagtattgacagccctgtcattaaagaagtccgcggcagagggctgtttatcggtgtggaattgactgaagcggcacgtccgtattgtgagcgtttgaaggaagagggacttttatgcaaggaaacgcatgatacagtcattcgttttgcaccgccattaatcatttccaaagaggacttggattgggcgatagagaaaattaagcacgtgctgcgaaacgcataaatccgcaccatggcgggatattcacttcgtttgtataaatttacaacagaaaaatcagcactccctatttgctcagctacagtattttagtataatgtatctttatgagaagaagtgaattttatattaaatagatagagactctttggacagcaaactgggatagcaccatgcagatgttccagcttagatccaatacaagttgctgaaggggtgcagaatgtgaatacaaaccaagataacggaaatcagctccagcggacaatgaaatcacgccatttgttcatgatttcattgggcggagtgatcggaaccggtttcttccttggaaccgggtttaccattaaccaagcgggaccgctcggcgcggttctgtcctatttagtgggcggctttatcatgtttttgaccatgctctgcttaggagagctggcagtcgcctttcctgtgtcggggtccttccagacctatgccacgaaatttatcagcccggccttcgggtttgcgttcggctggctgtactggctcggctgggcggttacatgcgccattgaatttttatcagcggggcagctgatgcaacgctggtttccgcatatagacgtgtggatctggtgtctggtctttgcggcactgatgtttattttaaatgcgatcaccacaaaagcctttgcggaatctgaattctggttctcaggcattaaaattttgattatccttttatttattattctcggcggagctgccatgtttggcctgattgatctgaagggcggagagcaggcgccgtttttgacacatttttatgaagacgggttatttccgaacggcataaaggcaatgctgattacgatgattactgtgaactttgcgtttcaggggactgagctgatcggggttgcagccggagaaagtgaagaccctgaaaaaacgattccgcggtccatcaaacagacagtatggagaacgcttgtgttctttgtgctttcaatcattgtcattgccggcatgattccgtggaaacaggcgggtgtcgtggaaagtccatttgttgccgtatttgagcaaatcggaatcccatatgcagctgatatcatgaactttgttattttaatcgcactgttatctgttgcgaactcaggtttatacgcatcaacacgtattctgtacgcgatggcgaatgaaggacaagccttcaaagcgcttggcaaaacaaatcagcgcggtgtaccgatgtactcgttaatcgtaacgatggctgtggcctgcctatcacttctgacaaagtttgcgcaggctgaaaccgtatatatggtactgttatctttggcgggcatgagcgcgcaggtcggctggattacgatctcgctttcccaaatcatgttcagacgcaaatatatccgtgagggcgggaagatagaagatttgaaatttaaaacaccgctgtacccggtgcttccgctgatcggcctaacgttaaatacggtcgtgctcatcagtcttgcatttgatccggagcagcgtatcgcgctgtattgcggcgtaccgtttatgatcatttgctacatcatttatcatgtcgtcattaaaaaacgccagcaggcaaatcgtcagctagagctttaaaaacgttgtccgcaagtcatctttgttataacccgcataggacattatcttaaatgttgaggtggaatcacagatggataaaacgatttcggttattggaatgccaatggatttaggacaagcacgacgcggagtggatatgggcccgagtgccatccggtacgctcatctgatcgagaggctgtcagacatggggtatacggttgaagatctcggtgacattccgatcaatcgcgaaaaaatcaaaaatgacgaggaactgaaaaacctgaattccgttttggcgggaaatgaaaaactcgcgcaaaaggtcaacaaagtcattgaagagaaaaaattcccgcttgtcctgggcggtgaccacagtattgcgatcggcacgcttgcaggcacagcgaagcattacgataatctcggcgtcatctggtatgacgcgcacggcgatttgaatacacttgaaacttcaccatcgggcaatattcacggcatgccgctcgcggtcagcctaggcattggccacgagtcactggttaaccttgaaggctacgcgcctaaaatcaaaccggaaaacgtcgtcatcattggcgcccggtcacttgatgaaggggagcgcaagtacattaaggaaagcggcatgaaggtgtacacaatgcacgaaatcgatcgtcttggcatgacaaaggtcattgaagaaacccttgattatttatcagcatgtgatggcgtccatctgagccttgatctggacggacttgatccgaacgacgcaccgggtgtcggaacccctgtcgtcggcggcatcagctaccgggagagccatttggctatggaaatgctgtatgacgcaggcatcattacctcagccgaattcgttgaggttaacccgatccttgatcacaaaaacaaaacgggcaaaacagcagtagagctcgtagaatccctgttagggaagaagctgctgtaataagaaaacccccgcacccgcgggggtttcagcgtgtcgacaaaccctcgcattcgttgtcaggcctgcgcttcggtgctcacgaattccaaacattcgctgcgctccaatgctcgttcttcctagacttcaagggttttcaatcacgctgaaaagatgaaagaatcctaaaactacaaaccgttttaggattctttcgttaaattgaacccccgcatcccgcgggggtttttcatttatccaatcattttctcagcgactttcatttcctgtgagtgggtttgatggtccgcaataaaccaacctgataaaatcaccgctgcgacgcctgcgccaatcagaaatcttttcatttatataacctccgttcgtttaatcagttcttcaatctgtaatgcttcataaaaaaagtgggcagcttctttgtaaagctcaagttccctataccgttcgccagccaaaatggaaagttctcttacactgtcatactctttctcggacaacaagtcatccatatgttgtttgcataagtgaaacgtttccgcatgacccccttctgcataaatggcatataaaatgtctatttttgcctcacatattctattcggctcagcagtcaatttttccttcacgtcttggtaataagataaggcctgttctttctttttgatcttaaacagctctcgtatcagcaagtaggcagaatgataataataggcggagcgggcatactcatcgttctgtagagcctcctctaatttcgaaaccgcttcttctgatttgccgctttgcgcatgtagaaggccgaagttatgcaaaagctgggcttcaaaaaaatgatcctctaattcactcgtgatccgaattgcttcgtccaaataagcctcagcttcttcaaactggctcatctctgtaaaattgcctgacatggtaatcagggctgaagccagcttctttttataatctgtctcttctctgaatgttttgactgcttgccgtgtatgattgagggacacaatattttgtcccagcttataatagagcttaccgaccttcaggtgaaattcggctttttcaatcggatcgggaatgttgtcgagatactgctctgcatctttatacagcccaatggcaatgtcataattatttttataggcctcatacatgccttcaaacagaaaaaagtaatatttcagcatgtcagacgtagcattcatatgagaaggctcctcatgctgaaagccctgtcctctcgcctcgtgaagcaaaaccttgtggcgcagttccaataaggagaagtaggcaagcacctcctgatcctcttccatgtcatccaataaaggcttcacttcttcaaataaacgggaggattcttcaacttcatgtttcttgatggcaaggtaccaatcgttgagcatgctagcgatttctgcgggtgcgatcttattcatgtgaaactcctttctctagtgacttatcaatctcagttgcttattctgatagtaacacctctttctattttatgtaaaatcctctagtcaatatatgaaggagagatgatatgacaattatgctaacccctatgcagacagaagaatttcggtcttatctcacgtacacaacaaagcattacgcggaagaaaaggtaaaagcgggaacatggctgcctgaagatgcccagcttttgtctaagcaggtgtttactgatctgcttccgagagggctcgaaacaccccatcaccatttgtggagcctcaagctgaatgaaaaggatatcgttggctggctctggatacatgctgaaccggagcatccgcagcaggaagcgtttatttatgatttcgggttatatgaaccgtatcggggaaagggctacgcaaagcaagcattggcggcattagatcaagcggcacgcagtatgggaatccgcaagctgtcccttcatgtctttgcccataatcagacggctcgaaagctatatgagcaaaccggatttcaagaaacagacgtagtgatgagcaagaagctttaacgaaaagggcctgataaaggcctttttctgtaaacgatttctaaaaattctgtaaataacctagttactttccttattttcctaatataatgtgggtgaggaaattacctttcctacactcacaagaaaagaggagatgtaatgaagttgaagaaacgagtgtcgatgtttttggtagcgctcacaatgtgcggcggcctgtttgttactcccgccaaagccgtaaagaccacaaattatgctgaagaaatcgccgcactgcagccaggcacgacaccggaagaaatcatgaaatctgccagccagattgccaaacagcagcacgtaaagcaggacgttatcctaaaacagttctataaggagatcacggctgataaagcagagggggaccggctcgccaaggaaagcggcatgtctatcatgggcggctcgtccggcacgaaaaaactcccgacaagcgcgaaaggcaatatctattacacgaactcctacacagcctactacaatcacggccatgtcggcatgtactccgccgctgacaaaattgttgaatctgtcccgagcgacggcgtcaggcagatcgcgtataatgccagagacgtggaagacaactccattgtgcaaaccgtcagcgtatcctcatctcaaaaaacagctgctgccgactgggcggtatcaaaagtcggcgacccatactcatttaacttcgtcaataacagaaataccggccatgacggcgccaaaaactgttcaaagctcctatggtctgcctttttgctgaaagcagggattgatatagacagcaacggaggcttaggcgtgtatccgcgcgacatcactagttcttcttatacgacaaccattatgaccatttactaaggagaaggctatgaaaaagtggatgattaccatcgccatgctgattctcgcaggaatcgcactatttgtcttcatttctcctctcaaaagccataaaaccgtgagtcagcaggatctcagaaatcccgatttcctggatgacaaagaagtcctgctgtatttctcatcctctgcggatcaagatgcatttggcggcgggaaaagctacgccctgtttatcagccatgacgggacgctgtcttcctttcagatgaagggccttgagctgggctcagcaaaggttcacggtgacagcgtgatgctggaggacaaaaacacgatttatacgatcaaaaacggcctgcgctcccataaaagaacctatcagcacacaggcgacagcgcgggctttctgcaaaacacggacggcttttacaccttatacaactccggctacgacaaaaagggagacggataccgctcagagctgtaccgccaaatggacggagagtggaaaaaagacgtcatcccctactacatccgagcctccggtttccatgatggcgccatttacgcactcgtcccgacagatgacggaaaaggctatcagctccttcagattcaagcagatcagaagaagcttacctatctcagcataacggaatggcagtaccgggaaggagcctcagtcgaatcccaacttgccgtggacgaccaagctgtgtatgttatggttcgcggccaaaaagcccacgatctctatcaaatggtcaagatcaacaaaaaaagcggcgaagtagagctgcacgatatcgccgaatacaaaaacgacgaacaaacgatatacagctccatgcccttcagctttaaaaacagctttttcccttatgacgggaacctgtatttcattgacggcttcggaaaggtacacaaaatcgatgccaagacaggaaaaacaagcatcgtcttcaccctttccccggacaaaatgaaagccgaattcaaagaaatcacccaaaaaggcagcagcctctatttcttcacatacacgtatcacaagcctgcctacattgaacagtacagcctgaaaaccggaaagaaaatgaaagaaaaagagattgggaaggtaaaggatgtcgtgacgccgaagagtcatttgaagctgtatgatgttgaggtgatgaagaggttttaaggcaaggagggtagtatgggagccatcgccgttttatttatcgtttttggttttccgatcgtcgcaggtgtatttggtatagcgggtcattttttatttaaaagattttgggtggcaccgctcatcgttcttatcacgagcttgatattgttagttacgttagcttcggggaatagctcattcatattttgggttgttatgtatacggcaattgcgttagtaacgagtgttgccacattatttctcaggaaattttttgagtgatctctgtttatgaagagactggtgtgaagtctctttttttgttgaaccgaagtttgcagaggattttgggtatggtttagaaacgaatccaaaggaggaattacatgcagacaaatcgggttattcttctggcagttatgatctgcctggtttcggccattactgtgttcttgttaaatggatgtaaagtcgacttcttagacatcggcggaaccattattggatgctttcttggcatatttgttgttgtaagaatacagaaaaaacagtcgtgaaaaagggaaagagtcatgccgaaccgaagtcatgttcaaggacggagagtccaaacacatgaatgggaggaatggcgttgacaggaaacaaagcggttgtgtacaaaggcaaagggactgtagcggtggaggatatcggttatccggagttaatcttgagggacgggcccggcgtcccgaaggcgaatgtgaatcgaaaatgtgagcatggggttattctcaaagtcattacaaccaacatttgcggaagcgaccagcatatggtcagaggccgcacaacggcgccagaaggcttggtgctcgggcatgaaattacgggagaagtcattgaaacggggcgtgatgttgaatttatcaaaaaaggagatatcgtatccgttcctttcaatattgcctgcggacgctgtgtgatgtgcaaaacgcagaaaacgcatgtgtgcctgaatgtcaatccggaccggccgggatcggcttacggctacgtcgatatgggcggctgggtcggcggccagtctgaatatgtcatggtgccatacgctgattttcagcttttggtattccctgataaagaacaggcgctagaaaagattctcgatttgaccatgctgtccgacatttttccgaccggcttccatggagcttatacagcgggcgtgcaaacaggttcaaccgtttatatcgctggagcgggtcctgtcggcttggcagctgcacactccgctcagctcctaggcgcctctaccgtgattgtcggcgatctgaacgaagacaggctggcacaggccagaagcttcggctgtgaaacggtcaacgtgcaaaaacacgaccgcctcggcgagcaaattgaacaaatactaggtgaaccaaccgttgatgctgcagtggactgtgtcggctttgaagcatctgggcacggcaatcaaggagaagcgccagccgccgtgctgaactcaatcatggacgtcacccaggtcggaggcagccttggcattccaggcttatacgtgaccgaagatcccggtgcaaaggatgcggacgccaaaacaggctcattaaaaatccgcttcggactcggctgggccaaagcccacaccttcgtcaccggacaaacgcccgccatgacatacaaccgcaatttgatgaaagcgatcctgagcggcagagcgcagatcgcaaaagccgtcaatgccaccgttatttctctggacgacgcgccaaaaggctacagcgacttcgacaaaggcgcagccaaaaaattcgtcatcgacccgcatgggacattgaagtaaaagaaaaagccggacgttctcagaacgccggctttattgctggtaatccgtttcttcaaagcgatctcctgtttcgtcttgaacaattaaatccccttcaattttgtccagtccaatcaaaataaaagggtttttctcatttgccgtaggagcaggttttcgctccacagttacaatcgtttctttagatgagaatttgacgtccgacacttcaagcttcttatctttctcgctgcttccgagagacacgacgaccatttttttgccttctgatatggtgaagacttgatatcctttcacgtcatcatgcatttggagataattagcgtatatttctaagtctggactgccttcaccgattcgatccttctccaacacccaataagatggctgacactcagcaagcagcaacataatcacaaaaagccaaacccatctaaagcgcaaatgcagacctccccacacatcggttacatccaaactaacacacgagcgaaatagagtcatcaacagcttgtttgtcgaattgtggataaaactcagcccgaagcactactaacatgtgaataaataggttatattgagaagagaacatttgtaaaaatggaagaaaacatcggaggatttgaacatgaaacaagcgtattattcttgtgaagaacacatcgaaacggtgctggatatgtacatagacgaccacgagctgccgcccgaaatcagaaaaatcgaacatactaacagtttatccacagcctgtgaattatgtggagaccccgcagtatatatagtggggaacgaatgatcttacacaaaatacagaaaagatatccacaattgtggacaacatatatgaataacttgtttttaaagtggggatgacctgtgaatatcaatattgtgacaatcggaaaactaaaagaaaaatacctcaagcaaggcattgaagaatacaccaaacgactttcggcctacgcaaaaatcgacatcatcgaactcccggacgaaaaagcgccggaaaacctaagcgaccaggacatgaaaatcataaaagacaaagaaggcgaccgcatcctatccaaaatcagccccgacgcccacgtcatcgccctcgccatcgaaggaaaaatgaaaacatccgaagaactagccgatacaatagataagctggctacttatggaaaaagcaaagtcaccttcgtcatcggcggatcactcggattgagtgacacggtgatgaagcgagcggacgagaagctatcgttctcgaagatgacatttcctcatcagttgatgcggcttattttagtggagcagatttatcgggcttttcggattaatcgtggggagccttatcataagtaagagcatctccaccattacagaaagactaaagttcaactaaaagctatttaatggaataattcaatgaatataatatttcagcaaccaatgcaatgtttgacttaaatacaatactaaaatgagtaaagagttatgtttaggttataatttatttgatggtgtggaaagagtcttaatatattaaagagtaaagatgatatagaataaaaagttttctagaaatatataggggataaatatacttatgagaggatgtttgtattgaaggtacgttttttacaaatttctgatttgcattttcagtttcaaaattatgacactattgtaatgagagataaattattagattttatagaagttttaagaagagagtcagattttgattttttattattaactggagatatagcacacaaaggtgatgtgtataacgaagatgttaaagaatatcttaatggaattattaaaagtatgggattaagtaagaataacgtacacttagtgccaggaaatcacgatatatctagagacatgacgaggacacttttgattgatagtattatgaaatctcctaacccctcagaaatgttggataaactagatcaaaaagctacaaatatattagtggaaggtcaaaggaaatttttcgatttttatgaagattttatgggtgttaaatatccggaagaagatttgcattttttgtatcaatcggagaagtataatgttttatcaataaatacatgtctgttatcagataaaaaaggtgaagaaggaacgttattaactgcacagatgaaattatataaagcaataaggaagatgaacaaagagaaaaataagggcaaggtattaaatatagctattgggcaccatacgttaggttgtattgaatcttccgaaagagaatcaataaaggcacattttgatgattactttattgatctatatttggcaggacatgtacatgattcttcatttaatattactgcaaatacaaatgaaaatccattcttagaattagtaagtggagccattataaaggatgagtatgctactccagaatttatttcggtggatgtgaatttagataatggcgagacagaagtaacatactacatttggaataccgaatataaatactggtcaaaaaacaaccaaggaggaaggagactacaggaagggaagttaaattataagattaatagattagagagccttattgaaaaagaaatagaagataacgatgataaaattgatgaagatgagtttaagagctttattatagattttcatgagtatagagaaagttataaaacatttactagtaattttgataatcaaattggtttagataaaaaattttatgatatgaaaagtggggaaacttttaaacggaaattcgatagttattctgagtattttggtgtgataaaccatataatggattccacttcgtatgtaagtgctgataaaaaggaattgattgctgagacgatagtagacaaatatctagagtttcataatcaatataataatggagatgagatatttgtaaaaattgttaatgagatttatctagaatgtcattcagttttaccatattcaaaggctttaacgaaaaaatacattaagattttaacatgttggtgcatttatgaatgtgagatttttaatgataacaaaagaagtgttaagaatgattgatcttaaaattgaaacagctgaaaatattctcaaatactcttatgttttattagaaaatgagtttaaaaacattcaaattggaaatgatcttattcctctagtgaataattctcctttaaaaaaggaaaaggcggagaggccagaaatgaatcattttttattaactaaatataatgctgtggaagaaaatattttatactcatcaaagatactttatgaactgttagagaaggaaaaacatattgatcaactttttcttgattatgctaagagtcaaggtattataataaatttgaatattgaacggatactgtatttatcgttaacttttttatattcattaggtaaagtttcttttaatcaaaatatgattagcagaacggagagttagtgattgttatgattataaaaaatctttttgtttgcaattcccaagaaattttgaaagagtataaatttaatgctgtaggagtaaatataatacttggtgaaaagagagaagatcatgaagagactaatggtgtaggtaagtcaacgatgattgaatgcatctcctttttactagggaagactatatcaaatttttatacgacaaatgaaattcttctcaataaaaacgtttttattgttttgaatgtggaaattgatggaaatcaagtattccttgctagatcttttaattctcctaaacatggttatacattacatgatacttctttaacttttaatttggaggaatggaaaaaagttagtataagtgtatataaaaaatttattgaaaaggaaattttaaagggtgagaaagaggatataacttttgcggcgttaagggagtatattataagagacgaaaagacagggtttaatgatatagttttaccgaataggggagggttaaaacaatataaattacttaactatctttttactttaccaactcatacagaaaaaacataaaggtttttcgggataagattgaaaaattaaatagtgaaataaaattgattgaatcaatgaatattaacattggcgatttaaaagttaaggaagatgaattaataaatgagatagaggattacaatagagttatctatcaaactaagactgccaataaatataataatgatacaaataggtactcagaaattaaaagtgaacttaataaaatacaaaatgaaatatttgaaaatgaacatatttgtaaacaatatcaaagaaatatagatgatttaaataaaaaagtaactaagattaaagaattagaaaatatagaaaaattctatgaagatattgtaggtttttttccagaggaagtaaaacagaattataataaagtccaagagttctataatttcatggtagaaagtagagggagttattttaaagataaaattgttaaaatacaagccgatttaaaaaaacttaatatcaaaaagcaaggattaacagaacaactggaatcaagtgccagaattttaaagagtaacaatttcattgaggatatttccattgtgatggaagaacaaagaaggaaagaaatagagttagcggaagtaagattgagaattagtgactacgataaaaaaaaccatatttttgataagattaatgaacttcaacatgaaatattaagagttaattcaatgtattatgatgagtttcaatcttatagcgctatagttagtgagttaaagaagctttttaataatctaatggatgttacatacaaccaacatggatttttagattttgaatatgataatagaataagtaacgcaaaacaatcaactacaggaaggatcaaaatttcttgttctataccggatgaacgttcacatggtagactccatatgaagataaatatatttgatcttacttggtttttatacaggtgtataaataagtgtagtttgaatattttaattcatgacggatcttattctaatcctgatcctcatgtaaaaggtacattattaaaacatatcaattcaagtctgttagagaataggatcggacaatattttgtaacaataaataaaaatgaattattattagatgaccttcaagaattagagtcgaaaggtatgattgttgcaaaattagatagaaacaatgaagataaaaatagattttttggttttagattttgaccaaataatattaaactagggagttcttatagaacttccttttaacctgttttaaaaattcccataatgtcaagggtgtttaaattcagtatataatgaaacaccgtaataacttaacctataacagagtgataaaatagaacttatgtcttttcttattctttcactagaaaaaatctagtactttgaatgttgaaaaaggtccaccctagcgagagttatatagaatggactttttttgagtgcatttttttacggttatgtctactaatgagtgccataatagagggagaatatagaacggctatatcgtgcatgttctccattgataattgtttcagtgtaataccatattatttcgcaacctctttctccgaatcattacccaattacattctataagtattagtatttcttccttgtagtataattgtccagccatgaaaaaactccccaaggcaaacagattttctaaaattcatctatctacttttaggggagcagcatatcaccatccctgaaccccacacccctcacttcatataccgatactcccgcaaactctctaaaatcgcaacttcctgcaacaattcctcacccacattcgtttccttcactttcttccgctcaagctctttgtccactaatcgtttgaccgttaagacgtcggttccggtgcttaggacttctgccttggaattgaagtgtttatgggcgacgagctgcatgccgtaggagttgtatagcagcgtgtagccggcgatgcctgttgtggattggtaggctttggagaagccgccgtcgatgacgatcatttttccgtttgctttgattgggtcttctccttcgatttcttttacaggtgtatggccgttgatgatatggccgtgatctggattgaggccgaattctgccaggatgtttcggcaggttgcctcgtcttctcgtaaataataatacgggtttttcttctctttatgcgtttccttctctttgatgaaatagcgctcaaatgtcgtcatggcgcgttttccgaagagggaggagtattcgcctgtccataaataccaagccatatctgtcgccaggtcatcggtttcttccgggtgggcaaaggcttcccgcaagaatcgttcaaatacatcgagcagctcacggcccgcatacggtttatcctcaatcatcatcgtttccatattgccgttttcatcaactggaatacagccgtgaatcaacaggttgccgttatattttaaataaaggctgccttttttcatcataaaattcatatggcggcccagcttttcggaatgctggacagagaatagcagcttgtctatgacttctgcttcttcttctaatagctgatctggctgctccggattaatcgtcgcaaagcaggtgttttccagttgatatgtttttccgttcagcgtgatttcatttttgtcatagtctattttctctaataacagccgctcttccatattaaagttcggccgtctcttgataatcgggctctcaagcttgaattggatcatggcaatcgcttgatggatttttgtgatttgcttaatctcatcctctggcctgttttcgtctgcttttggacggaacgctggattatcatcataatatttttcggccaggttcagcagcggtctcaggttgatgccgtacacgtcctcaataatatccaggttgtcgtagcgggcacagatgcggataatattggccaggcacactttggaaccggaataggcgccgatccaaaggacatcgtgatttccccactgaatatcgacagaatgatagttgatcagttcttccataattctatccggctgcgggccgcggtcataaatatcgccgaccacatgcagatggtcgaccaccaatcgctgaacgctgtaagcaaggccggtgatcagcttatcggcttggccaagttcaatgatctgatcaatgatttcggagtaatattgctccttgttgccagcttgttctgttttgtataacagctcctccgtaatataagcaaattgggcaggcagtgctttgcgtaatttggagcgggtatacttagaggagcaatatgaaacgagcttaatcattcgatgaatcgtttctttataccactcgtttaacgcttctttcgcatcaaagtcatgtttgattaatttcagtttgtcttccggataatagaccaatgctgctaattcatcaatttctctatcgtaaatgacaccgctgaagatgtcgcgtatcttctctttgactcgtcctgaaccattgcgcaacacgtgctggaatgcctgatactctccgtgcagatcactgacaaaatgctcggtgccttttggcaggttcaatatcgctttcaaattgatgatttctgttaccactttttcttcacaatcgtatttttgtgcgagtagatctaggtacttgctttccaaaaccgtccatcccctttttagaataaacccctctttatgagcatgtgcatgataaggtgaatttaaaagtatgacattatttttaaacattggacctttatatgatagtaccgcataactgcttttagagacaattaaaacgagagaaagaggtgccaaatggggtaagcaagagcttaaaacagcttttcagtacaggttggtttagggtaagattgtttgcctcatttcttccacttaaaatctgtatatcccttaactagtgtagtcaatattgatgttttacttttcattacgaagctttaaatcaaactatggcctttcattcggtatagcttagaggggctagaggactataggctttatataccaagaatagtgacatttttcagattttttaggtacaatatattgacatgtattgaatgatatagaataattggtttatattagaaaaggaggagggataatatgaaaaaggaaatcactaacaatgagactgtgaaaaacttagaatttaagggtctattagatgaatcacaaaagttagcaaaagtgaatgatctttggtattttgtaaaatcaaaagaaaatcgctggattcttggaagtggtcattaattagaggggtacaaaggagagtctaactctcctttaccatttgttgggggatatttcatgtataataaaacagtatcaatcaatttagattcaaggtgtaatgcatcctgtgaccattgttgtttttctagttcaccaacttcaacaaccaggatggaaaaagaatacataagagagttagtaactgaatttgcaaaaaacaaaaccattcaagtgatttcttttacaggtggggaagtttttttagattataaatttttaaaagaactaatggaaatcattaaaccatatgaaaaacaaataacgttgatctctaatggattttggggtttgagcaagaaaaaggtccaggagtactttcatgatatgaattctttaaatgtgatagcactgactataagttatgatgagtaccatgctccatttgtcaagtcttccagtattaaaaacatattagaacatagcaggaaataccctgatatcgatatttctcttaatatggcagttaccaaagacaaaatgtccaaccacattttagaggaattgggggattcaatcttaggtgtaaagataacaaaatttccaatgatatcagttggcgctgctaaaactagaattaagcaagaaaacatacataaattttacagtcttgaagatgaagattccttacattgtcccggatatgacattgtatatcatcatgatggagaaatttatccatgttgttcccctgctatttttgaaacgaaaataaccctaagggaagaatataaccaaagtttcgaaagaaccgtggaaaagttaaattccaatttgctattatttattcttagaaaagaaggattcaaatggtttttgaatattttaaaagaaaataacaaaatagaggaatttgacattccttatgaattttcctctatttgtggagtttgtggttccttattcaactctgcagaaaaaataaactacttctatccttatatggaaaaatactataatgaaaattttaaagtatgaagatgaaaaatatgaagtgcttgtgcaaaacaacgtatttataaaagacaaaaaaagcggagaatactataaaaatagtttaaattctctgtcagataaacaattattacgttttaaaatgtataaagagaaagtatcaccaaagtttttttatctgttcttatcctttacggctctcatgttcatattaaattatattcatttaataaaattgcaaaatggattgtcctcagtattttacggctggaaaatgtggataattatagttatttattttataatgaatatagtgcttcatgaactgggacatatttattccttaaaatttttcgggaaaaactttgataaagtgggattcaaactgaatttttatgtatttcctgctttttatgtccaattgaatgaaacctacatgctatcaagaaatgaaaagataatcgttcatttatttggcttgtttatcaattatcttttaataaatacattagaattaataaatcaatttacattttccagtgaagcattaactatggcatttatgcttttctcgtctactttattgtggaacttaatcccaatattgaattctgatggttacaaaattcttttagcttttctgagcttagatgaatatagccgttttaagacaaatcattggttagttcttacgattcaaattatagggattggccttgcagtgaattcagttgtacattggatattatatattgtaaactagagtaaaagatctccaaattagccatctaaaaacatttctttcgcttccggatcggaaacgaaagaggtacctcaaaagcttagacattagtaacaaatcacaaggcagaacattttattattatgcaaatatttcctaggagtatgtatatgaatatagcgaattacactttaaaagtgaaaggcaaaacgttacttcaggacaccgacttgcatttttcgagcgggaaaattaatcacgttgtcggaaaaaatggagtcggtaaatcacagcttgctaaagactttttgttgaataatagcaaaagaatcggcagagatattcgtcaaaatgtttctttaatatccagctcgtcgaatatacctaatgatgtttctaaggactttttattacactttttgagtaaaaaatttgatgcaaaaatgatagataaaatcgcatatttacttaatctggataatattgatggaaaagttctgatcaaaaatttgagtgatggacaaaagcaaaaattaaaattgctcagtttcttattagaggataaaaatattattgttttagatgaaataacgaattcattagacaaaaaaacggttatagagattcatggcttcttaaacaagtatattcaggagaaccccgagaagattatcatcaacattacacatgatttgtctgatttaaaggcgatagaaggggattattatatatttaatcaccaagaaattcaacaatatcattcagtggataaattaattgaagtgtatataaatgagtaataaaacagtgggggcttgagatgaaattagagtttaaaaagagtattagcaacaaagttatcattattttaggagcaatgtttgtatttttatttttgctgggttattttttacttgttggaatcgataaagtcagtaatgttacacctgaaatgtttttctttagctcctatactgttgcgacccagtttggtttgatgttattttcatttgttatagctttctttattaatagagagtattcaaacaaaaatattctcttttacaagttaattggagagaacatctatactttcttttataaaaagatagctgttttatttttagaatgttttgcatttataacgctaggcctgctaatcatatcgttgatgtaccatgatttttcgcattttgcattattactttttttattttctgcagttatactgcagtatattctaattatcggaactataagcgtgttatgtcctaatatattaattagtataggtgtcagtatcgtttattggatgacttctgttatcttagtagctataagcaataaaacgtttggtttcattgctccttttgaggcaggtaacactatgtacccccgaatagaaagagtgctgcaatctgataacatgacacttgggagtaatgatgttttatttattattttgtatttagtttcaattattatcataaatgcgattgtccttcgcttttctaaaactagatggatcaaaatgggcctttaataaagggagctacttcacaatgaagtagctttttatgtgcacctatatatcattaacatcaagattaatgcatgtgactggctgagtttgttaagggaaggatgtttttctgtttgcatcgcccaaactattattgtttttctttcaccatctttacaaagaggaaaaagataatgaatacgataaagtagttcattggattcttaacgatgctcatctctagtgaaatctgtaagagtatccagagcgcaaagatggctagtatggcaggaatgataattttgtacatgtcgaccacctaccgtagtgaagagccctataataaaaaactattagcctgtaccacaaactgcgactgctcataattatacgaaatcttcgagtaatcaaacggctgcccatttgtcaggtgaaaaatactttctatatacagcttcggcagtccagcctctaatcccaaatattccgcttcttcctcattaagctggcccacgtgcagaaacaaatcagaaaaaccaatcttcaaccccagtccttcccggatgtaatggaagatggagtgggagacgatttcgttgtttaaatacgtcacgatggatttggtgtaataggattcttcgtagcaaagggtctggccgttgatgtagcggacccttttgacatagtagatgtcctcgtccattccgatgttcaggttttccgccgcttccggtgttggctttctcacgtccagttcgatgacttttgaggtgacgttgaaatcctcgagatcttttttaaatccctgattcgacagaaggctgatatagccttttcgtttatgttttctgacgaaaatgccgcttcctctgacctgaaagatcgcgcctttttgctctaatagctcgagggactttgtgatggtgcttttgctgacttcaaactgggccatgagggtttctaggactggcagtttgtctccctgctgaagctggtgttcttctatatatgtttcaatttccgttgcgatttgctggtattttaacatacgcattcctcatttattcgtttagtttcacttgtcaaaattatagcataaaccgcttacaatgatagttagtgcgtaaatattttgtttcggaattgataaattataccgttacaattataatgaaagcgtaaccaaaacgaaggggtgggtgaaatgtcggggaaagtgagagattatacgagactagcaaaagacattttagaggccgtaggcggggaagagaatgtgattggggcttctcgctgcgctaccagacttcgattggtgctgaagcggtctacccctaaagcgaaggatatcgtgaaatcgatgctaccatcccggcgtcattacggttgtcatggttacgcctacaaagcatgcgattggcctgcgttcagcgtccggcgtcgaattgcttgcgcacatcgggctggatacggtgacatttgacggcacgcctttttccttgaaggtaaaagaaggcgataccgtcaaaaaaggcgaagtgcttgttgagtttgataaagctttcattgaagacattgaggaaagtgcattacatcaaaaaatatttacagtcgtaagctgaggaggaattaaacatgggaaacatgccaaaggattttttatggggcggtgctttagctgcccaccaatttgaaggcggatggaatcaaggcggtaaagggccgagtgtcgtcgatgtgatgacagcgggtgcgcacggcgtgccgagaaaaatcactgacacgattgaagaaaacgaattttatccaaaccatgaagccattgatttctatcacagatacaaggaagatatcgctttgtttgcggaaatgggattaaaatgtctgcggacgtccatcggctggagccggatttttccgaaaggcgatgaggctgaaccgaacgaagctggtttgcagttttatgatgatgtgtttgatgaattgctgaagcatgggatcgagccggtcattaccctgtctcactttgaaatgccgctgcacctggcaagagaatatggcggcttcagaaaccggaaagtcgtggacttcttcgtcaacttcgcagaggcttgctttacccgttacaaagataaagtgaagtactggatgacatttaacgagattaacaaccaaatggatgtgaacaatccgctgttcctatggacgaattcaggtgttgtggttggcgaaaacgaaaacgccaaggaagtcatgtatcaaacggcgcaccatgaattagtggcgagcgccttagcagtggcaaaaggaaaagacatcaatccagagttccagattggggccatggtatcacacgtgccgatttatcctttctcctccaatcctgaagatgtgatgctggctgaagaagaaatgaggcagcgctatttcttccctgatgtgcaggttcgcggttattatccaagctacgcgttgaaggaatttgaacgcgaaggctacaacatcacattcgaagacggcgatgatgagattttaagaaacggaaccgtcgattacttaggcttcagctattacatgtcaacaactgtgaaaagcgatgtgaaaaatgataacactggcgatattgtaaatggcggcttgccgaatggtgtcgaaaatccgtacatcacttcgagtgactggggatgggcgattgatccaaccgggttgagatatacgttaaatcgtttttatgaccgataccaaatcccgttattcatcgttgaaaatggctttggcgcagtggatacgctggaggaggacggcaaggttcatgatccggaacgcattcaatatttaaaatcgcatattgaagcattgaaaaaagcggtcacgtacgatggtgttgatttaattggctacacgccgtggggcattattgatattgtctccttcacaactggcgaaatgaaaaaacgctacggcatgatctatgttgatcgtgacaatgaaggaaacggatccatgaaacgatataagaaagactcctttgagtggtataaaaatgtcattcaaacgaatggtgaggaactataagaagcgctcgaatcgagcacttttaccgtagtgcctggttcggtttttttctgtagaaaaagaaaaatccgctatcctgccaatctggcaatatagcggatttcttatattagttacggattaggtaatcaaacgcgccgagggcggcagttgcacctgatcccatagaaataataatttggttgtacgcactgtctgtgcagtcgccggcagcaaataagcctggtacgcttgttgcgccgtgtttgtcgacaataatttcgcccatgcggttgcgttcaaccgttccttctaaccattctgtgtttggcacgagaccgatttggacgaatacaccttgaagttcaacgtgtttttcttcgcctgtttcgcggtctacatatgtgatgccgttaacactctgatcacctgtgatttcttttgtttgtgcgtttttcacgacagtaacgttaggcaggctgtagagacgtttttgcaggacttcgtctgctttcagttccggcgcgaattctagtacagtaacgtgattgacaatacctgcaagatcaatcgctgcttcgataccagagtttccgccgccgattaccgcaacgtctttgccttcaaacaatggcccatcacagtgcgggcagtatgcgacacctttgtttttgaactcttgttcaccggggacgttgacattgcgccagcgtgcacctgttgaaaggatcactgttttacttttcaggacagcgccgttttcgagttcaagttcgaacagatctttcttctcaaggcgtttcgcacgctgaaggttcatgacatcaatatcatattccttcacatgctcttcaagacttgccgctagcttcggtccttccgtcgctttgacgctgatgaagttttcgatgctcatggtgtcgagaacctgtccgccgaagcgctcagcgacaacaccagttcggatgcctttacgtgcagtgtagatcgctgcacttgcaccagcaggtccgcctccgaccacaagaacgtcaaacggctctttgtcagcaaactcagatgcatctgtgccgctgcccattttcgcaagaatttcttcaagcgtcatacggccgcttccgaaggattcgccattcaggtaaacggtcggcactgccatgatgtttttgctttcaacttctgctttgtatgctgcaccgtcaatcatcgtgtgcgtaatgttcgggttcagcacgctcatcatgtttaaagcttgtacaacatcaggacagttgtggcatgtcaggctgatataagattcgaagtggtattcaccactgatcttcttcacctgatcaatgactttttggtctaccttaggcggtctgccgctcacttggagcaacgccaacactaatgatgtgaattcgtggcccagagggataccggcgaaagtcacgccagtgtcttctccgacacgattgacactgaagctcggcgttctgtttaattcagctttttcaactgaaattttcgatgacatggaagccagctcatcaacgagagccagcatgtccttagaagtgtcatcttcgcctgcgctaactttgagaacaatgtcattctcaattagctgcatatattgatttaattgtgctttgatatttgcatcaagtaccaattgaatgcactccttagattttacctactagatcaaggctaggtgtaagagtttcgccgccttcttcccatttagccgggcaaacttcacctgggttttgacgaacgtattgagctgcttttactttgtttacaaggttgcttgcgtcacggccgataccgcctgcattgatttcaacagtttggataacgccgtctggatcgatgatgaatgttccgcggtcagcaaggccagtttcttcgtcaagaacatcgaagttgcgagagatcgtttgagatgggtcaccgatcattgcgtaagtgattttgctgattttttcagagctgtcatgccagcctttgtgtacgaagtgagtatctgtagaaacagagtatacttcaacacctaattctttaagtgcagcatattgttcttgaagatcttcaagctcagttgggcatacgaaagagaaatctgctgggtagaagcagaatacgctccattggcctttcaaatcttcgtttgttacatcgatgaattcaccgtttttgaatgcttttgcttcgaatggaagtacttctttaccgattaaagacataatgtatattcctcctaaaaatgtattagaaagcataatcgctttcaataataattctaattatatatgaattattaattaatatatattttttgtcaagccataacctactttttttcatcttaataaaggtgtgacaggtaggatttaggcatttcttttataataaatgagaggctgattctcaattagataaggttttcagggacttttgtaaatcagaatgccaggccgttttggcatttgaacattttatgacaccatggtcaagggcaaaggacaatggccaaaagcagaatagaacggaacagcaatctgctgtcacatgatgatcttggggattgtttctagctattattgtatcactgtttatgatatttaaaacataacttatgtcttctgttgtttgggatagaagaaaaaaacacggttcagttgaaactgaccgtgtttttaatacaggttattcagaccaattcgtatggaagacgccgtccatatcagtccgttcgtacgtgtgagcgccaaagtaatcgcgctgtgcctgcaagaggttcgcattggaacgccctgtgcggtagccgtcgtaataagagagcgcggtagttaagcatgggaaagagattccggtgctgataccctcgcaaacgacttttcgcaggcctgtttgataggcatggagcttatctgtgaaataaggcgcgatcagcaggttagccagatttggctgctcactgaatgcttcgctgatcacgtttaggaaatcagcgcggatgatgcagccgcctcggaaaatcaaggcgatgtctttgagcggcagattccagccgtaaagctcagatgacatcttatattgggcaaagccttgtgcataggcgcatactttccccatgtaaagagcctgtctgacgtattcaatccaagtgtctttatccaagtgtttttcttcggcttccgggcctgctaatacatcttgagctgccatccgttcttcttttaaagatgacaagtagcgggcgaacaaggactctgtgatgatcgtggacgggatgccgttatcaatcgcctgcatgctcgtccattttccggtgcctttttggccggttttatcaaggatgacatcgatcagaggctgtcctgttttttcgtcttttttgcgtaaaatctcagctgtaatctctattaaatagcttttcagctcaccttgattccatgtttcaaaaatagatgcaatttcatctagcggcagacgaagcgtttctcttagaaacgtataagcttctgcaatcagctgcatgtcggcatattcaatgccgttgtgcaccatttttgtaaagtgccctgccccttttggtccgatatagacacagcaagggtcatctccgacttgggctgcgattttcgtcaggataggagcggctttctcatagacgtcgcgatctccgcccggcatgatggaaggccctgttaacgcaccgacttcaccgccggaaatgccgactcccaggtagccgatccctttttccttcagctcgtcatatcttctttctgtgtcttcatagtgggagtttcctccgtccatgatgacgtcgccttcttcaagcaaaggctttaatgattggatgacggaatctacgggttttcccgctgtgaccatcaaaaagatttttcttggtttttctaacgattgaacaaagtcctcaagctcgtaatacgggctgagagattgtccatccagcttttggataagctggtccgttaaatctctggtgtaattatagacagcgacgttttcgcctttatttgccatgtttaaggcgatgttgcttcccattacgcctaagcctatgacaccaatcgaattgaacatgtgttacagctccttcttaatttcatacaactaaacttaacaataaaatgaatcccagtccagcaacggaaataatggtttccagcaatgtccatgtggcgaatgtttctttcatgcttaatccgaagtattccttgaacatccagaagccggcgtcattgacgtgtgaagcgatgacacttccggctcctgttgcgagtacgactaacgccaggttaacatcagaatggcccaataacggaatgaccagacctgttgtgcttagtgcggcaacagtcgccgatcctagagaaatgcgcaggatcgctgcgatgagccatgccagaatgattggcgataatgccgttcctttgaataagtctgctacgtaatcgccgacaccgccgttgatcagcacttgtttgaaggcgccgcctcctccgatgatcaaaagcatcatgccgatttgtgaaatggcagttgaacaagaatccatcacggttttgactggaatgttgcgcttgatgcccattgtatagactgcgaccaataacgaaataatcatagcagtcgatgcgtttccaatcaatctgataaaagctaaaactccgttatctgcaaacccgattgtttcttgaagcaggtcgataatggtcgcgaccgacatgatgataatcgggagcattgcagtaaagacactgattccaaagccgggtgtttcttcaaggttaaatgttttttgtgtgccgagtgatgcaatattgccgtttttcgcaaatgatgcaggaacgatttttttcgcgaactttgtaaataacggccctgcaatgagcactgtcggaacagcaacgataaagccgtacagcagcacttctccaatgtttgcgccatactcaccggcgatcgccgtaggtcccgggtgcggcggcaggaaaccgtgtgtgacggatagtgccgcgaccatcgggattccgagaaataaaatagaaatcttcaattctcttgaaatcgcaaagacaatcggaattaatagaaccagtcctacttcaaaaaataacgcaatcccaataatgaatgaggcaatgacaacggcccattgaatatttttctcaccgaatttgttgacgagcgtcatcgcaatgcgctgtgcgcctcctgaatccgcgatcagtttgcccagcatcgcaccgagtccgaagatgagcgcgatgtggccaagagtcccccctattcctgcttcgatggagctgacaactttatcgaacggcatcccgagtgccagtgccacgccgaacgatacgaccagcagggaaataaatgtgtttaattttaagcccataatcagaaatagtaatgctaagatcccaagtgcaacgatgattaacggcatggtaatgccctccccttcatgtcatgtactatttgtgtgtgattaagcccctctgataatctgcaatttgtgtatattgattttctaataatcttgatagattgatgaaaatcggcattaatgttctgtattccttggctgagtcttcgatcggcgtatgtctgtatgtgctgccgatcatatcggacacggcgtcgaaagaatcgatttttcctgttgcatacaggcctaaaatgcaggcgccgagacatgagctttcgtagctttccggaacgacaacctctgattcgaagatatccgacatcatttggcgccaaacctccgaccttgcaaaaccccctgtcgcttggatgcgggttaccgggccatccatgcattcagttaacgccaagaacaccgtgtacaggttgtaaatgacgccttccaatgccgcgcgtatcatatgctctttcttatgcgacatggtcaagccgaaaaatgagccgcgtacatccggattccacaacggagcgcgttctccggcgagatatgggtggaacagcagaccgtcagaaccgggtctgacgcgttgggcaattttcgtcagcacgtcatatggatcaatgcccagccgtgtcgctgtttcgatttcggaggaggcaaactcgtctctgatccagcgaaggacgatgcccccattgttcacaggtcccccaataacccaatgcttgtccgtcaaggcatagcaaaaaattctccctttttcatcggtttgcggcttgtcaataatcgtccgaatggcaccgcttgtaccgatggtgacggcgatttcaccctttttaatggcgttgacgccgaggttggacagcacgccgtcgctggcgccgatgacaaaaggcgtttccggatcgattcccatttggatcgctatttccgggctgcagtgctgaaagatctcggttgtcggcacgagtttggataagtgatccggcgtgatgcctgcgatgcgcagtgcctcttcgtcccaatccaagcccttcaggttcatcatgcctgtcgctgatgccaatgagtaatcgatgacatactcattgaacagctgtttaaaaatgtattctttgatgccgatatatttttttgccttggaagcgatttcttttctttcattcgtgatccaggcaattttacttaacggtgccatcggatgaatcggtgttcccgtccgtttgtacacctcatgtccgttcaattcctctttgatcttatgcgcccagccttcacttctgttgtcggcccatgtaatgcatggcgtcagcggcttgtcattttcgtcgattgcaatgacgctgtgcatggcgctgctgaacgaaatgaaagagatccgtttttcgggatgctgttttgtaattctcgctgttgtatggatgactgcctgaaaaatctcttccggattttgttcagctgttgagatgtccggtgtatagagcgggtagccgatgctttctttctgtaccacatctccgttttcactgaacagcacagcttttgtgcttgtcgtgccgatatcgattcctaacatataactagtcattgttgtattcagctccttttgccagcatttgttgtgagagccataggtcttctaccttatcctgcacatcatcaaagttttggtgaagagactgaatcatcagcgccctatcctttgttttgatggcttgaatataaagctcgtggttatctaaaatccttgtgaagtcttcatacttttcctttaaccgtacccgcatcgataaaagaataaagctttccatgacgggttttagattgttccagatcatctgaatgtatgaatgatcaatcgctcggataatcgtttcatggaacagcacatcttgaaatgaaaattcgtcagcatcctcatatttgattgagactttcatcatttcaagaattttgctgagatccttaactaaaggctcaatgtctattttgacaagccgttcaaagacaaatgtttctaatagtaaccgcacatcataaatttccgcgattttcttctcagttaaaccaattacgaccgctcccattcgttctaagcggatgattttttcggatgcgagtatttttagcgcttcgcgaaccggcgaacggcttactgaaaactcggcggcgattgtattttctgataaaatggtaccgctttcaatcagacctgaaacgatccgcattctcagctcgtatgcgacacgaactccggttgacgcttttgagagccattttgcgggatacaacaggtctttggagtctagcatacactcaccttcctcactcaaggagtatacttgtatacaagtatgataacgtgaatatttcttttatgcaaacactttcatttctaatttttatttaaatttttaccatattgcatggtatgtatttccagatcaattatggtacattggagatcaataggttaagtgaatcatgttttgaaagaggcgatttggatgaaaatcatcattgcacctgattcttttaaggaaagcttatcagctctggaggcagccgaagcgatagaaagaggtttcaaatcggtctttccgggtgctgattacagaaaattgccggtggcggatggcggcgagggaaccgttcaatctctggtcgatgcgaccaatggaaggatcatagagcaagttgtcacagggccgctgggggaaccggtgagagctttctttggcatgatgggagatgggagaacagctgtgattgaaatggctgctgcttcagggctgcatctggtgcctgtagataagcgaaatccgctcatcactacaacaaggggaacgggagaattaatcggagcagctcttgatgcgggagcggagcgattgatcatcggaatcggcggaagcgccacgaacgacgggggagccgggatgattcaggcattgggcggaaggcttcttgataactcaggcagcgagattggcccagggggcggcgcgttatctcagcttgcatcaatagatgtgagcgggcttgattccagattgcggaatgtcaaactggaagttgcctgtgacgtggacaatccgttaacaggaccaaagggtgctacggctgttttcgggccgcaaaaaggcgcgacggccgacatgttggatgtactagaccagaacgtaagccatttcgctgatatggcagaaaaagcgctcggatcaaccttccgagatacagagggcgccggtgcagcgggcggtcttggatggagcctgctaacttatcttcaggctgacctgaaaagaggcattgatattgtccttgaagcggttgattttgaaagtatcgttcaggatgcagaccttgtgattaccggcgagggacgaatcgacagccaaacggttcatggaaaaacaccgatcggggtggccaaggccgctaaatcatacgatgtgcccgttatcggcattgcgggatcaatttcccgagacagtaatgccgtctatcaacacggaatcgatgcgcttttcagcatcgtccccggagccgtgccactagaagacgcgtttgaacatgccgcggaatatatggaaagaacggcgcgggacattgcagcgtctatcaaattggcgaaaacgatgtttctgatatagccgatgcacatgccaatgcatagccatccttctttttgggtagagacagttaacacacaatgaggaattcatcccagaaggaggacgcagatatgactgtacaagaaatcaaaggcaaaaaactagtaaaaggcattgcgccaaatgtggagccggaagctctgttaaatgataaacgaaaagtatttttgtttggttcccctagctacacaaacattggcgaccaagcgattgcgtatgcggaagagaaatttatcaaaaatcattttccgtattatgaatacattgagattatggattatgcgacggatgagggcattgaactggtgaaggagatcattcgtgaagacgatattgtctgctttacaggcggagggaatttaggaaacctttatctcgatattgaggaagacagaagaaaggtcttttcggcgtttaaagactacaaatcaatttctctgccacaatccgtttattttgaggatacagaggaaggacagaaggaaaagaaaaaacacaggatgcgtaccatcaaaatacaaacttaacgattgctgcgcgtgagacgcaaacactggatgttgtgaaagagaccttcaactccaatgtgatctttacaccggacatggtgctttccttggatattgtgccgcgagagctcgagcgggacggcgttctctttattttaagagcggataaggagaaagtgactgacgaagattttatttcacagatgaagcaatgggcagaaaaaacaacttacacagagcgtaccgatacggtgctggatacggtagacaccatcgattacgctgatcgtgaaaagcattttatggagatgctggaccgcatcggctccagtaaattggtgattaccgaccgccttcacgcgatgattttctcgattatcaccaaaacaccttgccttgtctttggaaacagctatggcaaagccaaacattcatatcgggattggcttgaaagcttaaacttcattgaatatacggataagaatgatgttgaggagctggagcgtatgattgaccgcctgcttcaagcagaaccgaatgacgttgatttatctaaggactttcagccgttgattgatttttttgcttcttaaacgaaaaagactgccctcccccggggcagtctttctttgttaaatatgaaacagccagacgacgagcgggccgaagaatgagccgagcaccgcacaaagcgtcatggagacggaactcatggatacggccaattccccatattccaacgctttggaggtacccagtgcatgggaggcgctgcctaatgcaatgccttgtcctagggagctgcgtatgcgaagccattttaggaaaagcggcccgaggatgacgcctgaaaagcccgcaatcatgacaaatacgactgtcatggaagggacgccgccaagaccggcggcgatctgaatagcgacaggggttgtgatcgattttggcagaatggataataagagatcatgatcaatcccgaatgcttctgcgaagatcagcccgctgatcattcccatgcataagccgaccaggacgccgcctaaaatgggaacacaatgtttgacaatgatatgccattgcttataaagcggataggccagcgccacaacagccggcccaagcaaagaattgatccatttccccccgatcatatagccttcataggaaacatgaaacatcatcaaagccgctacaatcaaaattgtcgttgtcagaacagggatcagaaatggaagcgggaatcgcttatagagtttgaccatcgctaaataagcggcaactgttaaaagaattataatgatcgcgatacatgcttgctgcatttctctttctcctcccgtttttttgcttttttctctaatagctggctggcgaatccagccgcaatgatcgtgacgatggtgctgagaacgactgtaatcagcagcatcaggccattgaatgaaatgagagacggatagtttatcactcctgtcattgccgggatgaacaacaatggaaggaaggataataaaaaccctgctccgtcttcaatgatggagacgggaacaatacggaggcccaagcagatcagaagcaataccaatccaacgatgcttcctgacacgggtaaatgaaacagatgctgaatggcttccccgatcataaaaaatacatataatatcaacacttgcaaaataattcgtatgactttcacatcaagtgctgctctccaatcagaacagcttcctcctttctggtgcttgcttctaggatggttctgaggaatcgctttactttctttttatatgattgtactatacaagtataataattgatttagtcatataacgacttgtatttattcagttaatgtacatttgtattatacaagtatatatgatgttgtcaatgccggagattggaatagggagcgagagcgattgcaaaatcaaaatccagttgaattaattgaatatgagctgacgacttttatcaggagagctgtttatctggatcaatcggagaaaagaacagggaatttggagagatcttcgtacttattactgagacaattggatgagtttgggcctgctcgtgttaaggaattggctgaatcgtttaagcttgatatttctactctttcaagacaagcagctgcattagaggcaaaggagctcatctatcgtttctcagacccgtctgatgggagagtcagcctgtttaccattacaaaactcggcaaacaactattaaaagccgatcagcaaaagcgccttgaacgttatgaacagatgctgaaagaatggtcaacacaggaaaaagagatgttcggcgagctgctgcagcgtatgaacaaggcttttatcgattaacagctgaaaaacccatggttcgctggaacagcatgggtttttcttatggtcagagattatctgcatcgtttggcggcagcccaagccactagtccggcaacaacagccgccgatacaattgggcgcttcgtcgcttttgtgtagtagcttcttgacctcatccatcctttatttgtgcctctgtcatgcataccgcagccagcatcataaagagcgctttcttctctcggattggacggtctttcggcatgctggctgtgatacatgattttttccatcagtctgtcggtcagacgaggaaaaagcgcgcccagcatggcgatggctttggcctgtgagccgatgtacatgtcgcgcttagggtgttcggcggcaaacaggatcgcttcggcgaccgcttccggcggatagatcatggagcggtaatgagccggctgtttgtcgaggtagctgtgcgcatgctcgttatatggtgtgtcaattctgcccgggtggatgagcgttaccgagacgggcgcctgttccttttcaagctccattcggatgctttccgtccagccgtgaagcgcaaatttggcagatgcatatgtggattgaatgaccgttcccctgtctccgaacaggcttcctacattaatgagtgcgcccggcacacctctgccggtgtagtgtttgacagccgctcttgttccgtaaacaggtccccagaaatttgtgtcgaacatgcgcttcatgtcttcgacggtgacgtccatggcgtgtccgaaagtcgagacggccgcattgttgacccatgtatcaaagcggccgaatgtgctgatcgcggtttctgcgatgcggttgacgtcctcttcttttccgacatccgcctttacccatatggcgtcgtgccctttttccttaagttcatcagtgagctccttcagcgcctcttcatttcgcgctgctgccacgacctttgcgcctttttcagctgccattctcgccgtgacaagtccgataccgcttgaagcgccggtaatgacgatcacctgatccttaagctttttcagtttgagctttgtttttatggcggggttctgttgttcaagctgctctgtatttgtgactgaatgatcgattgtcattgagagatccctcctagacgctgtttttgtacattaccccatccggaagggtcttaccccttttgacaatcacagggttcttttttatattatataagtcgctctaccatacctaggagggaatgttttaatgactagcagaggagattcacgtgaaaaaatccttcacacggcgtcacgtctgttccagctgcaaggatatcacgcgacaggtttgaaccagattgtaaaagaaagcggtgctccaaaaggatcgctttatcacttttttccgaatggcaaagaagaactagcaattgaagcggttacatatacaggtaagatcgttgaacatctgatacagcaaagcatggatgaatcctctgatcctgttgaagcgattcagctttttatcaaaaaaacagccagccaatttgacaacacagaaagcattaaaggtattccagtcggtttgctggcgagtgagacagcgttaatcagtgaaccgctgcggacggtttgcatgaaggtgtttaaaagctgggaagcggtttttgccagaaaattaatggaaaacggatttgcagaagaagaagcaaatcagcttggaacgctgattaattcgatgattgagggcggcatcatgctttcgttaacgaataaagacaaaacgcctcttcttctcattgccgaacaaataccagtgctggtgagaaaaaaagggtagcattttgttatcctttctcctacaattatatagaacggtctagacaaatgaatgataatatatagactggtctaaattggaggaagcgataatatgaaaacattatgtacacattcattgcctaaagaaaaaatgccttatttgctccggagcggagaaggcgagcgctatctgttcggcagacaggttgccacggtgatggcgaatgggaggagcacaggtgatttgtttgagatcgtgcttctttccgggggaaaaggagatgcctttccgcttcacgtccacaaggacacacatgaaggaattctcgttttggacgggaaactggaactgacacttgatggtgaacgctatttattaatatcaggtgattatgccaacattccggcgggaacaccgcacagctaccggatgcagagccacagaacaagactggtgtcttacacgatgaaaggaaacgtagcgcacttgtattccgttattgggaatccgtatgatcacgctgaacatccgccgtacgcaagcgaagaagtctcaaacgagcgatttgcagaagcagccgctgtagcggacattgtatttctagatgaagcaaagcctgcatgttcggccaaattagcggaacttacagagctgccagatggagcggttccatacgttcttgaatctggagaaggagatcgtctgttgactggagatcagcttcaccgcattgtggctgcacaaaaaaatacagatggccagtttatcgtcgtatcatctgaaggccctaaaggtgaccgaatcgttgatcactaccatgaatatcatacagaaacattttattgccttgaaggccagatgacgatgtggacagatggccaggaaattcagctgaatccgggagatttcctgcatgtccctgcaaataccgttcactcctatcgccttgattctcactatacaaagatggtgggcgtattggttcctggtttatttgaaccgtttttccggacgttaggcgacccgtatgaaggccacatcttcccatgtgagcctcaggctttgcgctttgatcgcattttgcagaatatcgaagcattagatttaaaggtgatgaaaccataaagatgacaagattgtaaggttttcatgccggcctgacacctaaatcgatgttaccgcgcttcattttttcctacccttaaggtacagaaaaaaggagcgtgatggctatgtcttcattacagccgactttaacaaatgagcggatcggtgtgcttgatgtgctgagaggaatggcgattttcggcatcttatttgtcaatctggcacatttcagttatccggatatgtatttgtctatgcttggaaaagagaattttttcatggataagtggtctgaagctgattttgccgccgcagacatactgaaattcttcattcaaacaaaatgtattttattgttttcctttttatttggatttggcatggttgtcatgatggagagagcagaaaacaaagggaaacggtttgttccgttatatgtgagaaggttaatggcgcttctcttgtttggaacgattcatgcctttttgatatgggacggggatattttaacagaatatgccctgctcggatttgtcctgctcttgtttcgaaaagcaaagccgaaaacactgctgatatgggcggtctctttgtatcttctgttttccattccgttcatgttgacaagttttgatcaatcaaacggacaggaatgggtacaagcggtaacacagcaggcaaaacaagcgattcatgtttatggaagcggcagcctgaaggatattgcagaacagcggatccacgaccgtcttgtttacatgtcttcgaatggcatgcttacgtataatccgctcaactacttctttgcatccattccatatttcagcatgtttttgctgggagctgcggcagcaaaatcacggtatttgcatgaaccggaaaagcatcgcaaaggattaaaacgattatggatggctgggcttgtcatcggcatcggcgcccaggtgctgtacagtgtaacggataaagaaatatgtttgctgattggcgcgcctttcctcatgtttttctatgttacaacggttgtctatctttatcataaaacaagagtgagaacagtgctgcaatcattctccgctgttgggaggatggcatttaccaattatttgatgcagtctattgtgtgtacttggattttttatcattacggcttgggcctgtatggaaaagtgtaccctgctgccggtgtgctcattacaattgctgtttgtgccgttcaaatggtcttcagccacctttggcttcgtgtctttcggatggggccgtttgagtggttgtggagaagcgctacgtatctgtcgtggcagcctattgcaaagaaaacaaaagtctagatgcctattggcgtctagacttttttctattatttatacacgacacgtgttttgcaaatgatgtcatgcaggccttttttctctccaaaggcgatcatgataaacccgatataaaagatgattccagataagatataggcaaagtaacggccaattccctgtccgacagaaacccgttcaccttgttcattgaccactttcaggccaagaatttttttgccaagtgtgccttgcattttagaagctgtgagcagcccgtaatataacacgctgatgacgatcatgatcagcatagtaggcaaaaatgcaagcgtcatgtatttcactaaatactcttcttccgtcatgtaagggtttgttgccacagccccagctacaaacacagaattgataataaatagaataatataactaggaacagatacaataatgccgtcaataaaataagctaaaaaacgaatccaaaatcctgctggtttttccatgtatttttctctctcctctgaattaatcggaatagtatactttgaaaaacatgtacatgcaatatggtatggtgataaaatcctgatattacagaaaaatgagtcttttatcctttgttttttactatataaatatactagaaagaagcatagcatttgtgtatgtattctggaattttttaaaaatataatgaatataacattcaacttacttataataaaaaaggttaatatttctattaaaggaggagtttgatgtcaaaaaaaatagcgtggcgatcatgacaaccatttctgcgtttcttttttgcgccgtgattgtggcggcttcactttcgccgctggccggaacgggagcggcggccaatcagtttaattcagctggcatgtggtcagctgtcggtatgatccttgtcttgtatttcattccatttctcgtttatatgctcggagtcgatgcaatgaggtatgtcatggcggtgctttgcggcttcgggcttttgattcatttgtcttcggccggttttatcttgatgtttagtttctttagtgaccatctgctttctgaggtgatctttgttttgggagttagtctcgctgcggctgctgtcaacgtcatttggtttgtggctgcatttcgatcgggtgctgaaaaaacgtccgtgaatactcttacatagttttctagtttgtgatgtttttgtgaaatagatttataaaatggatgaatatgttatgatggtcacaaattagaagttacatataatgggggtctcaatgatggtcaagtcatttcgtatgaaagctttgattgcgggagctgcggtggcggcggctgtttcggccggcgctgtttctgatgtgcccgctgccaaagtgcttcagccgacagctgcttatgcggcggaaacggtgttttctcaaaataatggagcatctggctttttgccaggaagatatgatgtacaagcgatggcgcctgccatgtttaactggtcacgcgaaagccggttcgccggaaatacagacgggacgctgaaatggcaaaacgacatcagaacgactccgcaaaatggagcgggggctgtgattgacggagacggcacagtatatcttcattccagagacggggaaatgaaagcctttaatccagacggctcagtcaaatgggtgacgggcaatcttggaaaaacatatacgcaatctcctgtacttgggaccaacggcgttatctatttggcatcctatgacaaaaagatttattttattgacaaagaaacgggagaaattttaacaacggttccgttaagcggcgggccaagctctgaaacggtgatcggttcagacgggacgttgtatttctcaacacttgataattatgttcacgcgatcaaaccgacgtcaaaatcaacctggacagagcgctggaagttgaaaacaaatggggtcgtcagctctgtgccggtgcttgccaaaaacggcaccgtgtatgtcggcacatataattacgtgttttatgcgatcaactccggaaccggacaggtgaaatggtccagaacgacgtcaaatgcgtttaaaggatatccggtgattgataaggacggaaacatttatgccggcaaccaagatggacagctgtatgcttatacatcaacaggcagtttgaaatggacattcccgctaaacgggttctccagctcatctcctgcgattgatcataatggcaatatctacatcggctcaggaagcggcgagctgttttccatcagcaaaaacggggatatgaactggtcattctacacagacggccctgtcagaacggcgccgctgattgacgcgaagggaacggtttatttcgggtcagatgatatgaaggtttatgcggcagacgcaaacggcaatgaattatggagctatcaaaccgacagcaacgtcgtgtcttctcctcagctcgctgaggacggaacactttatattggaagttatacgaagctgatggcttttgggaaataactgaatagaatagcagaagaccttcttttaataagaaggtcttcttactgtgatacaaaacatttacacttgctgggatttttcaatctgaactttcatatcattgtctttaatcttaggcactatcgtataaaggataatagggattaatagaaatacagctacaacaacaaacatggcagagagcccaaaggctgcggaaatgatgccgaaaatgacaccggaaagaatttctccaattgctcctacccctgagtttaacgagaaaagtgtgttcttgtatgaatcggggaaaaacttatttaagtaacttgttacgatcggatgatgaatatcttcaattgcaagcaaaaacgctgtacatggaatgcccagcggcctgaatgctctagacaatagaaaagtcatgaccatgcccatggaatccaatgaggttaaagcgagatatggatttttttcgatcttcttttcgaacctgatggttaatgtcaaaagaacgagagcggtaaaccctcctagggcaaaaatatatcccagtgacttttctgaaaagcctaaatcactcaaaaaaggctgccagtaacgggaaattgtgtcataggctgtggctgtaaagaaaccggctatgacgattaaaagaaccctttttttgttaaagataatttttaaactttctttgataatctttatcgaatcatgttggttctgatccccatgatttgtttcggaaacagaagggactttaataaatacagacatccaaataaatagtaataagtagatcaccataacgagcaggaaaggaaaatagatatttaatgaatacaaatacccgctggcaatacttccaataattaaaaaagtgattagcaattgtgtgtttttcatcatttctttgccgaatcgatcttcccctgcgacacggctcatccaagtttcaaaagaaccggaaattaaggaatctgataaagcccatatgatcatagccagtatgcaaatagcagctgaatcgataaaagggaagaaggcccatgtaaggatggagaaaaagaatgaactggcaattgaaattttaattccataacgatcagcaaaaacgccggaaggaacttcaaatataagcttagcaatttcaagtaccgctcccattaatccaatctgaaggaaatcataatctttagatatcagataaagaatccaaataggcgaaaaaatccccattgctaatcccctaagtgcggaaaacgaataaaagatgctcatctatatgctccttctggcagatttttttgtttgatcaaaatgatattgtgttcgatggcttcttgaatatatttggccacttcttcaaggctgacaccatgtctgtctaaaatcgtatgaagtgtgtcttttccattaatatcgcagagaatatgcagccaagctccgacgtcttcctccgaaacaataaactgaataaatccttcttccgcaatgtagatgcaatgctcactatcgctttccggccttaacagagtgacgccagggtttagcgccaaaatatcttgtccttcacacttattggctgagatatttaaacgactggcaatatcaccttcctgtgagtgccagtcttttattgttatcgattctaaatggctggttatgtctaattgaacagaaggggtttctttagtcatttttgataaaagtcccatgttcaccagtcttaataaaaattcaaaatttgtaaactcaggatcatcctccaaatatgtcatgatggcatgaatgtgttcaacctgtattatgctggaggcatcgctgtgagagaaggcctcctctataagctgataattgtttttcttcagaagatgaaacatcattttatgtgtatatctcacgtccttaccatagaaaaaaggaacctttggccggtgggtatagcttgtatgcagctcatttgttaatgattttcgcaataccgacttatcccataacaagtctttacggagtccatcaggtattccgcaaacccattcaacaagccgatggtccaagaacggtacacggttttcgatatgattagccgcggcgatccgatcttcatgccagcaattatacatttgcagatcacggtattttgtcaggacatacgattgccaaggatctgcttggctggaatcattgctctttaaataagaaaggtttataggagaaagtccaaaatgctcctcccacactctaaagatatttccctgcagccgatgcagccggttcatctccatcgtattgaccgattcaataaatccttcccaacttgggttctcggctggtgaaagtgtcgtgctgtaaccgccgttaaattcgtcgctgccctggccggtcagcatgactttcaggtttggccttatcgctttggcatacttatgtaaatgaaacttatataattgttccggtccgcaaaacggtgtttcacagatccataacaaatgtttatatgactctggttgtaataactcatcgttccctaattgatagagaacctgatgatttggaaggtgtaaatctttagccagccaatgggcatattttgcatcttcatttgtaaatgtactttggcttaatactgtaaacgtatggagatcctgtttttctgcagcaaaatgtgcgactgcagctgaatcaatgccaccgctaagaaacaacccgacttcaacgtcgctttgtaaacatctatggactgaatctgccagcagttctctatatccttcaatcaggtcatcgggatggagattctcacgatagccttgcctgagcaaaatatcctgtaaagaccaatagcttgctgtttttcgttcatttgttgtcaaattaatttcgagataatggccagcatcgagattttggatgtttacaaaaaaggaagtggtttctttatgattactggctgcttccccgcttagccaaatgtctgagagtgcttctttccaattaaattggcggggacagtgaggatgagaaaatagggattttatttcagaggcaaatataagctcgtgttttagctctgtgtaaaaaagcggtttaatcccaaagcggtcacgaactaaaaatactttgttttattttgtcccaaatggctattgaaaacattccgatgatgtcgtctacaaatccaatccctttttcttcatataaatgaacaattacttcacaatcagatgtcgttttaaacatatgattgtgtaaagaagccttcagttctttatagttataaatttctccatttaccataacgacgattgatccatcctcatttaaaaagggctgctgtccatttacaaggtcaagaatggacaatcgccgaaatgcaaagccgactttggaatcaatatgatattgttcatcatccggtcccctatagctgatggcatctgccatgcctttcaatatatgaaaggtacattcctgagaacggggagcagccagatttataatacccgcgagcccgcacatatgtctccctcccaatagcgttattgatgtttatagatataagctgtctctacatctgtttcttttacaatatcgattttaattccgagacgttttgcgttttcgattgcgagaatggaagcgtacgcagaaaattcttcgggatcaatttcaaaataaaaaaaggcctcactaggttctttttcataccaagtgtgggtatttacgacatatttatcttctgtttcaaacaattcaattttgtcataaagtaaacgtcttccttttataaagagttccacaaatgatccaactggttgttggctgttaatgtgtctccactcatcataatatcctctttcctcatattgctcgtgaatccagcttacaatatcttgatgagtcaatccttgttttttggcaaaggcaagcagagtgatgatgtaatttacgattgatttagaacggtgtgtactcagctcatgtacatcgtctggtaaagcaagcactttttgtttttccaattctcatgccccctgcttaactttgattgcttcatgatcaataagcaactcaaacagctccatacaatcttctaagcaggtttgataatcaacatcatattcattgacgatttttgagcaaatatcatgtatgctgaccttgccgtcgatatggttataaatatctgatgccatttcatttaaagtgatgcccggctctataataatgcttttcaaatattttcttgatggcatttctggatttttggataaaacagttgattcattgatcattacaatgcaccttccttttctttttctatcgttaacatccatgtgacagactcaatttcatgatcagtactttgatcattttgttcccacaggggagcatcctccagctcatctaagctttctataaaatcctccggtaaaaagtgaaaggtttctaatgaataattgggaatgccggcatcctgaacaaactggtgaatgtcttcaaaggaataactttcttcaaatgcctctcttacaaacctgaagtattccggttctttgatttgttttcgcataatctctaaatggcttccttggggattaaatgtatccaaaatgacaatttttccgcccggagccagaactctatagcactctttaagtcctttaacaacgtcttcccaatgatgcaggcaagagtaggagacgatgaagtcagcatattggtcagcgtaagataaatggtggacatcttccaaatcaaatgaaatcaggctgcttactccgctttttttagcttcttcttgagcgatttcatgcatggccgggttaatatcgacagcatgcacgtgcgcatttgttcttttagccaactgaatgcttaaataacctggacctgtgcccatatcgataatgactttgtttttgggggaatacatccgggacagtctggcgccaagcaaggggtaaagataggattggtaaagatcaacaaattctttgtacgttctgcattcttcagccgtaatcatcttcagcatcctccttatcaagttggcgtgatagcctcaaacgttaatcgttttggataagattaatgaccgccagctgctacagcgcggcgcaattcaaaaaggcgaggtttcttataagcttttttcattgagcatccctcctaaaatagagtactagatgtcaaatgctatatgagattaatggccgccagctgctacagcacggcgcagttcaaaaagacgaggtttcttataagcctttttcatccttttccctccttccttgtaaaaaaataggctatcacgcacaactaaatattataatcctctgataattctgtcaatatttacttttagaaaaaaatgttatatctttgtggtgaagttactttttttgggagggataatatgagtgctgtaaccgaatcggttttggagtctatcatcagtcctgtaacgatgagtgagtttttagaagaatattggcctgtaaaacctttggtagccagaggagaagtggagagatttacaagcataccggggtttgaaaaggttagaacgctagaaaacgtattggctatctacaataatccagtcatggtcgttggtgatgctgtgattgaagaatctgaagggatcacagacagatttcttgtgtcacctgcagaggctttagagtggtatgaaaaaggggctgcattagagtttgatttcaccgacctatttattccccaagtcagaaggtggatagaaaaactcaaagcggaattaagactgcctgcgggtacttcttccaaagccattgtttacgcggcgaaaaatggcgggggattcaaagcccattttgacgcctacaccaacttgatttttcaaattcaaggtgagaaaacatggaagcttgccaagaatgaaaatgtgagcaatccaatgcagcactatgatttatcagaggctccttactatcctgatgatttacagtcatattggaaaggagatccgccaaaagaggatctgccagatgcagaaatcgttaatttaacaccgggaaccatgctgtatttgccaagaggtttatggcactccaccaaatctgatcaagcaacgttagctttaaatattacatttggccagcctgcatggcttgacttgatgctagcagctcttcgaaaaaaattaatcagtgataacagatttagagaactcgctgtaaatcatcaatccctacatgaatcgtccaaatcagagttaaatggatatttggaaagtctgattcaaacgttatcagagaacgcagagacattgaccccagagcaaatcttccaatctcaggattcagattttgatccttatcaatccacgcaattggtattcagacagcttttgacaagttataagttctagtaaatactagataaggggattaatgacataaaataggttgttaattctcttatttttgttcagctaaaaggaggaaaatatgaatattattccgacatgccagatacctaaagatcttgtttccgcgttttttcaaaaacactggggcagtccgcaaatggttatttctagcggtatttataactgcgatgaattagatggttatggaatgctcaacgatgataaccagattgttggccttattacatacatatttgaagaagatgcctgtgaaatcatttcgctggatagtgtcattgagaataaagggatcggaacagctctgctagagaaagccgaggaagcatgcagagagagaaatatcaaacaaataaaactgatcacaaccaatgataatattcatgcattagcgttttatcagaagagagggtaccggttggatcgactatttgtgaatgcagtcgagacggccagaaagatgaagcccgaaattcctttactggcagataataaaatacctatccgtgatgaattgcttttggtcaaggagttacaataaaaggcgctcctctaaggaagcgccttttgatcatgcgattattcagcggcctgaataaatacacccttctcatgagaaaactctttgaatccgtataccccatgataggagccgattccgcttgtgttgacgccgccgaatggcaggttgacgtcactgaaatggacgacgacatcattgatggcggcatttcctgatgtcgtgtgctgaaggacgttgtcaatcagatcttggtttttgctgaacacataaagtgcaagcggtttatcgcggtcatttacgtaatcgatgacctcgtcgatgtcttcatagttcatcattggcaggatcgatgcgaagatttcctcctgcatgattttcatgtcaggcgtgacgtttttcaaaacggttggcgagatcgtgcggtcgctggcatcgaatacgccgccgaacaccacttccgcccctctttcgatggcatcgtcgaacagatctttgacgcggttgaagttgcggtcattgacgatctgcgtaaatttgctgcggtctggggtatgatcatcctccataaatccagcgttgacgactgtttgtaaaatccccgcgaacctgtcctgaacgtcttttttaatgaacaggtaatcaggtgcgatgcaggtttggccggcgtttacgaatttcccgacggcgatctttttcgctgcgtccatcagatcgtattcactgtcaatgatcgtcgggctcttgccgccaagctcaagtgtgacagatgccaagtgtttggcagccgctgtcatgacaattttcccgacatttgtgcttccagtgaagaaaatatggtcgaacggctgatcaagtagttcggttgccacctcaacctctccttcaaaaatcgcgacttctttttcatcaaaagcgtctcttattactttagcagcaatgttgctcgtgttcatcgtgaaatcggacagcttcacaatcgcgctgtttccggctgcgagagaagcggcaagcggcgccatcgtcagcataaacggatagttccacgggccgaggatgagtgtgacgcctttaggctcgtacataagaattccgtttgcgtcagggcttaacgatgaaccgacttctttaggcgccatccattgttccaggttattcatattatctctaatcgctttttttgttccttcgatttccgcttttttgacttcgtgatatggtttgcggacgtctttgcggatcgcttcgatgatttcttcttcatgggcgatgacggaatctaaaaagcgttgaagcttttctctccgctgttccgctgttgaagcgcgcaaggctttttgctgttttttctgaagctgaaagacacgctggatgtcgtcctttacttgctgttccattgtaaaatccccctcatttgctttcttcttttctcggacctattataaggtggtaccttttctgtaagaaagacaacggtgaaccatctatacgttaccgtacatatatctaagatctgtctaatgattggaggtgtcttttgtgccggaatctgccgaagctcaagtgaaagaggcgctgctggctttattgaaagatagagatattcaacacatcacaatgaaagaaatcgctgagaaggccaaagtgagccgcggatcgctctacctttattatgaggataagttttcaatcattgaggatgtgatcgaagacatgaaggaaggactgggcaaagcgctttttgacgccttcagtcatatggatacccttcatttgaacaaaaaacggcaaacggtgcatccgacgctgtcctttgttcatgagcatcgttcctttttttctgtgatgatgaacagaggacattttcatcgtttttttaaggatgtgtttcagcaggatgtgctgctggctccgatccatgtgaatttaacgccgattgaacgggacatttatggacattatcgggccttgtacacgtacgcgattatcctgtattggctgaatgaggatgcggccgcgtctcctgaagccatcagccagaaggtatgggagcttgtttctcaaaagcggttttattggctgtttggaaaagctgtgccaggagagcgagagaaggagaagcaaatcgacaggcgggtggttcgaacgagagaggcgctgcagaaggcatttctggatgtattggcggagaaacaagactacgcgggcatcacgatttcagatattacgcgtaaaagcaatatccgccgtgcaaccttttatgatcactatgccaataaggaggaattgctccaaaccatgatacagcgatcatgtgcggagatcattgatcacctgacgattgcctccagcccgaatgaattttccttaaaggaagcggagaaggcgctcgccattctgctttctgctttgtcaaacatgcccattgtccattttctcaatcgggaatggggtgttcctcatgtgatacctgatatgttcaaagcgctggaatcgttttatctgcatcagcaaactgatattcacgcagagaaaaagctttatgcccattatgtatccgcaatgattatcgggttgcttttgtatcggctggatgaaggaaaggcgcatccgcctgaagtgctggcgagggagtttttgcagtttttggatgtgaagaaatataaggttgtattgctttaaaagacaaaaagagagggggctccctctcttatttcgtttcttccttccatttctcctcaatcagcatcttcccaggccatgtgtacgccatgatgccgccgtctgcggtgatgtcttctcctgtgacgtatgagctgtcgtctgatgcgaggaacagtgccactgttgccatttctttgggctggccaagacgtccgagcggcgtgatccatttgttggcttcgcggaattgttcgcccatttcctgttcttttgtgcctgctaatttgtcaatcagcggtgtttcgatcgtgcccggtgaaatggaattgacgcggatgccgtttcgtgcgtagtcgattgccattgcctttgtcaggttggtgataccgccttttgcggcgttgtagccggagcggtcaaggtccgcggcacggcctgacatggaggaggtgttgatgatggagcctccattttcgagcatgagcggaatcaaatatttgctgcaaaggaatgtgccgcgcaggtcgacggcgataatgcggtcaaacaggtcaaccggatattcgtgcacctttccgccttcctgatcaacgccggcattattaaacagaatatcaatcgttccgcatgcatccttgatttgatcagcaaatgctttcacactgttttcatctgacacatcgaggtgaaaggattcggcctgtcctccgttttttctgattgcgtcaactgtttcttccatttgatctttattgatatctccgatgatcacacgcgcgccttcattggcaaaaacctccgccgtcgcttgaccaatgcctgtcgcggcgcctgtgataactgctgttttgttttcaagtcttcccatgatacgagacctcctttttctatttgtcttcccgctatgtgcagtgataaacatgcgagaaaagaaaggccagcatatgttaagatgaattagaaattgttgggaggtttgtatgtttgaaggtacagcataagaaggagctcaagttttattgcatcgtgaccattccatctgcatttgttgtgctgactgtcatctcttttttattgcaagagattacgttcccggtgactgcaagcgcatttctgaatgcttcatggcataatcttttgtttttgataccgttcggtttgtttttctacccggtgcatatatggatgaagcgggagtttggccgttggaatgacacagaaaaaaagagaggatgatgaagcctctcttttttatgagaatgagtgagaaaaagagtgaaaacaaatccaactaatgttaaatttacatatatatgcatctatcaatctaattgacaattgtcatcttatgtgataaatagatgctgaaaagggtttacataatggtaaaggagcgatcaagagtggcgaaaaaagagtttaaagcagagtctaaacgcttgctggatatgatgattaactccatttatacccaaaaagaaattttcctgcgcgagttaatctccaattcgagtgatgcgattgacaaaatctattacaaagcgcttacggacgatgcgcttacgtttgataaagacagttactacataaaggtcgcagctgacaaagatgcgagaacattaaccatctctgatacggggatcggaatgacaaaggatgagcttgaacagcatcttggaacaattgcaaaaagcggttccctcgcgtttaaaaaggaaaacgagctgaaagacggacatgacattatcgggcagttcggtgtcggtttttacgcggcatttatggttgccgatgtcgtgacagtcatcagtaaagcgcttggcagcgaagaggcttataaatgggagtctgcgggtgcagacggctatacgattgagccgtgtgaaaaggattctgtcggtacagacattatcctgaaaatcaaagagaacacagaagatgacagctatgacgagtttttagaggaatatcgtttaaaagcgatcatcaagaagtactccgacttcattcgctacccgatcaaaatggatacaaccattaataagccgaaggaaggcagcgaaaatgaatttgaagaggtgcaggaagagcagacggtcaacagcatggtgccgatctggagaaaaaacaaaagcgagctgacagatgaggattatgaaaaattctatgctgaaaagcattacgggtttgataaaccgctgacacacgttcatatcagcgtggatggagcggttcgctacaacgcgattctattcgtccctgaaaacatgccgtttgactactattccaaggaatatgagaaaggcttggagctgtattccaatggcgtgctgatcatgaataagtgcgcagacctgctaccggaccacttcagctttgtgaagggcatggtcgattctgaggatctgtcgctgaatatttccagagaaatgctgcagcatgaccgccagctgaagctgatcgcgaaaaacatcagcaagaaaatcaaaagcgagctgcaaagcctgttgaaaaaagaccgcgagaaatacgagacgttctacaagtcgttcggcagacagctgaaattcggcgtgtacaatgattttggcgcgaataaggatcaattgaaggatctcctcttattctactcttcaaaagagaaaaaactggtcagcttagacgagtatgtttccagaatgccagaggagcagaaattcatttattacgcgaccggtgattcttacgaccgcattgagaaactgccgcaaacggaaatggtggcggacaaaggctatgaaatcctctactttactgaggacatcgatgagtttgcaattaaaatgctggcttcttatcaggaaaaagaattcaagtccgtatcaagcggagaccttggcatagacacggatgaggatcaaaagcagtccgaggaagaggaaagcaagtataaggatctgtttgaggaaatgaaaaacattctgtcagacaaagtgaaaaacgtcagaatctcaaaacggcttaaatcacatccagtctgccttgctgctgacggcgaagtgacaattgagatggaaaaaatcttaaatgcgatgcctgacagccaaaatgtgaaggcggaaaaagtgctggaaatcaacccaaatcacgaggtattccaaacactgcaggacgcgtttgaacaagataaagagaagctgagcctgtacacaaaccttctgtacaatcaggcgctcctcatcgaaggcctgccgattcaggaccctgtggaatttacgaacaatatttgcaaggtcatggtgtaaacagaaaaaggaatcgtctcataaggagacgattcctttttttataatgtacgctcattcagcacttggttttgggtgcttttcttctttttaaaccgttttttcaggcttgcttcaatttcctccaagcttttccctttggtttccggtaccatgtagaacgcgaagaaaaatgagagaagacaaatgactgagaaaaccataaagacccatgcgatgcccatcgcgcttagcatcagcgggaagacaagcgacacgatcaggttagccgccgataacaccaaagtcgtgaaccctgtcgcggctccgcgtgctttggacgggaagagctcaggcatgagcacccacactaccggaccccatgtcgcctggtaaaagacgatatagacaccgagaaagactactgtcatccacgctgttgatgcggaaagccccagtgtcaggagcacgcctgataaagcagcaaggctcagtgtgatgccgacacttccccagatcagaagttttttgcggccgacacggtcaattaagatcatggcagtgatacacatgatgacgttgaggatgccgattcccattgtgccgagcgccgaagctgatgtgccaagaccggccttcgtaaaaatggttggcgcgtagtagatgaccgtgttaatgccgactgcctgctggaaaatggcaaggccgacgccaatcagaagcatagggcgaatccacttggctttcagcacgccaagtgtcgtttcttttttctccgcttccccttgcttcatctctgccaattccatttcgatgtctttggggtcatgagtgatgttcatgatgcgtctcgcttcttcttcgctgccgcgcttcacgagccatcttggcgattccggcatgaaggcgatgccgattaatagaagcacggcaggcactgcagccagaccgaccatccagcgccacgcttcaaacggtgtgaacaggtagttaacgatataggcgagcaaaatcccggtgacaatcattaagttgttcattgtgccgagtgtcccgcgaattttcgtcggtgccatttcggaaagatacacgggcacaagtgccgttgaaccgccgacggccaacccgagtatcaccctagatgcaatcagcatgccgattgtttgagaaaatgcgcaagcgagcgcaccgataataaaaatgatggaaaggacaaatacaacctttctcctgccccagcggtctgagcatgtgccgctcaaggcagaaccgaaaatcgcgccaaggagcagcatgctgacaaccaatccttctgtcaatgtcgttaaaggaatatcgttattgataaacaggagtgctccggagataacacctgtatcgtaaccatatagcagtccccctaaagcgccgaaaaagtagatcatatatttccttgtgtctttcttcacaaatgtctcctcctcagttgttgagccaatgagtatctaaaaatatgtaacaaagttaatagattagtacccatttcctatctcatttgaaacatttgttttgaaaaaacggaaactttatagccaaaagagatgatcacagatccgctgagtttaggaaaaacgaaataactttatgctcagagaaaccattaaaaaaaccttacccgcgcggagtaaggtttgattaagacatttttattcttctgcttcgttgacaaaaaccaaggcggagaagccttttttcttatcaaattgcaattcaacgacggtaacgtccggattgaagttgtggtattcctctaagaactgaataatgccttctgaaatgtcatctgacataagctgcttgtggtgcaggccaaatgtagcttcagcgaagaaccctgtacgcttgttgtacgatagttcttttacttcaacgtcttcagggtagatatcttcttcattggaaatatacacgcaaattccgtctacaatttcttgctcatttaatattaatctcattgcctaaaatctccttctgtacgtcttcggtgctttaaatgcgcgaatcaatgcgatgacaatgattaaaataataatcaaagcgatgatatcaacgatccaggcaatgggtgaagcgccataagaaacataaccggggcctccgactggatgataggtgtaaccccatgggtgcatcatgctgatcatgaacatacccattgtaaatccgctataatatccaaaccatcctgatggcgcgaaacctgcgtgatagtaatgattgactgaaacataacgtccgccaacataggctttagacgtttttccgctgtatgtctttccggttacttttgatgtagcgccggaaaaggtgcctgacgattttttagagcttgatgaacttgccttttccgaaggcttctttttaagcgaaatcgatgatgatgaatcgtcagacgtcttggattttttgctagaagagcttgatcctgagctgtagcttgatttcgggcttgatttatagcttccgctgtatgatgagcttgaacttcggctgctgtaactagatgatgagcggccgctaaagctctttgcatgagaaatcgttgatggcagcagtacacctaaagcaacggttactgcaactaaggcttttacatatttaagtttcattctgtttcctccatagaccatcgaaacggtccgctattctgaccagcaaataaaagaagctgggtcagctttatttcatatgagctagatgatatgaacgtttcatacttttgctttctcaatcactttctttctgagataaactacctttattttatcggatttatggctcattttgtaaggttttgcttcaaaatcagttatttaggaatttatcgcacaaaaaaacagccttctccattggagaaggctgttttcttcttatgcgaacagcttatcaataaatgaaatatcctcttgagaaagcgtcacgtcagctgttttgatgttatcaatcagctgatcggcacgttttgctcctgggattaaaatatcaatttccggtcttgctaaataccaggccaatacgatgtgagggatatccacgttgtgtttttcggcaatcggcgcaagcttgttgacctttctgatattttctttgaaacgctcacccttgaagtgttcctgttcgtttcgcaggtcgccttctgggaacgttgtatcttctgtatactttcctgccaataaacctgatacgagagggaagtaagggataaatgaaatattatgctccttcgtatacgggaagaatgttttttccgcttcacggtttaacaggttgtattcgccttgcaatacatctaccaaaccgtctttgtttgcttctttcaattgctctaaagagaagttggatacaccgatggaacggatttttccggctttcttcatctcattcagcgcgttaacggcttcatccttaggcgtatgttcgtcagggaagtgaatgtagaacaaatcaatataatcggtattcaagcgcttcaggctttcatcaactgattttttaagaaaatctggtgaattatcaaagacaaagtcattgccttgttttctgtgagcggcttttgtcgcgatgacaacatcttcacggttgaattcacgcagcacttcaccaattaattcttcggaacggccgatcccgtaaatgtaagcggtgtctaacattgtcacgccattacggatcgcctcgcgcaccaattcttttccggtttcttcatttaggttcgggtagaggttatgtcctccgacagcatttgttcctaatccgatagggaatacctgcaagtctgattttccgagcttcgcttttttcatgatctgcctcctagaataaaatggatgatagactctcaacactattgtaaacgttaggccagatgaatgccgatttgatgctcattgcagtactgcgtgtactcgtcgtctaatggctgagaggtcacaatgcaatgcagcctgtcaaacggtgcatacgtcagaagcgttgattttccgaatttagaatggtcagccaatagatacacttcttttgctttttctgaaatcctctttttaatttcatactccagcagatccgaattggtcaatccgtgagtcagcgtcgttccggtagcggacataaaggctttgttgatattgtacttatcaagcatagccgggtcgtccatgccgacaaaggagcgggtttttctcttatagttgtttccgataatgattaagttgatattcttcaaagctgacgccgcattgataatgtctaaactgttggttaagatggtgacatttttggctggatcaagcgtatcaagaatagactttgtcgtcgttcctgaatcaatgaagaccaaatcgtgatcttcaataaatcgggaagcataatgggcgatttttgttttttcatcctggtgctgaatggtgcgattttcaaaaggaactaatgcggttttttcaatagatgttacgccgccgtatactttttcaatcgcacccttttctgttagcttgttgatatcacgtctgactgtgtttttggagacattgaacacctggcacagctcatctaaggaaacagtgccatgcgataaaatgtactcctccatttcctgaatccgcatcagtttcatataaaaaactccttcttgaatctttacgtaacataaatatataataaaaaccaaaagttaatcaatagttgcttaaaaatgataacatcggtgtatatcttttgcaagattggacggccttctcttacttctcttacttgattaaaagattaatataataaaaataatgaaaaaatgtagtgtttatgattgacttatgggtattatgcgattagaatataaccaagaaatgaccaaaaagtaacctgttgtgcatgaaatggttgcttgtatgtaaatatgcatccgccatttatttttttggtgtttttgaaagcgtttaattcttggcttgctgaaaagtggatattgatatgaatctatccggaaccatccatacaagtgtatgtgtttactaatgaaggaggcaataagaatggcagaaatcagaaaattaaaaaactacatcaacggtgaatgggttgaaagcaaaacagatcaatatgaagatgtcgtcaatccggcgacgaaagaagtgctatgccaagtgccgatttctacaaaagaggatattgattacgcagcgcaaacagcggctgaagcatttaaaacatggtcaaaggtggcggttcctcgccgcgccagaattctatttaacttccagcagctgctgtctcagcataaagaagaacttgctcatctaattaccattgaaaacggaaaaaacacgaaagaagctttaggtgaagtgggacgcgggattgaaaacgtagagttcgccgctggagcaccttccctgatgatgggtgactcacttgcttccatcgcaacggacgttgaagcggcgaactaccgttacccaatcggagttgtcggcggaatcgcgccattcaacttcccgatgatggttccttgctggatgttcccgatggcgatcgcgctcggcaacacatttattttaaagccatctgagcggactccgctgttaacagagaaattggttgagctttttgaaaaagcgggccttccgaaaggggtgttcaacgtcgtatacggtgcgcatgacgttgtgaacggcatcctcgagcatcccgaaattaaagcgatttcatttgtaggctccaagccagtaggcgaatacgtctacaaaaaaggaagcgaaaacttaaaacgcgttcaatctctgactggcgcgaaaaaccatacgattgtcttgaacgatgcgaatcttgaagacacggttacaaacatcgttggagctgccttcggttctgccggtgaacgctgcatggcttgtgcggttgtgacagttgaagaaggaatcgccgatgaatttatggcgaagctgcaggaaaaagtggcggacattaaaatcggtaacggccttgatgacggcgtgttcttaggaccggtgattcgcgaagacaacaagaagcgcacgctcagctatatcgaaaaaggtcttgaagaaggtgccagactcgtatgtgacggacgtgaaaatgtgtctgacgacggctactttgtcggcccgacgatctttgacaatgtcacaacagaaatgacgatctggaaagatgaaattttcgctccggtcttatctgtcatccgtgtgaaaaacctgaaagaagcgattgaaatcgccaataagtctgagtttgcgaacggcgcctgcttgttcacatccaactcaaacgcaatccgctacttccgtgaaaacattgatgcgggaatgctaggcatcaaccttggtgtgccggctccaatggcgttcttcccattctcaggctggaaatcttcattctttggaacgctgcatgcgaacggaaaagacagcgtcgacttctatacacgtaaaaaagtggtgacggcaagatatccggcacctgatttcaactaaacgacgaacagccgaacggcgtccatgtgcgctgttcggactcattctgccaatagaaagaggagggcttctctatgagttatttgttgcgtaagccgcagtcgcatgaagtgtctaatggggtcaaactcgtgcacgaagtaacgacatccaactctgatctcacttatgtagagtttaaagtgttagatcttgcatcaggttcaagctatacagaagaattgaaaaaacaagaaatctgtattgtggcggtaacggggaaaattacagtgacagatcatgagtcgacttttgagaatatcggcacgcgcgaaagcgtatttgaacgaaaaccgacagacagcgtctatatttcaaatgaccgtgcatttgagatcacagcggtcagcgacgcaagagtggcgctttgctattctccatcggaaaagcagcttccgacaaagctgatcaaagcggaagacaacggaattgagcatcgcgggcaattttcaaacaaacgtactgttcataacattcttccggattcagacccttcagctaacagtctattagtagttgaagtctatacagacagcggcaactggtccagctacccgcctcacaaacatgaccaagacaacttgccggaagaatctttcttagaagaaacgtactaccatgagttagacccgggacagggctttgtgtttcagcgcgtatacacagatgaccgttctattgacgagacaatgactgtgggaaatgaaaacgttgtcatcgttcctgcgggataccacccggtaggcgttccggacggatacacatcctactatttaaatgtcatggcagggccgacgcgaaaatggaagttttataacgacccggcgcatgaatggattttagaacgctaacaagtgaggagtggctgtttacgatgaagtatacattcaatgaagagaaggcttttgatattgttgccatcggccgggcatgtattgatctgaacgcagtcgaatacaaccgcccaatggaagaaacgatgacattttcgaaatatgtcggcggttcacctgcgaatatcgcgatcggcagcgcgaagcttggcttaaaagcgggcttcatcggcaaaattccggatgaccagcatggaagattcatagagtcctatatgagaaagaccggcgtggatactacacagatgattgttgatcaagatggacacaaagcaggccttgcatttacagaaatcctcagccctgaagaatgcagcatcttaatgtatcgcgatgatgtggcggatctttatcttgagccttcagaggtaagtgaggactatatcgcaaatgcgaaaatgctgcttgtctccgggacagcgctcgccaaaagcccgtcacgggaagcggtgttaaaagctgttcaatacgcgaaaaagcatcaggttaaggtggtattcgaactggattaccggccatatacgtggcagtcatcagatgaaacagccgtttattattctttggttgccgagcagtctgatatcgtcatcggcacacgcgatgaatttgatgtgatggaaaaccgcacaggcggaagcaatgaagaatccgtcaatcatttatttggccattcagccgacctcgttgtcatcaaacacggcgtcgaaggctcttacgcatacagcaaatccggcgaggtattccgcgctcaagcgtacaagacaaaagtgctgaaaacctttggggccggtgactcctatgcgtcagcctttatctatggccttgtcagcggaaaagacattgaaacggcattgaaatacggcagtgcttcagcctccattgtggtgagcaagcacagttcgtcagaagcgatgccgactgcggaagaaatcgaacagcttattgaagcacagtcataattgaaaaagatcgagtaaaggtgggatcgtttgtgggtaagaaaattcgcttaacaactgcgcaggcgctgattaaattcttaaaccagcagtacatccatgtagatggaaaggaagagccttttgtcgaagggatcttcacgattttcggtcatggaaacgtattagggatcgggcaggcgcttgagcaggatgcaggccatttgaaagtctatcaagggaaaaatgaacaaggaatggcgcatgcggccatggcgtacagcaagcaaatgctgagaagaaaaatatatgcggtgtctacatccgtcggacctggagcggctaacttggtggcggcagccggcactgcattggcaaataatatcccagttctcttgattccggcagacacatttgcgacaagacagccagaccctgtactgcagcaaatggagcaagaatacagtgcggcgattacgacaaacgatgcattgaagcctgtatcgagatactgggaccgcattacgcgccctgagcagctgatgagcagtttgctgcgcgcgtttgaagtcatgactgatccggcaaaagcaggtccggcaacgatttgtatttctcaggatgttgaaggggaagcatacgattttgatgaaagtttcttcgtcaaacgggttcactatattgatcgcatgcagccgagcgagcgcgagcttcaaggtgcggcggagctgattaaatccagcaaaaaaacctgtgattctcgtcggcggaggcgcaaaatattccggtgcgcgcgatgaattggttgccatttctgaagcctataacattccgttagttgaaacgcaggcaggaaagtctaccgttgaggcagattttgcgaacaaccttggcggaatgggcatcacaggtacacttgcggcaaacaaagcggcccgccaagctgatttgattatcggcatcggcacaaggtatacagattttgcgacatcctctaagaccgcttttgattttgataaagcgaagtttttgaacattaacgtcagccgaatgcaggcgtataaacttgatgcattccaagtggtggcggatgcgaaagtgacgcttggcaaactgcacggcttgcttgaaggctatgagagcgagttcggcacaacgatccgggagctgaaggacgaatggctagctgaacgcgagcgtctcagcaaagtgacgtttaagcgggaagcatttgatccggaaatcaaaaatcacttttctcaagaggtcctgaatgaatatgctgacgcgttgaatacggagcttccgcaaacaacggcattgctgacaatcaacgagacgattcctgaagacagcgtcatcatctgttcagcaggctcactcccaggagatttgcagcgtctgtggcattctaatgttccgaatacgtatcacctggagtatggatattcttgcatgggctatgaagtgtccgggacactcggtcttaaactggcccaccctgacagagaagtgtattcaatcgtcggagacggcagcttcctgatgcttcattctgaactgatcacggcgattcagtacaacaagaaaatcaatgtgctgctctttgacaactcaggattcggatgcatcaacaacctgcaaatggatcacggcagcggcagctactattgcgagttccgcacagatgacaaccaaatcctgaatgtcgattacgcgaaagtcgctgagggatacggcgcgaaaacctaccgtgcaaacacagtagaagaattaaaagctgcgttagaggatgcgaagaaacaggatgtatcaacattaattgaaatgaaggtgctgcctaaaacaatgacggacggctatgacagctggtggcatgtcggggtggcagaggtatctgaacaagaaagcgttcagaaagcatacgaagcaaaagagaaaaagctggaatctgcgaagcagtattagaggggaggcaccatagatgggcaaaaatgaaatcctgtggggaatcgctcccattgggtggcggaatgatgacatgcctgaaattggagcgggaaatacacttcagcatttgttaagtgatatcgttgtcgcacgttttcaaggcacggaggtcgggggctttttccccgaacctgccatcctgaacaaagagctgaagcttcggaacttacgcattgcaggaaaatggttcagcagttttattttgcgtgacggacttggtgaagcggcaaagacatttaccctgcattgtgagtatttgcagcaagtaaacgcggatgtcgcagttgtctctgaacaaacgtacagcgtgcaaagcttggagaaaaatgtgttcacagagaagccgcactttacggatgatgaatgggagcggctttgcgaagggctgaatcaccttggcgaaattgccgctcagcatggcttgaagcttgtctatcatcatcatctcggcactggtgtccaaacagcggaagaagtggaccgcctgatggcaggaacagaccctgcgcatgtacacctcctctatgatacaggccatgcgtatatttctgacggcgattacatggggatgcttgagaagcatatcggccgcattaagcatgtgcactttaaggatgcccgcctgaatgtcatggaacaatgcaggctcgaaggacaatcgttccggcaatcatttttaaaaggcatgtttacggttcccggtgacggctgcattgactttagagaagtatatcagctgctgttgaagcacagttattccggatggattgtcattgaagctgaacaagaccccgatgttgcaaacccgctggagtatgcattgattgcgagaaactatattgatcagcagttgttggatctggcttaatggggaatgaacatatgggcaataccaatggagattcagccttcaataaacggacaatcgcggcagcattggccaactatattgatgccggttcaattgtggcaggctccgccggtttatcattatgggtcagttaccttaagctatccgatacgcaaatcgggctgctcggcgcgttgagcgcaaatgcgatttctgccgctgtcggcgcgctgcttggcgggtttctggctgataaagtcggacggaaggctgtttataccaatagtatgctggtttatgcactagggatttgtttggttttgttcggggttaatttccccatgttgttaagcggttacatcattatcggtttatcagtaggggctgacataaccgcgtcatggaccattattgcggaaaatgcgccaaagaagaatcgggccaggcattgcggcgtagcacaagtcgcttgggccgcgggcgctgtcgttgtactgctcctctccgtactggccggtgacttgggactcttggggaataaaatcgtatttgcccatctgcttgtgattgcgctgattacgtacatcctgagaatcaggcttccggaatcagacgcctggcagacaaaaaatcagccggaggaagctcaggcagagaagccggctgtattgaataagacatcgtattttgatttgctcaagcctatgtatctaaaaagcatcctgtttttgatgggtgtgtacttggtttggaacctagccgccggggtcatgggcttctttatgccatacatttatcagcaggtcggcggtgtatctgccaacatggccaaccttttgcaaatggggctgtttatcttcacaggattgggggtcgccttgatcttcatgccctttgccgacaaatatagaaaaaccgtatttggaatcgccgctttcatggcggtgatcgggtggacactgtttctgctgccagttgaaggcctgccgattctgctcctgtttattgtcgtgatcggcatcaataacggagccgggcagcaagcgaactatcagttatgggccagcgaaatctttcctacgcaatatcgtgcttccgcacaaggactgatgtttttccttgtccgtatttcaatagggatttggagtctgtttgtcccaatgattatcaccaatttcggcattggaacgatggctgcaattcttctcggatgtgtgacggccagtatgatcatcgggctgctctttgcgccgaatacgtctggcaagtcgcttgaacaaattcaagaggaactctacgggtctcctcagagccaagtaaagaaaggaacagaaagcaaaatcatgtaaccaacagaaggagtggctgtcaatgagtttacgtattggcgtaattggaactggagcaatcggaaaagaacatattaaccgtatcacgaacaagctgtcaggcgcggaaattgtagctgtaacggatgttaatcaagaagctgcacaaaaggtcgttgagcaataccaattaaacgcgacggtttatccgaatgatgacagcttgcttgcagacgaaaatgtagacgctgttttagtgacaagctgggggcctgcgcatgagtcaagcgtgctgaaagcgattaaagcccagaaatatgtgttctgtgaaaaaccgctcgcgacaacggctgaaggatgcatgcgcattgtcgaagaagaaatcaaagtgggcaaacgccttgttcaagtcggcttcatgcgccgttatgacagcggttacgtacagctgaaggaagcacttgataaccatgtgattggcgaaccgcttatgattcattgcgcgcaccgcaacccgactgtaggagataactatacaacggatatggccgtagttgacacgcttgttcatgaaattgatgtgctgcactggctcgtcaatgatgactacgattccgttcaagttatctacccgaaaaaatcgaaaaatgcgctgccgcatttaaaagatccgcaaatcgtcgtgattgaaacaaaaggcggtatcgtcatcaatgctgaaatctatgtgaactgtaaatacggctatgacattcaatgtgaaatcgtcggagaagacggcatcatcaagcttcctgaaccatcaagcatcagcttgagaaaagaaggcaaattcagcacagatattttgatggattggcagagacgctttgttgctgcgtacgatgtggaaatccaagactttattgattcgattcaaaagaaaggcgaggtcagcggaccgacggcatgggacggctatattgctgctgtcacgactgacgcgtgtgtaaaagcccaggaatctggacaaaaagaaaaggttgaattgaaggaaaaaccggaattctatcaatcttttacaacagttcaaaactaaaaaacagaggagtgaaaatatgaagttagcattggatccatccatgtatcgtgatgatttaactttagaggaaacggtctataaaacggcagagctcggctatgaatatatcgaattgtctccgcgcgaggatttttgcccgttttataaatatccgaaagtcgattcagcaaagatcaaacaattaaagcgccttttaagagatacaggtgttaagctttcatcgcttcttcctctttaccactgggcgggtcctgatgaagaccgccgccaggcagcagtgcgcaattggaaacgggcaatcgaaattgcggttgaacttgaagtggatttgatgaacagcgaattcagcggttcaaaatatgatcctttaacaagtgaagaaaaatttatcaaatccatggatgagcttctgccagtctttgaaaaagaaggtattaaacttaatcttcaagcccacccatacgattttatcgaaacgcacaaaggtgcgatggatatgatccgcgcgcttgacaaggattggatcaatcttgtctactcgactgcgcatacgttcttctatgatgacggcaaaggcgacatcgagaccatgtttgacgaagccggcgaccgccttacacatgttttatttgcagatacctataatcataaagcggctcatggccttcgctatatcgtcaatccgcctgacgcgaaagtaacggttcaccagcatttggacattggtcaaggcgaggttgattttgatacgattttcagaaaactgagagagatgaagttcgacggaattgcgacgaatgccgtatttgcttgggtcgatgaaagagcggatgaatcaagccgatttatgcttaagaaaatgaaagaagaattaggtctggcataagctgagcatggagttcggcgggatatggcgacagccttcctgccgaactcccttcatatctaaaacgcagatgggggagtctggcatgaaactttgttttaatgaagcgacaacattggaaaactcaaaccttaaacaggatttagaactatgcgaaaagcacggctatgattatattgaaatccgcacaatggataagctgccggagtacttaaaagatcattcattggatgaccttgcggaatattttcaaacccaccacatcaaaccgcttgccttaaacgcactcgttttcttcaacaaccgtgatgaaaagggccacaacgagatcatcactgaatttaaaggcatgatggaaacatgcaaaaccctcggtgtgaaatatgtggtggccgttccgcttgtgacagagcagaagattgtaaaagaagagatcaaaaagagcagtgtagacgtgctgactgagctgtcagatatcgcggagccgtacggcgtaaaaatcgcgcttgagtttgtcggccatccgcaatgtacggtcaatacgtttgaacaggcgtatgagattgtaaacacagttaaccgtgacaatgtcgggcttgtccttgacagttttcacttccatgcaatgggttcaaatattgagagcttaaagcaggcggacggaaagaaaatcttcatctatcatattgatgatacagaagatttcccaatcggctttttaacagatgaggatcgtgtatggccgggacaaggggcaattgacttagatgcccacttatcagcactgaaggaaatcggcttctctgatgttgtttcggttgagctcttccggcctgaatactataagctgactgctgaggaagccattcaaacagcgaaaaaaacaacagtggatgtcgtatcaaaatacttcagcatgtaatggataaaggaggggtgaatatggcttttgtatcgatgaaagagcttcttgaagatgcaaagcgggagcaatatgcaattggccagtttaatatcaacggcctgcaatggacgaaggcgattttgcaggcggcgcaaaaggagcaatcaccggtcatcgccgcggcttccgatcgcctggtcgactatttaggcggatttaaaacgattgccgccatggtcggcgcgttaatagaggacatggcgattaccgttccggtcgtgcttcatctcgatcacggcagcagtgcggaacgctgcagacaggccattgatgccggattcagctcagtgatgattgacggctcccatcagccgattgacgagaatatcgcgatgacaaaagaagtcaccgattatgccgcaaaacacggcgtgtcagtagaagccgaagtcggcacggtcggcggaatggaagacggactggtcggcggggtccgctatgcggatatcacggaatgtgagcggatcgttaaagaaaccaatatcgacgcgctggccgccgccctcggctctgtacacggcaaatatcagggtgagccgaatctcggatttaaggaaatggaggctatctcccgcatgactgatattcccctcgttcttcacggggcatccgggattccgcaggatcagatcaaaaaagccatcacgctcggccacgcgaagatcaatatcaatacggaatgtatggtagcgtggacagacgaaacacgccgcatgtttcaggaaaacagcgatctgtacgaaccgcgcggctatttgacacccggcattgaagccgtggaagagacagtgcgaagcaaaatgagagagttcggatcagccggtaaagcagctaagcagcaggtcggctaaagagaccagaaaccgccgagatggcggtttttttgtgcggtgttgcgtccatacgcccaaaacgattatgatgatggcagcagtgtaagaaacgggagtggttcagtttgaataaaatcatgattgtggaagacagtgaagacattcgcggactattgcagaattaccttgaaaaatacggatatcaaacagtggtcgccgcggattttacagctgttcttgatgtctttttgcgggaaaagcccgatgtggtgctgcttgatatcaatttgccggcatatgacggatattattggtgccggcagatccgccagcactccacaagcccgatcatctttatttctgccagaagcggggaaatggatcaggtgatggcgattgaaaatgggggagacgattatatcgaaaaaccgttttcttatgatattgtgcttgcgaaaatcaaaagccagatccggagggcgtacggggagtacgccgcaaagcagggagagaaagtggttgaatatgccggcgttcagctctttgtggaacggtttgaactgcgttttcaggatgaaaaaagtgagctttctaaaaaagaaagcaagcttttggaagtgctgcttgagcggggagaaaaggtgacgagtcgggaccgtctcatggaaaagacgtgggacaccgacatattcatcgatgataatacacttaacgtgtatatcacgcggctcagaaaaaaactgcgggagctgaatgcgcctgtttctattgaagcggtgcggggcgaaggctaccagctgagggcgcagtcatgaagctgtttctccggtctcatgcagtgctgattctgctttttctccttcaagggctgtttgtcttcttttattactggtttgcgggtcttcattctttttctcacttgttttacatattgggcgtgcagcttcttattttggcgggctatcttgcctatcgctggtacaaagaccgcggcgtgtatcattggctcagctcggggcaggaagggacggatatcccgtatctcggttcttcagtgttctgttcagagctgtatgaaaagcagatggagctgatccggctgcagcaccagaagctccatgagaccgaagccaagcttgacgcgcgggtgacgtatatgaatcaatgggtgcaccaagtaaagacgccgctgtcggtcattaatttaatcattcaagaagaggatgagcccgtttttgaacaaatcaaaaaagaagtccggcagattgaattcgggctggagacgcttctttattcttcaaggctcgacctgtttgaacgggattttaaaatcgaagcggtttccctgtccgagcttctccaatcagttattcaaagctataaacgattttttattcaatatcgcgtttatccgaaaatgaacgtttgcgatgatcatcagatttacaccgatgccaaatggctcaaatttgcgattggccaagtggtcacaaatgcggtcaagtattcagcgggcaagagtgacagacttgagctgaatgtcttctgcgatgaagacaggacggtgcttgaagtcaaagattacggtgtcgggattccctcacaagacatcaagcgggtgtttgacccttattacacgggtgaaaacgggcggcgtttccaagaatctacgggaatcggcctccatctcgtcaaagaaattacagataagctcaatcatacggtggacatcagctcgtctcccggtgaagggacatcagttcgattttcatttcttacaaaaatgtaaggctgcgttaagaaaacaacatagcccgctttgtttccccttgataacatggatttatgtcaaggggatttttatgttgaacgtcccggcactacatgaaagcagcccagatcaacaagaataaaaccataaggaggattttcatggcgaatatgcttgaagtcaaacatataaataaaacctataaaggacaagtgtcctatcaggccttaaagcaaatttcattttcaatagaagaaggcgagttcacggcggtgatggggccgtccgggtccggaaaaacaacgcttttgaatatcatttcaacgattgaccgtccagattcaggcgatatcctgattaacggagaaaacccgcatcgcctgaagcggacaaagctcgctcatttccgccgcaagcagctcggatttgtgtttcaggatttcaaccttctggatacgctgacgatcggtgaaaatatcatgctgccgttaacgcttgaaaaagaagcgccgtctgtaatggaagaaaaactgcacggcatcgcggcaaagctcggtatcgaaaacctgcttaacaagcggacgtttgaagtatccggaggccagcgccagcgggccgccatcgcaagagcggtcattcataagccgtcactcattctggccgatgaaccaactggaaaccttgattccaaagcgacaaaagacgtcatggaaacgttgcagagcctgaatcgggatgatcatgtcacggctttgatggtgacccacgatccggtttcggcaagctactgccgccgcgtcatctttataaaagacggcgaactgtttaatgagatttaccgcggggaaaaccgccaagtattttatgaacaaattctcgatgtgctgtctatgctggggggaaacgcaaatgacctttcttcagttcgcttataaaaacgtcacgagaaacaaaagggcctatcttgcattctttttaagcagcgccttttccgttttgattttctttacctttgcgatgttcctgtttcatccggcattaaaggaaggctacctgaataacatcgccaaaaaaggcttaaccgccgcggaatggatgatctttgttttttctttcttatttgttctgtattcggttaatgcatttttgaaatcgagaaataaagaattcggcattctgctcatgcagggcatcacgccggggcagctgagaaagctcattactgcggaaaatatgatcatcggcgtcatgtcaattgcagccggtattatcggaggattcattttttcaaagacgttctttacggtcggcgcttatattttagaaatggacgcgctgcctttgtatatgccttggaaagcgctcggtattacggcctgcggatttctgctcttatttttctttttatcgcagtttacgatcctttttgtcagatcaaatacggttatcaaattaataaagggcactggcaaggttaaaccggagcctaagccgtccgtgcttctgtccttattcggcatcgcctgtctgtgcggcgggtacggcatggttcttaaaggcaatgtccacggggccgaaccgtttatcattttactgctcaccgttatcggaacatatttctttttcagccaaagcagcatatggattctgcgcgcgctgaagaagtggaaaaccttttatctgcgcgggaaaaacatcatttgggtttctgaccttgtctatcgtctaaaagacaacgcccgcctgttctttattgtcagcattatttccgcggttgcgtttactgcgacaggcgtgctcgcaatgtacaaatcgaccgtcggagcggaagagtccgcttatgaaatggagtatttatcttacagcaacaatccaaaagaacagactcatttgaaagatattgaccatgaactgaaaacacacggttttacgtatacgaaagacaaaatagatgtttcctatgttcgctatcaggaaggagaaactgttccccctgtttacatgatcagtgaatcggatgcggcaaaatacttccatgtcaaagtgaacggcctgaaagaagacgaggctgtctatttcccgggaacgtatgaccgcaatttcaaaaacgaagcgccggatcagctgaagctgctgaaccaaaaaggggagctgtctgatcaaaaactgtcggtaaaagaagtcaaaaaaccgctgatctcattgaatgctatcatcgcggtgaatgatcaaacctttgatcagctgaaatcactcggtgataaagcgtcattatacggctacagctatgatcattggaaagacagtcttgagatcagccaatccttgcaaaatgagatttacggcaattatatcgacgtgcattctgattttgcttcaaaagcggggacttactatgatacggtgcagctgccgagcctgagtctatttatcggcctgtttatcgcaattgtattctttgtcgcggcagcaagtttcttatatttcaggctgttcactgatttagatgaagaccgggagcgctaccgttcactggccaaaatcggcctgagtgagcgagaaatggcgcaaagcgtgacaatacaattggcgattcttttcttctttccatttgtcattgccgtcatgcatacactgtttgccttgagaacattggctgtggaaggatattccgatgtagcggggccgctcagtctcaccatcggagggtttttcatttttcagcttctattcttcctcgcggtgcggtcaagctatttgaaaaaaatgaacaagtaaggggagtgcaaagatgaaaaaagcaatggcaatcctggccgtcttggcggctgctgccgtaatatgcgggcttctcttttttcataacgatgttacagacagatttaatccgtttattcaccagcaagatgtctatgttcagattgatcgagatggcagacatcttagtccgggcggtactgaatatacattagacggatataatgcatccgggaaaaaagaagaagtgacctttttcgccggcaaagagcttcggaagaacgcgtatttgaaggtgaaggcgaaaggaaagtatgtcgagacttgggaagaagtcaagtttgaagatatgccggactccgtacagtcaaaattaaagtgaatcataaaaaacggcacagcgtcatgactgtgccgtttttttatttttattttcttcggcccgtttgatcagcatgtcggtgatgatatccacctgtttgctgacagaaatcgggtcgtacgggtagaacgagtcaaagtcattgataaacacgcgattatgtttaacagcgtcaagatttttccaaatggaggaattctccagcttgtcgagtgttttgctttcgcctttcgggttgtaatccgtaatgaacatataatctgcggcatactcaggaataacctcttgagagagctgtttcatctctccttttttgatgacatcttgctcaattttttcaggcgcttttaacccaagtgcattgtatacagcttggccgccgcgtccgccattgtcattgaacacccagaattcgcccttgtctgtgttttcataaatgccgaaggttgcatctttgtcgatgacgccggcaattttcttcttagctgcttccgcttttttgttaaagtcagccataaaggattttgcttggtctttcgctccggcgatatctccgaacatgctgactgtgtcttctacgtttttcgctgtgttataaggtatgacaacagtcggagcgattttctttaatttatcaacattctcttcattcatgacaacaattaagtcaggctgaagctccatcactttttcaacgcttattggatcaccaacatccttcacatttttcagctttgattttaaaaacggattatcaaatgaccatgagcctgagccgaccacattggccccgacagacagcaattcaccggcataaaaatcagtgacgatgcgtttcggatgtgcaggaatgttgacgttcccttttggtgatttgtatgttctcatttctgttttttcggaagcagaatcgcttgagctccctttagaagccgtgccgctgcaagcgctgacaaacatgagaagcagcacaagcatgcccacgagcaatatgttctttttcatcaagaaccctcccactatgtatctcaatagattagtaatgattatcattatcaattaataatatagcaagaaacctgttctccgtctatcactatttttaagggagaaagtttttcccgtttatgggtgacgcggtgtgcctaatcgattattataggtaaataggaggagaaaaatatgggaattacaaaaagaggtgccgcttgggaatggctgcatagctggtggatgctgtttattttcatgccttttgccattaccagtttttttgcctttttatttattggcatcaaggttagaaatagaaagtggatcatgtacggcatcatttattttttcatttttgcgtttggttttgttttgcccgatctgcccggtgtttttattgtggtcccgttatgggcggtaaccattattcatggatttaaagtgcgcccgctgtatttgattcagctggatgtctacaaagatcatgtggaggcgcgggcttttgccgaggcaagaagtgaagccgagagcagatttcatgcaccgaaacagtctattcaggatatacatattcgcaaagaacagtaagaaaaaagctcaacactcgcattgtgttgagctttttatatgttactgctggtaggattgctgctgaaatgtcgtgttttggccgaatggaagtgtagacacattcgtattcatgacgctggattgtccagtaagttcctgttgcatttggttgcacatgttgacaacctgctggcacttttgaatcgccatgtcatgcccgtgcagtgcttgctgaatggtatgtgcagcttgttgttcgtggtttagaatctgctgcagcatttggatgttttgctgttcctgatgaagcatttggcgatattgctggctgctttgctgtgtttgctgaatgagctgctgagcagtttggcggcattggttcagctgctgcaagccgtgttgtgtattatgcatgaatgatccctccatgtatcgattgacgtgagtcggtattatcatgcaacttgaatgaaaagaaattccgtcaaagaggaactacaattattttcctcagcccctctatctttgaatgaaaacggtaaagattgtatactgggtacaaaccctttttatgtaaatgttccgttttaacatataagaaatgcggaaaacgaaaccctgagatgggagaatcgtattccgcttttttctttgtttcgctcagaaaccgccttcccctgcagtaaatgggatattcagccggttttctactgtacggaggcgctgattgagccgatttaggcggcgtgtatggcgttcaacagcctggcttaactgattgacctgttcggcaatccgtgcaatttcccgattttgacggcggtcttcgtttgtcagacgggttaattctcttgactgctgttcattttgccgttcaagtgctgcgattcttctttccaatgccggctgtctgtccatttggtatggatcgtatacatcctgctgcggataaggattgtactcatagtggctatagtaaggttcctgctgaggcagctgagggctgtaatattgataagggttcatgtgatcagtctccttgtgggtgaattccttataacttatgtagtcattggcacagtggcacggcattcgcccaaaaaaggaggaaagaatggtgatccccttgagaaacaaatatggcattttgtttttaattgctgtatgcatcatggtatcgggctgccagcagcaaaaagaagagacgccgttttattacggaacgtgggatgaggggcgtgcccccgggccaacggacggtgtgaaatcagcaacagtcacatttaccgaagacgaggttgtggaaacggaagtgatggaaggaagaggagaggtacagctgccttttatggcatacaaggtgatttcccaaagcactgacgggtctatcgagattcagtacctcggcccttattatccgctcaaaagcacgctgaaaagaggagaaaacgggacattgatatgggagcaaaatggacagagaaaaacgatgacaagaatcgaatcaaagaccggcagggaggagaaagatgagaaatcaaaaagctgaaagactggtggcagcggggcttgttttacatatcattcaatggatatttatattatgggcttttctcaaagtcaaacatttatttagtgactatacgatctataaccctaatgtcatcagcggctccatgcagtccttatcgtttatacaaatgatgcgcgctatgatgtactcaggggcaatcgtgaattatgttttgttttttgcccttgtattgctgatttatggcatagtgcttcatgccatcctgatcgttctggaaatggcggcttacgtcatgatcagacggaatccatcatcttcatgggggttctttttcatcgcggcgggtgtgaagcttgccatcttgaatataaccggcattccttttctagctgccggctttctgctgatgaaacagaaaaaagcagaaaacggcgtcaaggcagaaagaaagcggaaaccgcgcttgcgtatccgaagacaagggcggcgtctaaacagaatccggagaaaaccatctcttccggttgaatatcaaaaagaaaaaacgatatgatgggactatagcctgaaaacgacatgaaggagatgcaggatgtacaaactaattgcaattgatatggatggaacacttttaaatgatcatcatgaagtaacagaggaggtccgcgacgcccttcacgcggcaaaagcggaaggtgtcaaaattgtgctttgcaccggccggcctatcgggggtgtgcagagatatttagatgaactgaatttaattgaagaaggcgactatgttattgcgtataatggagcacttgttcaaaatacgcatacaaatgaagtggtctcagagctgtctctcggttatgatgatttgacttcattatatgacctgagcttagagctgaagacgccgatgcatttctttgactcatctaatttgtatacgcctaaccgggatattagcgaatttaccgtatacgaatcctatgtgacacaggtgccgcttcatttccgcaagattgacgaggtgccaaaagatatcctcatcccgaaagtgatgtttattgataaaccggagaacttaagccgcgtcattacatcgattccaaaagacgtgagagaaaaatatacaatggtcagaagcgcgcctttcttttatgaaattctgcactcggaagccagcaaaggaaatgctgtacgccagctggctcagctgcttggaattgaacaggcggaagtcatgtgcataggcgacaacgggaacgacctgacaatgatcgaatgggcgggctgcggggttgccatggcaaacgccatcccagaagtattggaagcagcaaactttcaaacacgctccaataatgaacatggcgttgcacatgcgattcacgagcttgttttggctaaataataaaaaatccagccttctaaaggctggattttttcgttttatttgatgtaatgtcaattctttgacgaatcgatttgactttcgttatgctgataaaaccaattcgttcacaatatgtatgatattaatctgaattgaaaaggggactgatcaaatgtgcacaagtcttacattggaaactgctgaccgtaaacatgtattagcaagaacaatggattttgcatttcagctggggacagaggtgattctctatccgcgccgttacagctggaacagtgaagctgacggaagggcccatcagacacagtacgcgtttatcggtatggggagaaaacttggaaatatattatttgccgacggcattaatgaaagcggtttatcttgtgcggcgctttattttccgggctatgcggagtacgaaaaaacgatacgggaagataccgttcacattgtcccgcatgagtttgtgacatgggtgctgtcagtctgtcagtctttggaagacgtaaaagaaaagattcgatctttaacgattgtagagaaaaaattagatctattggatacagttttaccgcttcactggatattgtcagaccggacgggccgaaacctgacgatagaaccaagagcagacggcctcaaagtctatgataatcaacctggtgtcatgacgaacagccccgactttatatggcatgtaaccaatctgcagcaatatacaggaatcagaccgaagcaattagagagcaaagagatgggcggattagccctttctgcttttggccaaggcttaggaactgttggtctgccgggggattatacaccgccttcccggtttgtcagagctgtttatttgaaagaacatctagagccggcggccgatgaaacgaaaggtgtaacagccgcttttcaaattttggcaaatatgacgataccaaagggcgcagtgataacggaagaagacgaaattcattatacgcaatatacttccgtgatgtgcaacgaaactggaaactactatttccaccactatgacaatcggcaaatccaaaaagtaaatttatttcatgaagaccttgactgtttggagcctaaagtgttttccgctaaagcagaagagagtattcatgagcttaattaattcacatcaatcagctgattccggtttgaatatctggagtcagctgtttttttatacaatcgttacggcgtctgaatggataggcggtttgcaaaagcgaagaaaaggcaaaggaaatggcgaaatcttatatgaaattattggaagaaaactgagtctttgcttcattagactcagttttcttgccgatatagaggttgcactagttgaatgaatcaatgccgttccctcatggtcacgcaagggtcttttcgcttgaatagaaaaaattaatcttaactcattgacaaacgtccaagacaaaggtacattttgatttattcatattaaacgactaggaatataggagtttatttttcggattattcagcctaaaaacatgataaaaggagtatcgccatgacaagcaaaaagaaacaaatcaaattaggggtatttttagcaggtacaggccatcatgttgcgtcttggcggcacccggacgcgccgtcagatgcgagcatgaatttggattattttaaagagcttgcgaaaacagcggagcgaggcaagctggatatgctgtttttagcggacagcctttcaattgacagcaaatcacatccaaatgtattaacaaggtttgagccattcaccctgctctctgctttggcgcaggtcacatcaaaaatcggactgacagcaacagcctccactacatacagcgagccattccatattgccagacagtttgcgtcattggatcatctgtccaatggccgtgccggatggaacgtcgtcacttcatctattgaatcaacagcgctgaatttcagcggtgaaaagcaccttgaacaccatttgcgctatcagcgggcagaggaatttgtcgagattgtaaaggggctttgggattcatgggaagaggacgcctttatccgtaataaagaaacgggtgaattctttgacaaagaaaaaatgcatgagctgaaccacaaaggagaatatttctcggttcgcggacctctaaacgtttcaagaaccccgcaaggccagccggtcattatccaggcaggatcatcaggagacggaaaagcgctggctgccaaaacagccgaagtgatcttcacagcacaaaaccacctggaatcagctcaagaattttatcaatccattaaagaacaggctgcggaattcggacgtgatccagaaaaaattgccattatgccgggtattttcccaatcattgccgatacagaagaagcagcgcaagccaaatacaaggagctccaagatctgattatcccatctgtcggtctgcaaattctccaaaattacttaggcggaattgatttgtcggcatatccgcttgatgggccgctgccgaagcttgacgccgaagcttccaatgcggtgaagagccgcttcaagcttgttcaggagatggctgaacgtgacaatatgacgatacgagagctttacaaatacgttgcaggctccagaggccaccatatcttcgtcggcacgccggagcagctcgccgacaagatgcaggaatgggtggatacgaaagcgtgtgacgggtttaacatcatgcctccgcttcttccagaaggaattgaagtgtttgttgatcaagtggttccgattttacaggagcgcggcgtgttcagaaaagaatatgaaggcacaacattacgagagcacttcggtttggaaaagccggtaaaccgctatgcaaagtaaggaggaacgctagatgaagccacgataccgccttgcagttgaacgtgatgccgaacagcttctcgagctgacattgcgggcttatgaaccgattcgaaagctcggcattcgttttgctgctgctcatgcggatttggatttggtgctgaaaaatattcgggaaaatgcttgctacgtcatggaagaagacgggcggatcatcgcgaccatcaccttgagaatgccttggggaaaacagccgggaccgtatggcgttccgcatatctggtggtttgctgtggaccccgacaccggtaaaaaaggaatcggaacaaagctgcttcaatggctggaggaaacaatccttcgcgatacgttaaaggttccgtttgtctcactcggaacagcggataagcatccgtggctgattgagatgtacgaacgaaaaggatatgtccgctcaggtgaacaagaccttggaaaagggcatatcacagtctatatgaaaaaacaattgcgacatgatctataaaaatagaaaaggcgggaaaatcaaatgaagatgaaaaaatggacagtgctggtcgttgctgcattattagcggtgctctcagcttgcggcaatggaaacagcagcagtaaagaggatgacaatgtgcttcatgtcggtgcgacaggacaaagttacccatttgcttataaagaaaacggaaagctgacaggctttgacgtggaagtgatggaagcagtcgctaagaaaattgacatgaaactggactggaagctgcttgaattcagcgggctgatgggagagcttcaaacaggcaagcttgacaccatttccaaccaggtagctgtgacagacgaacgtaaggaaacgtataactttacgaaaccatacgcttatgcgggaacacagattgtcgtcaaaaaagacaatacagacatcaaatcagtagacgatttaaaaggcaagacagtcgcagccgttctcggttcaaaccacgcgaaaaaccttgaaagcaaagatcctgataaaaaaatcaatatcaaaacgtacgaaacacaagagggtacgctgaaggatgttgcgtacggccgtgtagacgcttatgtcaacagccgaactgtattgatcgcgcaaatcaagaagaccggtttgccattaaagcttgcaggagatccgattgtttacgaacaggttgcattcccatttgccaaggacgatgcgcacgacaagctccgcaaaaaagtcaataaggccctagatgaattgcgtaaagacggaacactgaaaaaactctctgaaaaatactttaatgaagatatcacagtagaacagaagcattaagaaacggcggtgactcaccagaatgaacacgattgattgggaattcatgatatcagcgttcccgactttaattcaggcccttccgatcaccttgtttatggcaatagcagctatgatttttgccattatcggaggacttattctcgcactcattacaaaaacaaaattccagtgcttcatcagctgtcaaagctgtatatatcctttttccgaggcgtgccgacacttgtacagctgttcttaatctattacgggctgccgcagctatttccagagatgagcaaaatgacagctctcacagctgccatcatcgggttaagcttaaaaaacgcagcttatttggcagaaatcttccgggccgccctcaattctgttgatgacgggcagctggaggcgtgcctgtctgtcggtatgacaaaatttcaggcatacagacggattattttgccgcaagcgatccgaaatgcgattccggcaacgggcaatacatttatcgggctcctgaaagaaacgtcactggcctttacattaggggtcatggagatgttcgcccaagggaagatgtacgcttcaggaaacctcaaatattttgagacgtatttggcggttgcgatcgtctattgggttcttaccattatctacagcattttgcaggacttgtttgaacgtgccatgagcaagccataccggacttagaggtgaaatcagttgataacagtaaaaaatattcgcaaagcgtttaaagatctcgtcgtgctcgacggaatcgatctagaagtgaaacgcggagaagtggtggcaatcatcggtccgtccggttccggaaaatcaacgcttctccggtgcttaaatctattagagcgtccggatcaaggccttattgaaatcggagaagccaaactgaatgcggaaaagtttacacgcaaggaagcacatcggcttcgccagcaaacggccatggtctttcaaaactacaatctgtttaaaaataaaacggctctgcaaaacattacagaagctttaatcgtggctcaacataaaccacgcgacgaagcgaaacgtattggaatggagattctgaaacaagtcggtctggagcataaggctgacagctatccaatcacaatgtccggcggccagcagcagcgaatcggcattgcgcgggcgcttgcggtcaatccgcatgcgattttgctggatgaaccaacgtcagcgcttgaccctgagctcgtcacaggggtgcttcaggtcatcaagtccattgcggaaaaacaaacaacgatgatcattgttacacacgaaatggcgtttgcaaaagaggttgctgatcaagtgatttttatggcagacggccatattatcgagcagggaacgccagaggaactgtttgaccatccgaaaaacgaacggacgaaacgatttatcaagcaggtgggagagcctgcagagcttatataagaaggggagaagaacaatggccgacaaagcgtttcatacccgtttaatcaatatgcggcgtgatcttcatgaacatcctgaactgtcatttcaagaggttgaaacgacgaaaaaaatccgccgttggcttgaggaggagcaaatcgaaatacttgatgtccctcaattgaagactggtgtgattgcagaaatcaaaggacgggaagacggccccgtgatagcaatacgagcggacattgacgcgctcccgatccaagaacagacgaatcttccatttgcatctaaggttgatggcacaatgcatgcgtgcggacacgattttcatactgcttctattattggcacagcgatgttgctgaatcaaagaagggccgagctgaaaggtacagtccgctttatctttcagccggccgaagaaattgccgcaggagcaagaaaggttctagaagctggcgtacttaatggcgtttctgcgattttcggcatgcacaataagccggatctgcctgtcgggaccattggtgtaaaggaaggtccgctcatggcaagtgttgaccgatttgagatcgtcatcaaagggaaaggcgggcacgccggcatcccaaataacagtattgatccaatcgctgcagccggacaaatcatcagcgggctgcaatctgtggtcagccgcaatatcagctcactgcaaaacgcagtcgtcagtatcacaagagtacaggcgggcacctcgtggaacgtaattccagaccaagctgaaatggaggggacggttcgaacctttcaaaaagaagcgaggcaggctgttcccgagcatatgagacgagtggctgaaggaattgcagcgggctatggggcacaagcagaattcaagtggtttccttatttgccttccgttcagaatgacggcacatttttgaatgcggcatccgaagctgcggcacggcttggctatcaaaccgttcacgctgagcagtctccgggcggagaagacttcgctctgtatcaagagaagattccgggattttttgtctggatgggaacgaacgggacggaggagtggcatcatccggcctttacactggatgaagaagcccttacggttgcctctcaatactttgcggagctggcggttattgtattggagaccatcaaatgagcaaacaagggctgacagcaggtcttgcagaggctgtgagaacgtcacaacctgagcattcagttgacgcgattcacgaagcaaaaaagggattacttgattttactgccgcttcattcgcaggaagagaagataaaggaattcaaaagctcctccgtctgatagaggatgaaggaggccggccccttgttcctgttatcggacagggcaaaaaggccgcgccattacaatccgcgatgctcaatggatttatcgcccatgcattggattttgatgatgtccactccgatgtaagaggacaccccagtgcagtcatcgtaccggcccttattgcttctgccgctcgcggacatgacgagcggcttcttggcgcttatgttgttggtgttgaagtgatggcacggctgggagaatcaattggcagccgccactatgagaagggctggcataatacaggtacgcttggtgccatcgctgctgcctgcgccgtaggttatgctgaggagctgactcaggaagagttggaaaaagcaattggttttgcggctacgcaatctgctgggatgagggtgcaatttggaacagaaatgaaaccgctgcacgccggtttggcggctcaggctggcttgctggccgttaagctggcccaatcagaatttggcgggtcccgcacggcacttgatggagaaactggtttcttcagtctgtacggtgacgttgagaaagcacaacacactttgctaaacgattggggggcaccgtggagaattgtgcagccgggtctatggtttaaaatctatccattttgttccgcggcacaccatgctgcagatgcggtacgacagcttatctccgaagaaaccatttctgctgccaataccgaacgtattgaagtgatatttccgccaggcggagatgctgcattgacggaaagatctccaaaagctggagaggaaggccgtttcagcgttgaatatgtgattgctcttgctttgcatggacacggcctgaccgttgaacatttcagcagccagccgatcccaaacggggttcaaacgacaatggggcgaattcagcgcgtatatgacaatgctattcagccggctcctcatgccgttccaaaaggccgtttcacgattgtccgggcctatttatcagacggccggatttgcgaagcgcgtgtggactgcccaaaaggggcaccaggaaatgagctgtctgaagaagacataatagaaaaattgacattaacggtcccgcaagaaaaagcgcgacgcattataacagccgttgaaaaagccgatataaaagaatttttagctcatattgaataagatcaactctattcggtgatttcagatgatatgataaaaccaatcatacgtttgaaaaaggagaaaaccatgacggtgaatgacgcggttgtattcattttggctgcctttttactatggggagcagcggattattgtttgggaaacagatgggggctaggcgagcggtttgcggacggctttaaggctatggggccgctggcgctgtccatgatcggaattgtatcgctggcgcccgtgctggcagcaatcttgattcccattgttgctccgttttacacagcgattggcgcggatccttcttcctttgcgaacaccattttggcgattgatatgggaggatatgcgctggctggagaaatggcgaaagatccgcaggccgggctgttttcatgggtgtttttaggaacaatgatggggccggcaatcgtcttcacgattcccgtcgctcttggcatcatcgaaaaagaggatcatccgtattttgcgaaaggcatattaatcgggctgtgcacagtgccgatcggttgcttaatcggcggattatgcgcaggctttgacatcggcatgataggtaaaaatcttctgatcccgagtctgttatctgctgtcatcgcttttgggttatggcgatacaccgacagaatgattcagttgtttcatctcttcgggaaagcggtcagtatggttgcgattatcgggcttgcagctgtttctgttgaaacgatgaccggcattgtgctgattccgggaatggagaatgtcgagacagggatacaaacgacagggaccatcgccattgctctggcaggggcgttcccgatgacggcatttattacaaaaacctttaaaaaaccgcttcaggctctggggaaatgccttcatttagatgagacagcaacagcaggcttagtgacctctttggcgcatcatatcccaatgctggcttcattaaaggatatgacgccgagaggaaaggtcatcaatgtcgcgtttgcggtcagcggcgcctttgtactcggcagccatctcggttttgtagctggaatgaaaaaagaaatggcggcggccatgatcattgggaaattagcaggcggagtcacagctgccgcagcggctgcttggatgacacctgcacaatcagctaaacagcaaaaacgtatctcagccagccatagctgaggcaggagctgtttcaactttgttcaatcgggaatgttacagtaaagatttctgtgaaagagggttggacacatggcggtgaaagaccggtacatgtcaaaaataaaacaggaaaccaagccttggatcaaacgattcgggaggcttggttattttgcattcggcggcgtttttattctgcttggggttttggcttttatgacggctgccggggcaggccgcgccaaagattcgagcggagctctccaaacgctatcacgcatgccgtatgggtcactattgctttttttataggcatcggccttatcggctatgtgatctggatggtgttaagcgcgatcaaggacacggaggggcacggaaacagcaggcgaggcctgtcgcggagaataggaaactttttcagtgccgctgtttacacatccatcgcttggaatgccttgcgatttgtgtttggccaaggggacggcggcacttcagaacagacgtggtccgcttatgtattggcgcagccgttcggccaatggctcacagggcttacgggtgcgggttttatcgtatttgcgattgttcaatttatgaaaggcgttcgggctgcttttatgaaagaattcgatacatcaaaaatgaacaaacagatgatatgcatcacgaaaaacacaggacgcgcaggcaatatcgcccgggccattattttctcggctatcggctattttctcatcaagacagccatgaccgctgatcccgacgacacaagaggctttgacggcgcgctcgcagaactcgcgcagcagccgcatggcaaattgattctgtctatattggcattaggcctgatcctatatggaatgtacgccattatgaaaggcatttatcagcatatgacttgggagaagtaagctctgggcaggtccgcgcccagagcgtttttcagtttcttagaaatcaggtggatgaaagccggcgccagcctgtataataaaagcaaatcaaaagcagttttatcaggactgatccacagggaggtgcagaatggatcgggaaaaacagcaattaagcatagaagcggcaaggctttactatcagtctgactacagtcagcagcaaattgctgagcagctcaacatttcaaggccaaccgtttcccggctgctgcaatatgcaaaggaaaaagggtatgtccagattcgcgtcatggacccttttgaggatttggatgcgctcggttccatacttgaagagaaatacgggctccttgaggcgcatgttgtgttttccccgacacccgattatgcaggaattacacatgacctaagccgctatggtgcagaatatatgcatgaaacggtaaaagacggcgacattgtcggcgtcagctggggaaccaccatgtatcaaatcgcgcaaaacatgcagccgaagcaggtaaaaggcgtcgaggtcgtccagctgaaaggcggcatcagccattcccgggtaaacacgtattcggctgaaacgattcagctgtttgcagaggcttttcaaacgatgccgcgctatctcccgcttcccgtcgtgtttgataatgcggatgtgaagcgaatggtggagaaagaccgtcatattgaacggatcattgagatgggcaagcaggcgaatatcgctctctttacggtcgggactgtccgtgatgaagcgctgttgtttcggctcggatattttaacgaagaagagaaagccctgctgaaaaaacaggccgtcggggatatttgttcacgcttttttgatgcgaaagggaatatttgcagcagcgccatcaatgaccggaccatcggtgttgagcttcaagaccttagactgaaggaacgctccattttagttgccggcggaagcagaaaagtatcttccattcacggagcattaaccggaaaatatgccaacgttttaatcattgaccagcataccgcgagggcgcttgttaatgatttgtgacacgttcaaacctttcattgaacaaaatttcaattaccaatttacatatgttcaaaagtcggttatgctaaaaaatatcttaacaaaaaaggaagtgtgcgaaggatgtcattagccaacataattgatcatacagctttgaaaccgcatacacaaaaagcggacattctaaaactaattgaagaagcgaaaacatacaaatttgcttcagtatgtgtcaatccgacatgggtggagcttgctgcaaaagagcttaagggaactggagtcgacgtttgtacggtcatcggcttcccgctcggtgccaatacaactgaaacaaaagcgttcgaaacaaaagacgccatttcaaaaggcgccactgaagtggatatggtcattaatattgccgctttaaaagacaaggaagacgatgtggtggaagctgatatccgcggtgtagtggaagctgtagccggaaaagcgcttgtcaaagtcattatcgaaacgtgccttctgactgatgaagaaaaagaacgtgcatgccgtttagcggtgtctgcgggagcggatttcgtaaaaacatcaacaggcttttctacaggcggcgcaacgaaggaagatatcgccttaatgcgcaaaacagtagggcctgatatcggcgtgaaagcatctggcggcgtcagaacgaaagaagatgtagacacaatggtagaggccggagcaagccgaattggcgccagcgcaggcgtttctatcgtaaaaggagaaaatgcatcaggcggagacaactattaagagctgacggaaggcagactgctttccgttttctgaggaaacagtaattgtaagcgaatacaaataaaggagaaacacatatgaagtatttgattgggattatcggtttaatcgtgtttttaggcctcgcgtggatcgcgagcagcggcaaaaaaagaattaagatccgcccaattgttgttatgctcattttgcaatttattcttggctacattctcctcaataccggaatagggaatttcctcgtgggaggatttgcaaaaggattcggttacctgcttgaatacgcggcagagggaattaactttgtgtttggcggcttggtgaatgcggaccaaacgacattctttatgaatgttctcttgccaatcgtgtttatttccgctctgatcgggattctgcaaaagtggaaagtcctcccgtttatcattagatatatcggccttgccctcagcaaggtaaacggtatgggaagattggaatcgtataacgcagtggcttctgcgattttagggcagtcagaagtatttatctccttgaagaaagaactcggtcttttaaatcagcagcgcttgtacacgctttgcgcatctgcgatgtcaactgtatcaatgtcgattgtcggtgcgtatatgacaatgctgaaaccggaatatgttgtaacagcgcttgttttgaacttatttggcggtttcattatcgcttctattatcaatccgtacgaggttgcaaaagaagaggatatgcttcgtgttgaggaagaagaaaaacaatccttcttcgaagtgctcggagaatacattcttgacggtttcaaagtagcggttgtcgtcgctgcgatgctgattggatttgtcgcgattattgcattgatcaatggcatttttaatgcagtattcggtatttcgttccaaggcattcttggatatgtgtttgctccattcgcttttcttgtcggtatcccatggaatgaagctgttaatgcgggaagcattatggcaacaaaaatggtatcgaatgaatttgtcgccatgacgtcgcttacgcaaaacggtttccatttcagcggccgtacaacagcgatcgtatcggtattccttgtgtcatttgcgaacttctcctcaatcggaatcattgccggtgccgtaaaaggactgaatgaaaagcaaggaaatgtcgtcgctcgtttcggcttgaaattattatacggtgctacgcttgtcagctttttatcagcagcaattgtgggcttgatttactgaacttaatcgaaaaggatcggtgaccaaacatgagaatggtagatatcatcatcaaaaaacaaaacggaaaagaactcaccactgaagaaattcaattttttgtgaacggctatacagatggaagcattcctgattatcaggcaagcgcgcttgctatggcgattttcttccaggatatgagtgaccgtgaacgcgcggacttgacgatggctatggtgaactccggtgaaacgattgatctttctgccattgaaggaattaaagtggataaacactctaccggcggcgtcggcgacacgacaacgctcgttctcgctccgcttgttgcggctcttgatgtgccggttgctaagatgtccggccgcggcctcggccatacgggcggcacgattgataagttagaggcaatcatgggcttccacgtggaactgacgaaggatgaatttattaaacttgtgaaccgcgacaaggttgcggtcatcggccaaagcggcaatttaacgccggctgataaaaaactgtacgcgcttcgtgatgtaacgggaacggtcaattccattccgctcattgcaagctcgattatgagcaaaaaaatcgctgccggggcggacgccatcgtgcttgacgtaaaaacgggagcgggcgccttcatgaaaacagaagaagacgcagctgaacttgccaaagcgatggtacgcatcggaaataacgtcggccgtcaaacaatggctgtcatttcagacatgtcccagccactcggctttgcgatcggaaatgcgcttgaagtcaaagaagcgatcgacacgctcaaaggcgaggggcctgaggatcttcatgagcttgtcttaacgctcggcagccagatggttgtgcttgcgaaaaaagccgatacattggacgaagcgagagcgaagctggaagaagtcatgaaaaacggcaaagcacttgagaaattcaaggatttcctgaaaaaccaaggcggcgacagctcaattgttgacgatccgtctaagcttccgcaagccgcatatcaaattgatgtgcctgccaaagaagcgggtgtcgtctctgaaatcgttgcggacgaaatcggcgtcgcggcgatgctgttaggtgccggtcgcgccacaaaagaagatgagatcgatttagccgtcggcatcatgctccgcaagaaggtcggcgacaaagtagaaaaaggcgaaccgctcgtgacgctttacgccaaccgcgaaaacgttgatgaagtcatcgcaaaagtctatgacaacatccgcatcgccgcggaagcgaaggcgccgaagctgattcatacgttgattactgaataaaaaaaagcacatcccatcctgagtggggtgtgcttttttgattacaggatgtgatcagcctgatattcctcttggctgatttttttcgcttttgtaacatttcttttgaaatggtagatcagatagcaaaggatgatacaaggaactccgcagaaaagtgcgattctttgattgggatcaaaagcaagaccgatacaagaagcagaacataataagagagcggctataggcataagaggataaagcggcgtgcgaaatgtcagatcttttacattccccccttttttcagaaatctctttcgaaacaagagctgggacaaggcaatgctcatccagaccacgactcctgcaaatccagcaattgcgaccatcaccacatagacagttccaggggccacgatactggaaacgagagataagcaagatacagccatactgatcattaaggcatttaaaggaatgcctttagaggtcactttcttaaaacgggaactgatcatgttttcatttgctaacgaccacatcatacgggtcgaagcatataagcctgagttggcgacagacagcaaggctgttaatatcacgaaattcataatatcagcagcgtaagggattccgatctccgcaaatacggcgacaaacgggctttcaatcacgcctgcgtccttccacgaaatcaacccggataatatgaagacagcgccaatgaaaaaaatcacggttctccatgcgacattacggatggatcgcggtatatccttttgaggatttgctgattctcctgctgtaacgccgattaactctgtaccggaaaaggcgaagctcacagatatcatcgcgataaaaacggcgagaaagccatttggaaacaacccgccatgatctgtgaagtttgacaacataggagcatccgccgttccgtttaaagagatcaggccaaacatggcggctcctcctaaaatgataaataaaataatggtgacaatctttacgctggaaaaccaaaattcagtttccgcaaataacttaactgaaaatgcgttgcatataaaaagaagggctgcaaaaatcgcactccacatccatacactgctgtcagggaaccagcgctgcatgagaataccggatgcggtaaactcagagcctaccgtcaccacccaattgatccagtacatgatgccgaccataaaaccggtagatggaccgataaatgttgtagcatatttttgaaaagagccggtcaccggcatggcaaccgacaattcgccgagacattgcatgacgaggtacatcatcaacccgccgattacataagcgagtatcgtaccgccgggtccggcttgatgtagcgtatagcccgtactgaggaaaagtcctgtgcctatgacgcctcccaatgagatcataaataggtgcctgcttttcattgtgcgttttagctgttggctgctgttctcctgaagattcactgtctcgccctccttttagctgccattccttaggcagatgagtttcttatacccaaaatacaacctgccagaagatcacttgaatggggagagtttcattccttttaatgcgtgtaacagaacatgagctgcagctctgcttgtcatatctcgaaaatcgagggtaggatcgacttcaacaatttcaatcccggcaatattgggctgttgtgcgatgtacttgactgcttcaagcaattcgtctgtatagaggccgcccgggccaatcgctggacagccgggtgcatgggactggtctaagacatccatgtcaacagatataaaaatgaaatctgttctatcttgaacaacaggcaaaatctcttttatcgttgggattagtcctttttcgcggatcatgtccatcgtgtgaatgttcacgctatgtttttttgcatatgcttcataggcctggctgttgctgaattctctgatacccagctggatcaaatgttgaccttcaatgatctcttcatccaaaaggcggcggaagggggtgccgtttgtcggccccccgtcctccgtattgcgaacatcgtgatgggcatcaaattgaatcaccgctgtcgttccttttgtttgtgctatcgcttttattgtggagtagctgatagagttatctcccccaagtatgagcggcacccaatccggatgatccgaaagcagagcgtgcatggtttggaaaatgtgatgatgtgactttacgatatcagtgacatgaatatcgatatcccccaggtcatatagaagctctgatacgacgtgctctccaagctcagcagaataggctgatgaatgtttcagagcctggcgtattgttccgggtgcaaaggaagcgcctgaatgactgatggaggattttgatagggggacacctatcaacgccggtcccttaatgtcctggccgtcccatgttgcgatcaggtcgctcatttttgtgacatcccggtctttaaacgaagatccggcctctctgagaaaagggtacttatccaagaatggctccctccctgttgacaacaattgttccatttttcatgacttgatgtacatgattgaccccgtagtgatacggaatatacatatagttcggggcttgccaaatgacaagatcagctgagcggccagctttgagctgaccggcttcttctccttttcctatggcatatgcggcattgactgtgaccgcgtgccatatttcttctgcagtcattttcagatgaagcgcggcaatggacataatcagctggatattttcagtcggcgagctgccaggattaaaatccgttgccaagctgacacatacaccttcatcaatcatagctcttgccctggcgtatgtgcttttgccaagataaaatgtcgtgcccggcaagaggacggcgatcgttcctgcctcagccaatttctttatgccttcgtccgatgtacctaccaaatggtcggctgagacggcctttagcttacctgctaattcagcacctccaagcggatcgatttcatctgcgtgtatttttaatccgaagcctgcctcagctgctttttgtaaataacggcgggattggctgactgtaaaaacgcctgtttctgtaaaaatatcagcaaagctggcgagctcctgctctttgatttccggcaaaagggaaagcatttgatccagaaaatcatctggatcgttttgatattcgggaggaatcgcatgggctcccataaatgtggaaacaaggtcaacaggctggctttcatgcagtttctttgcgacacgcaactgtttgagctctgtctctttttccaagccgtagccgcttttcacttctgctgtggttgtgccgtaggacagcattctttgcagatgaaaatgggctttttgcagcagctcttcttctgaagccgccctggtatccttgactgtagacagaatcccgccgccctgcgccagaatatccaaatatgaaatgccctgaagcttaaggttcatctccttttcacgagatccgccaaatacaagatgggtgtgcggatcaacgaggccaggcgttacaaggcgtcccgaacagtcaatgatttcgtctgcctcgtaaccggcttcagcccctttttgtccggcgaacacaattttctgttcatggatgccgacaacagcgtcttcgatcacatgaagatcctgcatgcttttgcctgcccgcggaccgctgctttccatcgtcaaaagctgaccgatgttgatgagaatcgtatcaatttgctttggcatgtcatcactcctttatttttgcatcggcacgataatgtcctgttccttcgctacttcaacggcacgttcataacccgcatccgcatgacggataatgcccattcctgggtcgctcgttaagacccgcgcgagccgctcgtcagccagctcacttccatcggccactgcaaccatgccggcatgaagggaatagcccattccgacgccgccgccatggtggaaggaaacccagcttgcacccgccgccgtgttgacaagcgcatttagcacagcccaatcaccgacagcgtcacttccatccttcatcgcttctgtttcccggtttggagaggcgacagacccgcagtccaaatgatctctcccaataacgacaggcgcttttagctccccggttctaaccagctcgttaatggcgaggcccatcttttttcgttctccatatccaagccagcagatacgggacggcaagccttggaaggtgactttttcctgtgccatatcaatccagcggtgaagggctttatttgtcgggaacagctcttttaataacgcatccgtacggtaaatatctgccggatctccggaaagcgccgcccagcggaacggcccttttccttcacagaataaggggcggatgtaggcagggacaaaccccggaaaatcgaaggcattctccagcccttcatcctttgcgacttgccggatattgttgccgtagtcaaatacaatagagcccttttgctgaaaggccagcatggcttcgacatgttttttcatgctttgcttcgcaaggcgcacgtaaagctctggagtgtcttgacgcaaacggtcagcttcatcaagggaatagccctcgggaacataaccgattaaagggtcatgggcagatgtctgatctgtcacaatatcaattttgacgcctcggttcaaaagtgtgtgatgcacctcagctgcgtttccgagaagtgcaatggacaaaggttttcctgccagctttgcctcttcagcccaagctaaggcttcctcaatcgatgctgtttttcgatcgcagtattttgtttcgatccgcttgtcgatgcgtttctcgtcaacctcgacggcaatcacgacgccttcattcatcgtgactgacagcggctgggcgcctcccattccgccgagacccgctgtcagcgtcaacgttccttttaagctgcccccgaagtgctgtcgcgccagctcagcgaaggtttcataggttccttgcaatatgccttgtgagccaatgtaaatccagctgccagccgtcatctgtccgtacatcattaacccttttttctcaagttcgtggaaatgctcccagtctgcccacttcggaacaagaacagaatttgctaggagcacgcgaggggcctgcgggtgtgtacggaacatgccaacgggctttccggattgcacgagcaatgtttcatcattttttaatgttttcaaggaatgctcaatggcgtgaaaagcgtcccaatcccgtgcggctttgccaatcccgccatatacgatgaggtcctccggcttctcggcgacttctggatcaaggttgtttcgaagcatccgaagcactgcctcttgctcccatcctaagcattcaagctctgttcctctgttggcacggattgatttttttacatcagtcatatgttcatcccccttagttctttattctgatgatcaggtattaaagattctttcttcagccagtcagtcaagcgttcaatgtcataggaaaaaacacggtcctgctgaatggacggcacgacttttctcatttcttgaaaaagctgtttcgtataggacgctgcatgttctatgcctctgtattcaacagcctgcaatgcgcaaatggcttcgatcgcaatgactctccttgtatttgcgatcacctgataagcatgccgagcggcgatggttcccatgctgacatggtcctcttggttggcggatgacggaatggaatccacacttgcaggatgggccagtgttttattttcagaaacgagtgaggccgcggcgtactgcatgatcattgcaccggattgcagaccgggatgagggctcaggaacggcggcaggtcattcagctgcggattcacaagtcgttcgatcctacgctctgcgatattcgcaagctctgatattgcgattttcagaaaatccatggcaaaggcgattggctgtccgtgaaagtttccgccggaaatcactttgtcaccgtcattgaaaatgagtggattgtctgtagctgcgttcatttcaatctctaatttttctttgacatatcctagtgtctgccaagtcgcaccgtgtacttgcggaatacagcgcaatgaataggcatcctgtacccgcagttctccctgggaggttgtcaggccgctgtcagatagataaaagcgaattcgttctgcgacatcgatctgctcctgatagccgcgggctaagtgaatatcctcgtcaaatgcatcgataattccctgcaacccctcaatcgttaagctggcaattcgttctgtttgataggctagtttctcagcttcgatgtaggcgaccacccccattgcagtcatggcctgagtcccgttaatcaaggcaagcccttccttggatgtcagcgttaccggttgaatacctgcttttttcaagcctgtcattgccggcattctttccccctcaaaaaagacttctccttgtccgatcagcgcaagcgccaagtgggaaagcggcgccagatctccgcttgcgccaagtgatccttgctgagggatgacaggatggacgcgtttatttaaaaaagcaagcaactgctcgatcagctcagcgcgtacaccggaaaagccttttaacagcgcattggcgcgcaaaagcagcattgccctggaaacacactcaggaaaagggtcgccgactccgcaggcatgagaaaggattaaattcagctgcagcgccgccgagtcttctttctgaatcaggacatcgctgaatttgccaaatccggtgttgatgccgtagattgtcttttcgtcgcgtacaatccgttccactgctgctctgctttttttcacgcgctccatactttcctcagaagccgctgcctcctcaaaatcaaacagcacacgagcgacgtcggctgttgtcaatgaagaaccgtctaaagtcaccataagcccaactcctttttctttactttggtaaagcgcccatacaaaaaggagctatgctgtgaacttctgttttcacgcatagccccctatcgtctaagatctatgggctgtttcatatgtgattaattccaacgccgaatgtttcatgctcaagacctttaatcggcgccccgattgttccgtaaagcgagacagcgatccaatcgccttccgcttcactttcataaggatttcccctcaaaacggcaaacctcaatcccaccgtccgaagcagcgatcccagcagcatttcacctctggtcacgccatgcaaagcctccatcgtcgcatgataaagcgcatgtgactcccgataaccctcagattgaatgacaccgctctttttggaagcggtttcaattgcggctactactttatgtgcgtccattgatcctaccttgccaagacagaccttccatccgtctcgctccagctcctcaacctgcgtactttcttccgcctcattcagcagcaggagaacagacagccggccgatccgacgctctttatgcagtgtcatatgaatcactcaattcctaaaaattctgataactattaactgagtattatattaattggttcagcagcagaagtcaaaaggttttttatagtctttaacaagttagattgctattgtaatagcgtgacgcagaaagcagaacaggttttttcagcgattgcacacgatatccagacaaggaggcaagcgccgctgtctaactctcaatatgcgtttactaagtcgtatttttcgcaaggcgttttataaagagccagccgaatgactctggtgttgacgggcaatcaggcatcatcttaaaaaacgccgacaacgaaatggctgtatcacagttgatgcaaaacctgacaaagcagttattacatgtacgcgaaagaaaaacagacgtgatgcaagaaggagaaacagcaaaagagttgaactatgaaggagaggatatgcaagcaacaagttctgcgcaaaacagacagacatcagtctgactatgtaagtgaagtgagaaatcacctatctggatgaatatgaaaacattcggctgttttaataggccggggtatcttcatagagaaatgtaagcgtttaaaatttaataaaaaagagaggcgaattgtttagatgttcaaccgattgttccgtgtatgttttcttgcagctcttatcatggccttcaccctcccaaactccgtctatgcacaaaaacctatatttaaagaagtcagcgtccatgacccttccatcattgaaacaaacggcactttttatgtttttggatctcatctcgcttcagctaaatcgaatgacctcatgcaatggcagcagctgaccaccagcgtaagcaatgacaacccacttatcccgaatgtctatgaagaattaaaagaaaccttcgaatgggcgcaatccgatactctttgggcggctgacgtcacgcagctggcggacggcaaatactacatgtactacaacgcctgccgcggcgattcgccaagatccgccatgggtgttgccgttgctgacaacatcgaaggcccatacaaaaacaaaggcatctttttgaaatcaggaatggaaggcacaagcagcgatggaacaccgtatgatgcaaccaaacatccgaatgtcgtcgacccgcataccttctttgataaagacggcaagctgtggatggtgtacggatcatactcaggcggcattttcatacttgaaatgaatccgaaaacgggcttcccgcttcctggacagggatatgggaaaaaactgctcggcggcaaccacagcagaatcgaaggcccgtatgttctctacaatccagacacccaatactactacttatacctatcatatggcggtctcgatgcaacaggcggctacaacatccgtgtggcccgctccaagaaaccggacggcccttactatgatgcagaaggcaatccaatgctcgacgtccgcggcaagggaggcacattcttcgacgaccgttccatcgaaccatacggcgtcaaactcatgggcagctacacttttgaaacagaaaatgaaaaaggcaccgggtacgtctcaccaggccacaactccgcatactatgatgaaaaaaccgggcgttcctatttaatcttccacacccgcttcccgggcaggggtgaagaacacgaagtcagagtccaccaattgttcatgaacaaagacggctggccggtagcagcaccatatcgttatgcgggcgaaacattgaaagaagtaaaacaaaaagacatcacaggaacatacaaacttatccagcacggaaaagacatctcagccgacatcaaacaaaccatcaacatccagctcaacaaaaaccacaccatttccggggaaatgaccggaacatggaggaaaaccggaaaaaacaccgccgacatcacgttagcaggcaagaagtataacggggtatttttacgccagtgggattcggtgagagagaagaacgtcatgacgtttagtgtgctgaataccagcggtgaggctgtatggggatctaaataagatggagaagcgccttcgagggaaggtgtttttttatgagctttattgactataagaaacagttaagtgggaggaaaaattagaactggaggagagattaaaggcttaaataaaaagtccctactatgattgttttctcctttcatagggtgatgagatcgtatttttagcaatttagaaccagttctatacctctcaagacaatcctttttacctatttatccaatatgacccatcatgtaatatgaaaatagtctgtattgtaaagaatttacacagtttgatagaaacacgaggtgttgcggcatgcatagtgaaatgttgttacattcggtaaaagccgacttacatgaaaagcaggaacagatccatcaattaaaacgagtgctgcacgaaattaggcaaatcaaacacgatttctctgaggcccagcatctcattcaccggcctcatcttaaccgggaggcatggagaggaacacatgctgagcggtttgaagatattcgtgaaggaatgaacaaagcatatcagcaaatcaaaagcgatcaagtcagcggaatcatcgaaagcatagaaggaaaaatccactcattagagggcgatgtgtattctataagacgccaaatcacgaggatagagcatgaaatagagaaggaaaaacataaaaagtgaggtgagcacaaatggcacaggaaattaaaatggtgtatgacacagtgaagcaagggctttctcagctcaagaattcagctgaactcaagtcctcattgcccggtcatctctcaggcagaaaccatttgaatgttgtgaagtccatcgagcaattaaataaggacatcaaagagctcactgaagcatatgcgtctgttctggccaagcatatcgcacaaacggaaagcgcggtaaacgccatgaaggaaacggacgaaaacatatcatcttccatgaaataaagcgcgggaggacaagggattgaaaacattagatgtccacgctcttcacgagggcattcagcatacgattgagaaactggacaagcaaaaacaacagctggagaagctggaaaaaagcgttgagcatctggcaggcatgaaggatgcgctgaaaggaaaaggcggagatgccatccggaccttttacgaggagtgccacaagccttttctccttttctttggcatatttatcgacgaatacaaaaaagtgctgaaacaaacacagcatgcgatttcctctgtagaatctaactcccacggcatgatcgcagaggcttttctctcacacgatgcgagacatggggtcaagcatgcacgagaagtgacagagcagctcactgacgcagtcaatcgccagacatcagccatagatcacatcgtcagcctgccgacagtcaatgattccttttttcggatggaaacagaacaggctgagcggctgatttcagacaccctgaataagctctttcaatttgacggccagcaaacccaagcactagaagccgcaaaatcagattttcaaacgatgaaaaaatacattgatcagctcgaaaccatgtacaccggcccgaaaattgaaatcacaggctacaaaagcggctccatcctgaaatcacaggaagaagaaaacatcaaccaaatcttcggcgcgattaacccgcaaatgaagcaggcggatgattcaccgatggagatgatgctgaagaaattagccgagaatgaaaagtctaaagtggattcagttgtcaaaacgggtgattctaaaaaggtaagtaaaaatatcatcgttatcaatggtaaagtgtataatacgagtgaacatagagaacatataaaaactgatttctcaaatgcagaggttaagcaagtcgtttataatgatacactttacaatgtatacatatctggtaatgacatgaagcttgaacctgtcgtctcgctttcggacattaaagtggatgagaatggatatgtgaaaattttagagacggctgtagaacttaccggcgtgtatgatctatttaaagcagccacgggcagagatccggtatcaggcgaaaaagtcacagggaaagaccgtgttgttgcctccataaactcagtaccatttgccaaaatagctaagttagaaaagttaatagatattaataaacttattaataatgggaaaaaggctaagaaggcttcggaagttaaaaacgttgctaaggataaagggaaaattgcgaatgatgtaagtggatctgctaataaaattaattctgatttaataaaaaagtatgctagagatatagaacaacgcacaggtagagaattacctaaaaatcaaatagataaattaaaggaagcattaagaaataaagaatataaaaaaatgtcaccaatagagactgcaaaacacaggactaaatttgataaagtaaaaaataaagttataaaagaatgggaagaaaacactggacaaaaatggcctgtttataaggaaaatgttgtatctgaaaaaacaggtaaaattattagaaaaaaaggggataagtatgatgctcaccatataattgaaaatacttttggcggagaacatgaatggtggaatatgcatccagcaaaatttcctaacgagcatcaagctgggattcatggtacaggctcaccagcaaatgaattatttaaaggaggcaaaaaaaatgagttataattttataaaatcaaacaaagaaaatgatttttatccagtgaatcaaagtgagattgaagaggttgaaaaaatttaaacttaaaattacctagtgaattagtgaatttttatttagaagttggctatgggtttattaaaggatcagagtttaatactaatcgcattttggatccatattctgtaagagactttcgattgaggataaatgactttgaattttatcctgacatagaaatatatgatgagtttgagaatgataaattaatattttttgaaggtagtgaatcggcattaatgtcaattgaattaaatgataataataaaaatccgatttactattatgatattcaaattgcaacttctcttaccgagttcttaagaaaaatagaagagaatgatcagtattatcttgatttattagatgatgaatgattttaacattatcccgttacctctcccttaaaggagcaagatgacatgttattgatcaataaacagaaggaccctgtttttcagtttttagctggaacattccatcaagatattgaaactcctgatgacgctatacaagagttattaatagaggaaagtaaggaatatttggaggatgctattgtctttttaacggattttattgaaagtgagcattcagacaataagaaaaacgattacattcaatcttgcgcagatggcgtgtatcttcctgcgtttaatttagaaccaatagattggctaaagaatgtaatagtacagataaagaagtctttaaaaaaatttaaacggtaacgattcataaccttgattggaaaaaatgcctttcaaggtttttaattacaataattttttattgaagttaatactaagttcaaatctttatgattacttttgttctagaaacgatagtcaacaccaaaaatgaaagcgttgacatctcacgaatctagtgctaaagtatacctacaaacaaataaaacgacccgtcaggattgttactgcgaaagcaggcaaaacctaaatggtgcaggtgcaggaggagactctcgcaatctgtgtcatttaggtttttttattctcttttaggaggtgatgcagcatttgatacaaaaaaagctggtgaaaggcggccacctttcatccagcagtccccccataaaaaggaggtatacacatggattatgataaattatcgaaggacatattacaactcgtaggcggtgaagaaaacgttcagcgcgtgatccactgcatgacgaggctgcgttttaatcttcatgacaacgcgaaggcggatcgcagtcagctggagcagctgcctggagtgatgggcaccaatatcagcggcgagcagtttcaaatcattatcggaaacgatgtgccgaaggtgtatcaggcgattgtgcggcacagcaatctcagtgatgaaaagagcgctggttcatcctctcagaaaaagaatgtgctgagtgcggtctttgatgtgatttctggggtgtttacccctattctgcctgcgattgcgggagcggggatgatcaaaggacttgtggcgctggcagtcacgtttggctggatggcggagaagagccaggttcatgtcattttgacggctgtcggtgacggtgcgttctacttcctgccgctcctgctagcgatgagtgcggcgagaaaattcggaagcaatccgtacgtagcggctgccattgcggcggcgatcctgcatccggatttgacagccctgctcggtgcggggaaaccgatttcctttatcgggcttcctgtaaccgctgccacttattcgtcaacggtcatcccgattttgctgtcgatttggattgcttcatacgtggaaaaatggattgaccgttttacacacgcatctctcaaattgattgtggttccgacattcacgctattgattgtcgtgccgctgacattgattacagtcggtccgcttggcgctattttaggagaatacttgtcttctggggtcaattatttgtttgatcatgcagggcttgtggcaatgattttgctggcgggtacattctctttaatcattatgacgggcatgcactatgcctttgtgccgatcatgatcaacaacatcgctcaaaacggccacgattatttactgccggctatgtttttggcgaatatggggcaggcgggagcatcatttgccgtcttccttcgctctagaaacaaaaaatttaaatcactcgcgcttaccacaagcatcacggcgctgatggggatcacagaacctgcgatgtacggcgtgaatatgcgattgaaaaagccgtttgcggccgctttgattggcggtgcagccggtggcgcgttttacggcatgacgggtgttgcttcctatatcgtcggggggaatgcaggtctgccgagcatccctgtctttatcggcccaacgtttatttacgcgatgatcggccttgtgattgcgtttgcggcgggaacagcagctgcgtatttgcttggattcgaggatgtgccttctgacggcagccagcagccggcagtgcatgaaggcagcagagagatcattcacagcccgattaagggagaagtgaaagccttaagtgaagtcaaagacggagtgttttctgctggggtcatgggaaaaggatttgccattgagcctgaagaaggagaagttgtttcgcctgttcgtggaagcgttaccaccatttttaaaacaaaacacgcaattggcattacgagtgatcagggagctgaaatactcatacacattggattggacacggtaaagctggagggacaatggttcacggctcacatcaaagaaggcgacaaggtcgcaccgggagatccgctcgtgtcctttgatctggagcaaatcaaagccgcgggatatgacgtcattaccccggtgattgtgaccaacacagaccaatattcgttttcgccggtgaaagagatcggtaaagtgcagccaaaagaagcgctgcttgctttatcttgaaaaaactaatggggtgatcaatatgagttcaaatgaaaaacgatttccagaaggatttttatggggcggcgcagttgctgccaaccaagtggagggtgcttataacgagggtggtaaggggctttcgacagctgacgtatcgccgaacgggatcatgtctccatttgatgaatcaatgacttccttgaatctgtatcacaacgggattgacttttatcatcgttataaagaggatatcgccttatttgcagaaatgggatttaaggcgttccgcacatcgattgcgtggacgagaatttttccgaatggcgatgaagaggagcccaatgaagaaggcctcagattttatgatgatctgtttgatgagctgttaaagcatcatattgagcctgtcgtaaccatctctcattatgagatgccgctcggtttagtgaaaaattatggcggctggaagaatcgcaaagtcatagagttttatgaacgctatgccaaaacggttttcaaacgctatcaacacaaagtgaagtattggatgacgtttaatgaaattaacgtagtgctccatgcgccatttaccggaggcggtcttgtttttgaagaaggagaaaacaaattaaacgcgatgtaccaggcggcacaccaccaatttgtggccagtgctcttgctgtcaaagcgggtcacgacatcattcctgattcgaaaatcggctgtatgatagcggcaacgacaacctatccgatgacttctaagccggaggatgtcttcgcggcaatggagaatgagcgcaaaacacttttcttctcagatgttcaggcaagaggcgcatacccgggatatatgaaacgctatctggcagaaaacaatattgaaattgaaatggctgaaggcgatgaagagctcttgaaagaacatacggtggattatattggattcagctactacatgtcgatggcggcgagcacagatccggaagagcttgcaaaatcagggggcaacctgctgggcggagtcaaaaacccttacctcaaatcatcagaatggggctggcaaattgatccgaaaggcttacgcatcacgctcaacaccttatacgaccgttatcagaagccgctgttcattgttgaaaacggccttggcgctgtagacaaggttgaagaggacggcacgattcaggacgattacagaatcaactatctgcgtgatcatttaattgaagcgcgcgaagccattgcggacggcgttgaattaatcggatacacatcatgggggccaattgaccttgtcagcgcatctactgcggaaatgaaaaaacgctacggtttcatttatgtggacagggacaatgaaggaaatggaacatttaaccgcatcaagaaaaaaagcttcaactggtatcagcaggtcatcgccacaaacggagagagtatctgacaaatttttgaaaactcatgcgcttcaattgacaataacgaaatgcaggctgacaataaaagagaaagatgaaccacccacagtccgaaaggcgggaagagcatgtttaacaaaatgttagttgcgattgacggatcagacatgagtgcaaaagcgcttgatgccgcagtgcatttggcaaaagagcagcaagcggaactaagcattcttcatgtggggagagaagccgtcgtcacgacttcttctctgacgggaattgtctatgtgcctgaacactttattgatgaaatcaggaacgaggttaaaaaagagggcctgaaaatccttgaaaatgcaaaagaaaaagcagccgaaaaaggcgttcaagctgaaaccatttacgcgaatggcgagccggcgcatgagatactaaatcacgcaaaagagaaaggcgtcagcctgattgtagttggcagccgggggatcagcggcctgaaagaaatgatgcttggaagcgtcagccataaagtgtctcaattatcaacatgcccggttttgattgttcgatagatttgtaaaaaaagcgcccttgggcgcttttttttatttagaatagaagtgttataatatctacatgtaaaaaagaggaattctatgtgtagatttctgaattcacaaaaaacagtttatgctatgcagtattggaggtagaatacgtttgatgcaacaggatccttccatatcgtcaaaacaaaaatcaacagccgtaatcaaaatggtcatctctatggtgattttcggctccatcggctttttctcagagcataccaatctgccgtcatttgaattggtctttgtccgctgcctttgcgcgacgctgtttttaggcttttgctggctggcgtccggccagtataaaactgaaaaatggagcaagagagacgtgctgcaaacattggcgtgcggtttctttcttgtattcaactgggtgttcttatttaagtcttttgaagaaacgtccgttacaattgccatctctgtttatcatctagcgccggtgcttgttcttcttctggggagcttcttctacagagagaaattaaatgtgatctccgtcagctccattatcatctgctttcttgggactgcgctgatttccgggattaacggcagcacatcattgacacagctgatgggatcagggatcatatgggcagttctcgccgcactgttttatgcgttcaccactttattgggaaaaggcattcacaatctcagtccttacacgaccaccttcttgcagacaggtttaggggttatcatcctgattccgtttattcactttggcgcttttgcggacctatctcagggaaactggattatggtggtatctaccggcatcatccatacgggtattgtatatttgctgttttttgacagtttacgatttttatcaacgaaatttatttcaatcattgtatttctcgaccccgctgtcgcgatcgtgctcgataccgtcttcacaggcttccgccctgacctctatcaaacgcttggcatcgtaatgatctttgcgggcatggccttgacgcttgtcaggaggcaggggaaggcgaatgtgacagctgagggtacggatattgaacaaatacaataaaaaatgtaaaaaggcctatgcggcctttttttgttttaggtcaattgactctcgctaatccttaaaataagataaattttctagaaaaatattgtaatgatatttcagtctagttaagattattgagtaaatattacttttattacaaaaggagagaggaaatgaaaaaaagaaagaggcgaaactttaaaaggttcattgcagcatttttagtgttggctttaatgatttcattagtgccagccgatgtactagcaaaatctacagaagaagagaatggaaaccgtattgctgccgatgatccagaagaaactcttcagaaagaacaaactgaggaagctgtaccttttgatccaaaagatataaacaaagagggtgagatcacctctgaaagaacagaaaatacaaaactctattatgaaggtgacggtgtctataaacaggaagtataccttgatcctattcatacaaaggaaacaccggatgccgactgggaagacatttctcctgagttaaaagagtcgacaagcaaacaagtcgagacagagaacgctattttgaattcagattttcaaaagcaaatgaagaacgggctttatgcgacttttgagcataatgaccataaggttacatattcactagcagaagcgaaaggcccgaataaaacttcacttactccgaaagatacctcagcagattataagactgacagtaatgagattgtgtatccggatgtgtttccgaatattgatcttcagactttcacattcaatgaaaacataaaagaagatttagtccttcatcagtataatggatacaacacatttacatttcagttaaaaaccgatttgcaggctaaagaacaagaggatggatccattgatttttctgatgaaaaaggaaaagttgttttttctgtgcctaagccttttatgacggattcaaaactagatgagctttccggcgaggttgaacggtcagacaaagtcagctataagctggaaaagaatgaagaagggtatttgcttcatcttacggcagacgagaactggctgaaagacccagaacgcgtatatccagtatctatcgacccgtcaacttctttatctgtttcatcggatacgtttgtcatgagtgcctacccgacgacgaactattcggcctcctcacaaaaatgggatgctaatttaaaggcctatgtactgaaaacgggctattatgacaaaacaacaggcacaaactatgcgttcatgaaatttaacaacctaaagccaattcaaaatatgactgtcactaaagctacattaaaaacatacgtagcccattcctattatggaacaaaggcaaccggcctttggctggatacggtcaacagcaattatgataatgcaaaagtgacatggaacaccaaaccggcatctaaaaatatcggaaaagccgacgtccataaaggacagtgggcgagttatgatgtgaccgctgctgtaaagtcatggaactccggcggggccaactatggatttaagcttcatacaaacggaaacggcaaggaatattggaaaaaactaatttcttcagcgaactccgccaataaaccatatattgaagtgacgtataccattccaaagggaaacacacctacaatcaaagcctatcacaacggcgattccactggttatttcgatatcagctggaaaaaggttgaaggcgcaaaaggatataaggtatggatttacaatggtaaggaatatcaagcgatttctgcaggcaacgtcacgtcgtggagcacaaaaggtaaaaaaatctggcctacgagcgcagaaattgcctccaagagatataaactgcatctggacggcaaggatggagctgaattggcattagatccatccccggtctataagaattccggcggaagctatgctacaagcaaaaactattggattggcgtcagtgcgatatttgaccaaggtgaaggagcgatgtccgcaccggcaaagcccgttatccctaatgtaggaaaagcacaagcaccgtcagcaaagggctacaataatgggaatgccacaggatacttcgacctttcttggaaagctgtatccggtgcaaccggctataaggttcaggtgttcaatgggaaaggctttgagacacttgatctcggaaatcagacgtcttggaccacaaaagggaaaaagatctggccgacaagtgcagaaatcaaggcgggaaaatatgctcttcacctaaaggacggaagcggagcagagctgccgatcaatcccggaccaacctataaaaacgccgggggagatggagccaaaagaaattactcgtttaaaattatcgcatacaacaaagacggcgaagccattgcatccccggctgctaccccggcacttcctgatatcgctaggccaaagaatgtaactggctatttgtatacaaatacaaaatcgagtcaaacgggttatgtgaatttgatatgggaaaaggttcaaaatgcgaagggctataaagttaacatttacaacggtaaagaatatcagtcctttgatgttggtgatgctgatcattggacaacccaaaataaaaacatctggccgacttctgaggaaatcaaagccggaagctataagcttcatacagatggaaaaggcggggaattagccctcgatccatcacctgtctataacaatgcaaatgggaattacaaagggaagaagaattattctttcacgcttgtcgcctatgatgcgaatggtgaaacgattccaacggcgccctttaacccaacgttccatgaaggcgcagaattcctaggtacagaagagtactggtctatcattgatatcccaagcggccagttaaatggtgcgacaggcaatgtcattgtgaatgaagaagatttgtcaattgatggacgcggtccgggacttggcttatcgagaacctacaacagtcttgacagctctgatcacttatttggacaaggctggtatgctgatgcagaaacatctgtcatctcaacggatggcggggcaatgtatatcgatgaagacgctacgacacatcgattcacgaaaaaagccgatggcacgtatcagccgccgaccggtgtatatcttgaattaacagaaacagctgatcagttcatattaaaaacaaaggatcaaaccaacgcttatttcaataaaaaaggcggcaaactccaaaaggtagtggatggccataacaatgcaactgtctatacttacaatgacaaaaatcaactgaccgccattacagatgcatcaggccgcaagcttacatttacctatgatgaaaacggccatgtgacgtccatcacaggacctaagaataagaaagtcacctactcatatgagaatgatttgctgaagaaggttacagatacagacgggactgtcacaagctatgactacgatagtgaagggcgccttgtcaaacaatattcagctaacagtaccgaagcaaagcctgtctttaccgaatatcagtatagcggtcaccgtctcgaaaaagcgatcaacgctaaaaaagaaacatatgtctacagctatgatgctgataaaaagacgcttctcatgacacagccaaatggccggaaagtacagtatggctataatgaagcgggaaatccgattcaggtcattgatgatgcggaagggttaaaaattacaacgaatacaaagtatgaaggcaacaatgttgtagaagatgtagatccaaatgacgtcggcaccggaaaagcaacggaaagctatcaatatgacaaagatggcaacgttacgtcggttaaagatgcatatggaactgagacatacgaatacaacaaaaacaacgatgtcacaaagatgaaggataccgagggcaatgtcacggatattgcttatgacggactggatgctgtatccgaaaccgatcagagcggaaaatcatcgtcagcagctgtttatgataaatatggaaaccagattcaatcgagcaaagatttatcagcttcaactaatattttgaaagatggaagctttgaagctcaaaaatccggctggaatctgactgcctctaaagacagcggcaaaatttcagtcatcgccgataaaagcggagttctttccggatcaaaggcattggaggtcttgagccaatcaacgtctgccggaacagatcatgggtattcgtcagcaacacaaacagttgagctggagccgaatacaacctatacattaagcgggaaaatcaaaacagatcttgcgaaatcaagagcctattttaacattgatttgcgagacaaagatcaaaaacgaattcaatggattcacaatgaatacagtgcattagccggaaaaaatgactggacaaaacggcaaatcacttttacgactccagcgaatgcaggcaaagctgttgtgtatatggaagtcgatcataaagataaagatggcaaaggaaaagcatggtttgatgaagtccagctggaaaaaggcgaagtatcatcaagctataacccagttcaaaacagcagcttcacatcagcaacggaaaactggaatgtaagcggagcatccgttgattctgaagaaggctttaatgatgatgtatcattaaaagctgcccggaccagtgcgtcccaagccggatcagtaacaaaacaaaccgttgtcttagggcaaagcgcaaatgacaaaccggtttatctcacactgacaggaatgtcgaaagcaagcagcgtcaaatttacagatgaaaaagactattctctgcaggcgaatgtcacttacgctgacggcagcacaggcatctacaatgcgaaattcccttctggaacacaggaatggaaccgagcagctgtcgtcatccctaaaacaaagccgatcaataaagtcgatatcagtattctgttccaaaagagtgcgacaggcacagtctggtttgatgatatccgtttgattgaaggaagccttctgactaaaagcacgtatgacagtaatggcaactatgtgaccaaggaagaggacgaactaggttacgccacttcaactgattacgatgaaactggtaagaaaacgtctgaaacagatgcaaaaggtgaaaaaacaacctatacgtatgatcaggcagaccaattgacaaacatgacgctctctaacggcacgtctatccttcacagctatgataaggaaggcaatgaggtaagcaaaaccatccgggcaggagcagatcaaacctataaattcgaatatgatgtcatgggcaagcttgtcaaaacaactgaccctctcggcaatgtgttagcaagcgaatatgatgccaacagcaacctgaccaaaaccatttcaccaaatggcaacgaagtgtctctttcttatgatggaacagaccgggtgaaatcaaagtcgtataacggtacagaaaagtacattttcacgtatgacaaaaatggaaatgaaacgtcggtcgtcaataaagagcagaacaccacaaagaaacggacatttgacaacaaaaaccgtttaaccgaactgacagaccgcggcggcagccaaacttggacatatcctagtgactccgataagctgaaaaccttctcgtggattcatggggaccaaaaaggaacgaatcaatttacgtataacaagctggatcaaatgattgagatgaaagacagtacatcctcatattcatttgattatgatgaaaatggaaacgtccaaacctttattacgggcaacggcggcggaacaagtttttcatatgacgaaagaaaccttgtaagctcgctgcatatcggtgacaaaaacggcggagacattctgacggaaagctatgaatatgatgccaacggcaaccgcacaacgataaacagctcagcaagcggcaaggtgcaatatgagtatgggaagctgaatcagcttgtcaaagaaacccatgaagacggtactgttattgaatacacatatgatggattcggaaaccggaaaaccgttacaactataaaagacggctcaagcaaaacggtgaacgcttccttcaacatcatgaaccagctgacaaaagtcaatgatgaaagcatctcttacgataaaaacggcaaccgcacatccgacggcaaattcacatatacgtgggatgcagaagataacctgaccgccgttaccaaaaaaggcgaagacaagccattcgcaacatataagtatgacgaaaaaggaaacagaatccaaaaaaccgtcaacggaaaagtcacgaactacttctacgacggagacagcttgaacgtcttgtatgaaacagacgcggacaacaacgtcacaaaatcatacacgtacggagacagcggccagctgttatcctacacagaaaatggtaagaaatatttctatcactacaacgctcacggcgacatcatcgcgatctcagacagcactggaaaaaccgttgccaagtatcaatacgacgcatggggaaatccaacaaaaaccgaagcaagcgacgaagtaaaagacaatcgctaccgctacgcaggctaccaatacgacgaagaaaccggcctgtactatctcatggcccgctactacgagccaagaaacggcgtgttcctatcgctcgacccagacccgggcagcgacggagattcattggatcagaatgggtatgcttatggaaataataacccagtgatgaatgttgatccggacgggcattgggtatggcttgtggtaaatgccggatttgcagcctatgatggatataaggcatataaatcaggtaaaggatggaaaggtgctgcttgggcagctgcttctaattttggtcctgggaagatatttaagggtgctagtcgcgcctataagtttacgaagaaggcagttaaaatcacaggtcatacaagacatggacttaatcaatctataggaagaaatggaggccgtggagtcaatttaagggccaaactgaatgctgtgcgaagccctaaaaaagtaataaaacaacctaatggggcaacgaaatatgttggaaaaaaagctacagttgttttaaataaaaggggtaaagtaatcacagcttatggaagttcaagagctaagggttctaaacacgtattccatacacacggaaaaggaaataaatctaagagaaggcgttaataaggttaagcgagggggggatgacaactaccctcacttaaactttaaatgaggaggaaatatggccaaaataaaagatgattgtatagaacttgaattaacaccgagaaggtatcaagagttggacgatgatccatttattttatctgtatttgaattgttggaaaataagaaagccgtcgttcgcgatttttctgctgttttattagaaagtgaatataaggtgttgatatctgggatcgaaactatgataaaaggaaatcaagacagtatcagtttagagactattgaaccattcttatttcttagtattgatcaagaaaacggaaattacagaattaagattaaaattatatttgatgattataaagaaagtaagtcgaactccaacttgttcgaaattaattgtaatgaagaaaagctagagtcttttgtgaccgctttaaaattaaatcttgaaaatacaaaaaatccttctaaacttccttaattataaataatttctgcattggataaaaatggggcatttattgatggaacattaaataagagatgttaccatcctctcttatttgtatgacaaaagaatctaaaaatatagaattgattgggatgaagaggatttgccaaaaaggttcccagcgttttgtgaaaagcccactgggtgagttttaagcagttgaagataaagcttgtatcgataagcgatacaagcttttttagaacaaatctaaacatgaacgacaacgaaaacaagagaatgatgaatcaatttaaaagaagttgagaaattgacagcggagggaatgcggctcatgcaaaaaagattgatcgaaaaactcgccgagaataaaagacgtttattgatgagcgaaatcaaagaaaaactagtcccttgtgcagaaagaggcttcacttatcgttttgctgatctggcgcaaagcaggcaattgcttgagctggttttatcaaattcaataccagccaacacccgtgaggttgatgccctcgaaaaaacggaagcgaaacagctgatctggaaaatatctcagtcatatgttgcttacgatgaccgggacgttctgctgtttcatcaatacagcagcgaaattggtgcgttagtttgttcttttggaaaatgtctcgagcaccttgactgcttattggagtgtattgagttcgatgaagggattctcaatcatagttttattttggttgagcctaagtgccagtttggtttatgtatattgcacacggaatacggatgtgagcttgtttattggtagattggaaaccttttggaacatatcttttacggaaaaagcttcaatatctaaatatcagtacggtgctttgcatactaataaaaaatcatttagtacttgaatacgtggtgatcaaattgagcgagacaaatctaatagaatgcataaataaaatcaaaagtgtcttaaatggacaaacaacaagagaagaagtgtcggattgggctggaacttatgtttatgcggatgaccccgaagtagaagacgatagagtctgggatatgttaatccttctaagtgggattgatttgaaagattcatcagaaacttatttgcattcaacagatgatttaaatgattggatcaaacaatatacggagtaatttgttttctgcttggtggcaaggcgttattgtttaaaaagaggcaggggatgacaatgtatcaaacgattaatgaatgggttgattatatagataaggggtgcagtgtccttcatttagattttaatgtgtttaaaaaagaactctcacttgatattaaggtttttgaagatgaaggtgaatatacgcataaaatttcatttcaaaatgtggcatccgcttattatagtgcagatgttggcgacatgagattggaaaaaatagatccggaagaatacaattggcaagtatttgagatgagttatcatccagaaggaatcgggaatctatcaaattctataattccggagtatcaatcaaatgctaactttcttattgacatgaacagaatgctgattgctatagaagctgaaacagttcgctttgatgatcaatcgttttatgcataccaattaaacactaaatgatttaaggctgaattggaaagtagatttatcccaaaacgattaatgaaactaggttgtccgttactaatagctaataaatggtttattcttatcatttcatttcgaacctaggagcataaccaatgaaaaaattaaaattgaataaaatcatcaacgagaacacccaagattgttttttccatgctgatccacaggggcgtgtctacattggaaaagggttgaaaggtggtatcaccattacaatctatgatccttccggtgatgttcgggattttagagtgaaagagcagatttcatacagtgatattctgctctttcaacaatgtgcagatggctatgtcttcgtttattacgaatcgtacgagccgaaggtaaaggttttttcagaagagggaagggtgaaaagtgtttttcacttgccttcaggggtttcctgctgtcttttggattagaaacaacagctttgggtcggtttatgtgatgaagggatttatcatgatgagaatcccaacggccatagtgtgtggtgttttacgttagatggtcagcagaaggaaatacacattgatagaaagcttgaagaaatggatgcgcctgctgtagatgattgttatggacttgcagaaaaaaacggcttgatttatatgctgtattacggagatgcagtcattgccgcatttgatgaaacggtcgtgagacgggtgtggattctgtcggataaagagccggactcagaagcatttgatcagctcgcgatatccgaagaaggttttttggttgggacgttcaattgttacagtgcagaccttaagtcgtctctttatttgatttctgccgatgtgagtcaagagatggaagagataacatgctgtgattcgaacggtgaaggcctagatgttcaacagctgaaactgacaagttacgctgtttacgcagtggcctcttctggtgtttataagcaggatatccaataaggtgtagggatgagattatgatgaattggcgcgctttaagtcagacaaaacaagaccgcatctggtcagaagtgaacaagatcataaaatggaagcccggaagcagatgtcatcacatcatcccgcctgatccatatcgagtgtttgatatctcaagcgcgatgagcagtaaagctggtcataatgatgtgagcggagtgctaagtgatttagagacttctattttaaaagcatttcaattaggtactggaaagaacgatgtaatgtacgcactagattggcagcatgacggatatacctttagtcctcatcaggcaatgcctaaggatgaatttggcgaatggcctgttcccgtatttccaaatggagactattatttcttttttcatcaggacttctcctggggacttttgggagacccgtggaaatgtgcaatcactgtgtttggtgaagagctgttggaggcgatagataatgatccgcctattctgtttcgaaataaatgagattattgcggaagggagaggatcaacgtgcttcaaaaactgagaaaaagacagcgagagcttgaagaaaagcagtaccctgatgaattgtacggctttgaagcggaaatctatgagttttttatgcttgttgctggcagtttggattatgtgctggcgaataaaaggataccccggcatcagcggcgttcgttggagaaaagcttttttgagctgtatcctgacatacttccggatatgatcaaaaacgataaggatctgtatcatcacattctcttgtatgaacaagtcagacaagagatttgcgttgcgctatccaactgataaggggaagattttatggaaataacctctataagcagtattggcaatttggacatgatcgagcttaagcctgaccaaaccgttatggcatgcgaacttgaagatgcagagtcgttttatcgtttttgggcagggcttgcctacgatcgaatcatgatacaggtaataacgactggttcatttatagaagacctgtccgagtattttgaaggtcatgcttacaaggtgacgaagctggccaaaagggaattccatttccaatccatattacaggaagcagaccgggatattgcagattttctctttctgctagcttccatcaatgatgatgtttttctgatcactgatcctcaaccggataaaagctatttttcagaagggaagctccaatgcctaacggactcaggcgaacggatcatatggtttgaatacgatgctgtggacatttatatgattggcggtgaatcatataaatagagggaattcatttgaatatcacacaatacgagaaattgaaacagcatctttctgatgaggatacaggtccatttacattaaacgagttttctttctatatgaaagaagatgatcgttatattcatattcctgtgtttgaatgaaaacgatctgctcaaacctgtgacattcaattgcggtttgaaaacattagtgcatcaaagctggatgaccttgaatccatcgattcggttgcattggagattgtaccgactgacgatcaatgggaaagactccgttattatgtgtatgacgaagaaaaccaaataagcttctattgcggaggttgggatgtgatcaagtgtgacaagaagtcacactgattttccccttcttgagactctcccctcatttttattcctcaacgcaatttttttcttaattcagtcatcataaagaaacaatcaccgagtatgcattaatgtattcgttttcatagagggggagtcttgatgaaaaaatggatggcagcggtttttgtgatgatgctgatgctgtgttttggcgggattgagaatgtgaaggcggcggagccgaaggtgtatcagtttgactttggaagcggttcgatggagcctggttatattggtgtcagggcgtctgatcggtatgaccggtcaaagggctacggttttcaaacaccggagaatatgagggatgtggcggcatccggggctggtgtgaagagtgatgcggttcagtttttagcgtatgggacgaaaagcaataacacgtttaatgttgatctcccgaatggcctttatgaggtgaaggtgacgcttggcaatacggcaagggccagtgtggcagcggagggcgtgtttcaggtcatcaatatgacaggggatggcgcggaggatacgttccaaattcccgtcaccgacgggcagctgaatctgctggtgacagagggaaaggcaggcaccgcttttacgctcagcgccttgaaaataaagaaattgtctgatcagccggtaacgaatcgaaccatttatgtcggcggcgactcgacggtgtgcaattattatccgctcaacagcagcaagcaggcgggctgggggcagatgctgcctcactatatcgataaacacacctttcaagtgagaaacatggcgtctggcgggcagatcgcgagagggttcagaaatgatggacagcttgaggcgattctgaagtatattaaacccggagattattttatgttgcagcttggcattaatgacacaaatccgaagcataaagaatctgaagcggagtttaaagaggtgatgcgtgatatgattcgtcaggtaaaagcgaaaggagcggacgtcatcctatcaacgcctcagggccgggcaaccgattttacttctgaaggcatccattcgtctgtaaacagatggtacagggcctctattttagctttggccgaagaggaaaaaacatatctcattgacttaaatgtcctcagctcggcatactttacatcgatcggtccggaaagaacactcgggctttatatggatggagatacgctgcacccgaatcgcgcgggggccgacgcactggcgcgattggctgttcaggagctaaaacgccagggaatcgctggcttttaatacatcatttttcgacaaaacacatatgccttggtcaattagagtataatgagaacatctgcaagagacaggagtttatacatgagtcattttaaaaactatcaaatcagtcatgacattttacgagcattggaaggactgggatatacagaaccgaccaaggtgcagcagagtgtgatccccgctgcccttgaacgaaaggatcttgtcgtcaaatcacagacaggaagcgggaaaacggcttcgttcgggattcctctctgtgagctggcgaattgggatgaaaacaagccgcaggcgcttattttaacaccgacccgtgagcttgcggtgcaagtaaaggaagatatcacgaacatcggacgatttaaacggatcaaagcgacagccgtatttggaaaatcctcctttgataaacaaaaagctgagcttaagcaaaaaagccacattgttgtcggcacgccgggacgtgttctggatcatatcgaaaaaggcacgctgccgttggatcgtctctcttatttggtcattgatgaagcggatgagatgctgaatatgggcttcattgagcaggtggaggcgattatcaagcatctgccgactgagcgtacgacgatgctgttttcagcgacgcttccgcaggatatcgagaagctgagccgtcaatatatgcaaaaccccgagcatatcgaggtcaaagcggccggcctaaccacaagaaatattgaacatgcggtgattcaagtaagagaagagaataagttttcattgctgaaagatgtgctgatgacggagaatcccgacagctgcatcattttctgccgaacgaaggagcacgtcaatcagctgaccgatgaattggatgacttgggatatccatgcgataaaattcacggcggaatgattcaggaagaccgattcgacgtcatgaatgaatttaaacgtggcgagtaccgttacttagtggcgacggatgtcgccgcgcgcgggattgatattgaaaatatctcccttgtcatcaactatgatctgccgcttgaaaaagaaagctatgtccaccgcacgggccgaacgggacgcgcagggaacaaaggaaaggccatttcgtttgtcacggccttcgaaaaacggtttttagccgacattgaagaatatatcggatttgaaatccaaaaaatagaagcaccttctcaagaggaagtggcaaggaagaaaccagaatttctagctaaactgaatgaccgtccggaaagcaaaaaggacaaaagcgaagagctgaataaagacattatgaagctgtattttaacggcggaaagaaaaagaaaatcagagccgttgattttgtaggaacgattgccaaaattgacggtgtgtcagctgacgacatcggcatcatcacgatcatggataacgcctcatacgttgagattttaaatggtaaaggccctcatgttctcaaagtgatgaagaacacaaccgtcaaagggaaacagctgaaggtgaataaagcgaataaatgatgaatgacctgctcccagttaaaggggcaggtcattttgctgctggctgacatctgtgctggtttcctcgggaacaaaggcaagaatcacaataccaatcacaaacaaaatgatcaggctgaacaccgcagtcgaggatttaccggtcagctgggcggtaacggcaatgagcagcggccccataattgaggcgaattttccaaaaatgttgtagaagccaaagaattcattggcgtggcgctttggcacaagcttggcgaaataggaacggcttagggcttgaataccgccttgcgaggtggcgacaagcatagccagtatccagaaatcaagcgttgtctccataaaataggcatacacgcagacgatcatataaatgacgatcccgacgtacagcatggtcttccccgtgaagcgttctgccagttttccgtatataatcgaaaacggcgcggcgactacctgggtgacaaataggatgatcagaaggcttgaggagccgatccctaaatctgatccataggatgtcgacatcgtaataatcgtgccgactccgtcgatataaaagaaataagcgagcaagaagaggaaaagtgcccggtattgcctgatccgtttcatcgtttggccgagccgcttaaagctgttgatgacaatatgaggttcttttttgatgtaatagcgttgatggacatgtttaatcattgggatggtgaacagcccccaccaggcagccgttatgaagaaggacagctggcttgcggccgatacagacactggaatagtctctgcttgtgcgagcaggatgacagcaatactgatgataaatggaatcgtgcttccaatgtatcctaagccaaaaccccgtgccgagacgagattcatccgcttctcaggcgtgacgtccacgagaaaggcatcataaaacacattggcgccggaaaaaccgatagccgataccgtataaaacagcaacaatagcagccaatgttcactagggataaaggcgagcatcgcggtgctggcgacaccggctgacacaaagaaaccgaagaactttttcttgcacccttcatagtcggcgattgtgcctaaaatagggccgagcatcgcaagaataaacgttgaaatcgcaatggtatagcccagataggcagtcgattgagcggcgctgacaccgctttccgcagctgctgatttataaaataacggaaataccgcggtggtcacgacaattgagtaagctgaatttgcccagtcatataacacccagctgttttcttgtttcgtaaaacgtttcatcatcagagcccctctccggtaacgatacttctattgtacgagaaatgggcctgaaaagaatggaatgcacgtcaatttttacaaaatatttatgttttttcgcttcaaatcatacttttgatttattgctggggttaggtgcatctggtaccatttaactatattttatggtattttccagaagggattcagcagagaggagacagagcatgaggcgaataggcttgtgtataagcctgctggtcacagttcttgtgatgagcgcatgcgaaagtgaaggtgaggctcagatgttcgcagactgtgatcaaaagacagtaaaacaaaccgcagccaaaccgatgagcagtaagaaaaagcaggatttccaagccctcgcaagcgacaggcagctggccattgtgttcagttccatgatacaagtgagcgaagcatttgattatggaatcggcaatccagaatacttcgtgcgaatcagcatgactgaagaagaagcagacattgcgaaggagaatctcgaatcgattaagcttgagaacaaatcgctcaaaaaacaaaacagcgaggcggttgccttgcttcaaaaaacgcgtaatcaagatatgagccgcatcgaaattcagcagctgacagaaaatagagccggtttttttgagaccgcagacagtatgatcaaactcatcaaccaagtcacaccgaaaaacgcgaagaagacaagacagcagctggatcagctgaaaaaacaatatacacaatacagtgctgaaagcattaaaatcatgaacagcattgtcaaaaagcagaaagctgacaaggcatcatttgaacgccatctggaggcgctgcttcaaaaacagcccgggcagcaggtacggagtgaattgtactgaccagcttccgtctttccctgatgatattgacctagtacaaaaagaatgtacaatcaagatatagtctgttcttagtagatttggagggacatgccatgaaaattgcgaaggtgatcaacaataatgtgatcagcgtggtcaatgaacaggggaaagaattggtcgtcatgggcagggggctcgcgtttcagaaaaagtccggcgatgatgtcgatgaagcccgcattgagaaagtgttcacgctcgataacaaggatgtatcagaaaagttcaaaacccttttgtatgatataccgatcgagtgtatggaagtatccgaagagattatcagctacgcaaaattacagctcggcaaaaagctcaacgacagcatctatgtgtcgctgaccgaccatattaactttgccatccagcgcaaccagaaagggcttgatatcaaaaacgccttgctgtgggaaacaaaacggctctacaaagacgaatttgcgatcggcaaagaagcgttggttatggtaaaaaacaagactggtgtgtctctgccagaggatgaagcaggctttattgctctgcatattgtaaatgccgagctgaatgaagagatgcccaatattatcaacattacaaaagtcatgcaagagattttgagtattgtaaaataccattttaagattgaattcaacgaagaatcgcttcactattatcggttcgtcacccacttaaagtttttcgcgcagcgtctatttaacggcactcacatggaaagccaggacgattttttgctggatacagtgaaagaaaagtatcatcgcgcgtatgaatgcacgaagaaaatccaaacctacattgagcgggagtatgagcacaagctcacaagtgacgagctgctgtatttaaccattcacatagaaagggtagttaaacaagcataatgagagcgctgacatttgtgtttccttgtgttcactttttcttacattcacatatgaaaatggtaggattgttactgataaagcaggcaaaacctaaattgcaatgagtgcggatcatctctgtctgtgctgatggtaatttaggtttttatttttttcagagggaagatgatgatagttacaggattcaagttagtaagattcgatattatcattattttgaccgatgttcccttttaaaagaatcatgtaagatcaacatagaaaacgctttcaatgaaaggggaatgccaatatgccttatctgaaacgagtgttgctgcttcttgtcactggattgtttatgagtttgtttgcagtcactgctactgcctcagctcaaacaggtggatcgttttttgacccttttaacggctataactccggtttttggcaaaaagcagatggttattcgaatggaaatatgttcaactgcacgtggcgggctaataacgtatcaatgacgtcattgggtgaaatgcgtttagcgctaacaagcccagcttataacaagtttgactgcggggaaaaccgttctgttcaaacatatggctatggactttatgaagtcagaatgaaaccagctaaaaacacagggatcgtttcatcgttcttcacttacacaggtccaacagatggaactccttgggatgagattgatatcgaatttttaggaaaagacacaacgaaggttcaatttaactattatacaaatggtgcaggaaaccatgagaagattgttgatctcgggtttgatgcagccaatgcctatcatacgtatgcattcgattggcagccaaactctattaaatggtatgtcgacgggcaattaaaacatactgcaacaaaccaaattccgacaacacctggaaagatcatgatgaacttgtggaatggcacgggtgtcgatgaatggcttggctcctacaatggtgtaaatccgctatacgctcattatgactgggtgcgctatacaaaaaaataatgccaaatgtgaaagagcctgctgcaatatagcaggctcttatgattgtaatgagaagttgttggcatgaatcttctattcactcataatatcctatttgatcttctcccctctgtaaatcacgtactcactcaatgctacgatcaagctcatacatttagaaagaaataatcccaatcaaaagcgccgcaatggtcatcacaatcgttgttcccacggcccatttaatagtgaatttttgatggtcgccaaagctgacgcctgccattcctaccaatagataggtggaaggcacaagcgggctgagcagatgcacaggctgccccagcaaggaggccctcccgatttcagcggcgtctattccgtaagcggaagcggcttcggcgatgatgggaaggacaccgaagtaaaaggcgtcattcgacatgaaaaggtgaagggcatgctgacgatcgcagtgatcaacggcaggtgcgggcccatggcatcagggatgagtgaaacgagagaatgcgccatggcatccaccatttttgtgccggagagaatgcctgtgaatatgcccgcagcaaacaccattgagacaacgtttaacgcattacccgcatgcgccgagattcgtttctgctgctctttgacatttggatagttaaccatcaaggcaacggcgaacgcagtcataaaaagaacagggagcggcagcaggctggtgatcagtgcggccatcagagcgacagtcagcagcaggttaaaccattgaagagcgggacgcttgagcggtgcggcctccgggtcggaagacggtgcgtgatcaatcgaaatgacgccgagccgcttccgctctttctttccgaggatataagcaacggcgatcacccagagaatgccggcgatcatagcgggaatcagcggtgtaaagacctctgacgtgtccaattttaaggaagccaaaaccctcgcagtcggcccgccccacgggataatattcataacccccgaaccaagcatcgctattcccgctaacaccaaacggttcatgccgagccgtttgtagagaggcagcatcgctgcaatggtaatcatataggttgttgtcccatctccgtccagcgaaatggtcatggtcagaaccgctgtgcctacggcgatttttaacggatctcctttgacaaacgataagattttggcaatgagaggatcaaacaggcctgagtcaatcataatgccgaaatacaggatggcgaataacagcatgataccggtaggggcgaggtctgtaacgccctgaatcatcatctcgccgagatctttgccaaatccgctgatcagggcaaacacaataggaacgacaatcaaagcaataagagcggaaagccggttagacataataaggtacataaagacaatcatcatcacaaaaccgagtatggcaagcatgatatgacctcccctattcaacagcttttttggtaagcgtttccatcctttctttctgtgaagaaggcttatttcaaatgtgtatgaccgcatatttatatgtagaccaaaaatcctaatgagcggattagcagtttatatgaagaacgccacgggtaaatgtgctgtagaatgtttcgttttaaaaagggggagcagacatgagtgatgaccaaaacaaacgtgtaaatgaacactcaaaggacgagcagcttgagcagtacaggaccgataacagcgggaagaaaatgacgacaaaccaaggcttgcgagtgtcagaggatgagcactcgttaaaagccggggttcgcggcccgacgctgatggaggattttcatttccgggagaaaatgacgcactttgaccatgagaggattccggagcgcgttgtgcatgcgcgcggatttggcgtgcatggcttttttcaggtttacgaaccaatgacggaatacacacgggccaaatttcttcaggacccttcggtgaagacaccggtatttgtccgtttttctacggttgcgggttctaaaggctccgcagacacggtgcgggatgccagaggctttgcgacaaaattttatactgaagaaggaaactatgaccttgtgggaaataacattccggtgtttttcattcaggacgcaatcaaatttccggatttggttcacgcgtttaagcctgagccacacaatgaaatgcctcaggctgcgactgctcacgatacattttgggattttgtcgccaataaccctgagtctgcccacatggtgatgtggacgatgtctgacagaggcatcccgcgcagctacagaatgatggaaggcttcggcgttcacacgttccgttttgtcaatgaacaaggaaaggcacgtttcgtgaaatttcactggaagccggtgctcggcgtgcattctctcgtatgggatgaagcgcaaaaaattgccgggaaagatccagatttccaccgccgtgacctgtgggaaacaattgaaaacggcggcaaggttgaatacgagctcggcgtgcagatgattgatgaggaagatgaattcaagtttgattttgatattcttgacccaactaagctgtggccggaagagcttgtgccggtgaagatcattggaaaaatgacgctgaaccgcaatcaggataatgtgtttgcggaaacagaacaagtcgcattccacccgggaaatgtcgtgccgggcatcgattttaccaatgacccgctattgcaggggcggcttttctcttatacggatacacagctcatccgtcttggcggcccgaacttccatgagattccgattaaccggccggtctgtccattccataacaaccaatacgacggctatcaccggatgacgatcaataagggacctgtcgcttatcataaaaactcactgcaaaacaatgatccgtcgcctgcgacagctgaagaaggcggctacgtccactatcaggaaaaagtcgagggcaaaaaaatccgccagcgaagcgacagcttcaacgattattactcacaggcgaagcttttctggaacagcatgtctcctgtggagaaacagcacatcatttctgctttctgcttcgaggtcgggaaggtcaaaagcaaagacgtacagcggcaggtcgttgatgtcttcagcaatgtcgatgcagatttagcagaagaaatcgccaaaggagtaggcgtggcggcgcccgcgaagcgtaaagcatctaaagaaattcttacttcgcctgcgttaagccaagcccgtacagtgaaaaccgcgtcaacaagaaaagtcgctgtactcgccggaaacggatttcatgaaaaagagctgcaaacagtactggaagccttaaagcaagaaggaatcacagtggatatcatcagtcaaaatctggggtatatgacaagcggcagcggacagcagcttgaggccagcggcacgttcctgacggttgattctgttctgtatgatgccgtctatgccgcaggaggactggagttaaaagacaacaaacaagcgatggcgtttatcagagaagcttacaatcactacaaggcgatcggtgcggcaaatgaaggaattgaccttcttcaatcctctgtcgggacaacagaggggctaggcatcgtaacggctaaagatgaacctgactacaccgctttcagcaaggcatttatcgatgcggttgctgctcatcgccattgggatagacgaatttgatcggctcctgtatctttaaggaagatacttttcataaggagcatgacaaatgaacgaaaaacagctcactgaagcttacgaacgcgatgaaaatatgatgattttggtgtttgcccagtggtgcgtgaaccatgatcttgatccgatggagctgtacgccaaagcgtatccgcagcaaaagctgaatgaaagcttgaaaaaaaccatggacgatctggtcgtgccaaaacacgaagcagagcacattccggaccagactgtcattgcggtattagagatgttcggaaatacagatttggcacaagcccttcatgaagcgatttctgggcgcaaacagtaaaaaaagagacatcctgtgtctctttttttattggaaaaatcatgctgttagacctagaaacttctttcgatttaatcagtctataaaagtgtgtattgcttaaataagggaatgataaacaacgacatcaaaggagtagattgtatgaaatggaataacatgctgaaagccgcgggcattgcagtcttgcttttttctgtatttgcatatgcggccccatctttaaaagcagttcaagcgaaaacaccgactgtcagcacccatacgtacaaaaagatcaaggagttaacgtatccacaagtgcatcacgtcgggaatgccgcgtttgaaaagaaaatcaatcaagagctgaaagcctacatgaacaatcgtatcaggaatacctgaaaaacaaaaaagcaggcgaacagcagggctttaaaacgggaatatcaaacatccttcagcgtcaaatacaatgcggcaggcaagctcagcattcaaacactcaattatatctattcagggggcgcccacggtctaacgtctgtccagtccttcaactatgacttgaaagcacaaaagcgggtgacgctggatcagattctgaacaccaaaacaaaagtcagcaaaacgagagattacctatatagctatatcaaaaaacacgatgtgctgtttttctctgatgtaaagaaagaggatataaccctaaacagagacacaatgttttactttacggcaaacgggatcgccatcgtcttcggccagtatgacttggggccttatgcagcgggaatccgggatgtgcaggtgccagcctctatttatcaataatgaaaagagccatatccgaaaagggatatggctcaatgtttctaccacacaaacaggccgacaatcgcagcacttaataaagataccgcaattccgctgacgagcagtttccacacgtttctcccgatgaccgttgacttttctccgtcaaggatcgaattgtacgtgccgtaaatcatgccgacagtactgaagtttgcaaaggacgtcaggaatgtcgtcgccaccgcaacggtgtgaggcggaagggatttgagattgtttttcaagtcaagcatcgcaacaaactcgttcgttgctaatttcatgcccatcagctgagcaacatacatcgcatcgtgcactggcagtccaagcaggaatgcgaacggactgaacagataagcaaaaattgtctggatggtcaggccatgtacgaaaacgccaagaatgccattaactgctgacgttaatgcgacatatccgatcaccattgccaaaataacgataaccatgttcatgccgacaagcatactgttagaaatcgtagagaaaaagtctttcttctcttctttaggcggtgtatagatgatatcttcatcctccggcacgtgaacaggattcagcaggtttgcgataatcagcgcgtttaagcagttcaaaggaatggctgtaaacacgtatgtcgcaggcaccattgaaagataagatccgataatggagccgctgatgctgctcatgctcattaaaccgaatgtgagcaggcggttgttgcttaaaaccgtaagctgctggcggatgaccgcaagtgcttcggtatttccaaggaacatcatttgaatagagaaaaagctttctaatttcggcaagcgggaagcctttgaaatcacccatccgattttatcaatcagccaaggcaaaatgccgaaatacgttaaaatatcaaagaatgtgacgataaagataattggaagaagcgcactaaagaaaaagtctactgtttcattcgccatcactgacggaaaggcaaacgcgataccgtcactggcgcaagcaatcagccaagtgaagaaatcaccgattttaccgatggcccagcttccgacttttgttcccagcataaaccaagtaatcagcaattccagaacaattaacgtaatgatcgggcgccacttgattttctttttctgcggagaacataggaatacaactgccataatcacaatgagaccgacaaggtttagtaaaaagtacatgatagcaactcctatgagggttattatggaaacaaaaaaagctcttatccttcacaaattctggaagtgcagaaagtgtgaaaaataagagcaaacagaaaagaacttgtccttttcaactcgttcaaatttattcaaactttcttgtagtctagttttttacggttactaggtagaaacaatcagaccatattactgatcatatacaagaatgtctttttctaagatgatagcagtattttatcctttcactttttgaaaatcaacctttttaactattttcacaataataaaatttatattctaaaatgagaaaataaaggaaaaacatgctggattgctatgctgatatgatgttggcgggataccagcatgtcagtactgatttttcttcactataaggttccagctcctggatatttgttgtatgatggaaacggggaaacccatacagcagaaagggagtttttttcatgattatccaattcattcgttatagataatgacaggtgtagacaaactgccagacctggccaatttttgagataggcctaggtttatttgtctatgcctttttcatttatctaaaaatgaatgaatggggtgttttttatcatgaagcgaacagttgatttcagcatgtttcgatgcccgctctgcgattcttctatggatgcggcatcagggaaaagcttgatttgtacagaacgaggacatacatttgatctatctcggcacggctacgtgaactttctgacgaagccggtcaaaaccagttacggtgccgagctttttgaagcgaggagcaggctgattggagaatgtggtttttttgacccgctccatgatgcgattgcagagctcatcagtcatcccaaatctggtcatgaggcattcaccatcttggacagcggttgcggtgagggttctcatttgaatgcgctttgcgggtttgattatgcagggaaagcagcgataggaaccggcatagatctttcgaaggacgggatcttaaaagcttctaaggcattcaaagatctgatgtgggcggttgccgatgtggcgcgtgctccttttcatgatcgccaatttgatgttgttctgtctattttttcgccgtccaattatgcagagtttcatagactgctgaagaatgatggcatgctcataaaagtagtgccgcgaagcgactatttaatagaattaaggcaatttttatatactgattcaccaaggcgcacgtattccaatacggcagcagttgagcgttttacagcaaatgcagcacacagccgtcctgtcaggctgcgctatgttaaaacgcttgaccagcaggcgatccactggcttctcaagatgacgccgcttgcctggtcggcgccgaaagatcgagtcagcctgctgaaagagatgaaatcagccgatattacggttgatgttgatatcctaataggaatgaaatgaatggtagaggaaagctccgaaaaaaggagctttccttttttaatcggaatagttggcccacgcttctcgtacatatggaaaggggacggaaacagccgatgcggacaggtttttgtaaacgctttctagttcgcggaaacgggggatgtgtgtgtggaactgatcatcattctattggcgttaggtttgctgatgtttacggcgtatcggggattttctgtcatattgtttgcgccgatttgcgcgttattcgcggtgctgctgacagatccaagccatgtgcttccttttttttcatcaatttttatggagaagatggcgggttttattaagctgtatttcccagtgtttttgctcggtgctatttttggaaaggtcgttgaaatggccgggcttgcggcatcaatcgcgaaaacaattgtccggcttgtcggggcaaaaagagcgatacttgccattgtgctgatgggtgctgtcttgacgtacagcggtgtcagcctgtttgttgtcgtatttgctgtatatccttttgcgaaaaacatgttccaagaagcaaacataccaaaacgcctcatcccgggtacgattgctttaggagcttttacgtttacgatggacgcacttccgggaacgccgcaaatccaaaatgtcatcccgacgtcgtttttcaaaacagacatttatgccgccccttggctgggtttgatgggcgcagtgattgtgctggcagctgggatgctctatttggaatcaaggcggaagaaagcgcaggcatctggcgaaggctatggcggttttgattcgcagaatgctcctgctcctgaatcgattgagtccgcggctgaaccggacaaaagcccgattcggcacgcgcttgcctttgtcccgcttattctcgtcggtgcagtgaataaatatttcaccatttacctgccaaagtggtatccgaatggatttgatttttcttccataggattaaaggagttcggcaggcttgatatttcttcagcggctgctatttggtcggtggagattgctttagtgattggcatcatcacaacgatattatttgattggagaagtgtgtttgcccaattgaaggaagggctgaatgaaggaattggcggcgccttgctggcatctatgaatacgggtgctgagtacgggttcggcggcattatcgccgcgctgccggggtttcataagctgagcagcggaatttcacatacttttaccgatccgcttgtaaatggcgccgttacgacaactgcgctggcgggaatcaccggctcggcttcgggaggaatgggcattgcgttaagcgcgatgtcagaacaatacttacaggcgattcaggcttacaatattccgccagaggtgatgcatcgggtcatttcaatggcatcaggcgggatggatacactgccgcataatggcgccgttatcacgcttctggccgtgacgggtttgacccaccggcaatcctatcgcgatatttttgcgatcacgctcattaaaacggctgccgtatttgctgtgatcgcgatttacagcctgactggtctagtgtagaagaaaacgaaaggggcatcaatatgggaaaagtgctgtcatcaagcaaggaagctgcgaaactgattcatgatggggatacgctgatcgcgggagggtttgggctgtgcggcatccctgaacagctcattttgtctataagagatcagggagtaaaggatttaaccgttgtcagcaataactgcggagtcgatgactgggggcttggtttgcttctggctaacaagcaaatcaagaaaatgatcgcttcctatgtcggtgaaaataaaatttttgagcggcagtttttaagcggagagcttgaggtagagcttgttccccaaggaacgctcgctgagagaattcgtgcaggcggtgcaggcataccgggattttatacggcgacaggcgtcggcacctccatagccgagggaaaagaacataaaacattcggcggccggacttatgtgctggagcgaggcattaccggcgatgtggcgatcgtcaaagcgtggaaagcggacaccatgggcaatttgatttttaggaaaacggcgagaaatttcaatcccattgccgccatggcaggcaagatcacgattgccgaggcggaagaaatcgtggaagcaggagagctcgatccagatcacatccatacgccgggaatttacgtacagcatgtcgtgcttggcgcgagccaagaaaaacggattgaaaaacgaacagttcagcaagcatcgggaaagggtgaggccaagtgaaggaagcgagaaaacgaatggtcaaacgggctgtacaagaaatcaaggacggcatgaatgtgaatctcgggattggaatgccgacgcttgtcgcaaatgagatacccgatggcgttcacgtcatgcttcagtcggaaaacggcttgctcggaattggcccctatcctctggaaggaacggaagacgcggatttgatcaatgcgggaaaggaaacgatcactgaagtgacaggcgcctcttattttgacagcgctgagtcattcgcgatgataagaggcgggcatatcgatttagctattctcggcggaatggaggtttcggagcagggggatttggccaattggatgatcccgggcaaaatggtaaaagggatgggcggcgccatggatctcgtcaacggggcgaaacgaatcgttgtcatcatggagcacgtcaataagcatggtgaatcaaaggtgaaaaaaacatgctcccttccgctgacaggccagaaagtcgtacacaggctgattacggatttggctgtatttgattttgtgaacggccgcatgacactgacggagcttcaggatggtgtcacaattgaagaggtttatgaaaaaacagaagctgatttcgctgtaagccagtctgtactcaattcttaatgggaaggtgtttgacatgagaaaacaagtcgctttggtgacaggggctgccggcggaatcggattcgaaatcgcaagagaattcgcccgggaaggtgccagcgtcatcgtttcagacctccgtccggaagcatgtgaaaaagcagcctccaagcttgcagaagaaggctttgacgcggcggccattccgtatgatgtgacaaaggaagcgcaagttgctgatacggtgaacgtcatccaaaaacaatacggccgcttggatattctggtgaacaatgccggtattcagcacgtcgctccgattgaagagtttccgacagacacctttgaacagctgatcaaggtcatgctgacggctccctttattgcaatgaagcatgtttttccgatcatgaaaaaacagcagtttggcagaatcattaatattgcgtctgttaatggattagtgggctttgcagggaaatccgcttataatagcgccaagcacggcgtcattggactcacaaaagtaggggcgctggaaggcgcgccccacggcataacagtcaatgcgctctgtccgggttatgtcgatacccagcttgtacgcaatcagcttagcgatctatcgaaaactagaaatgtcccttacgactctgtacttgaacaagtcatttttccgcttgtgccgcaaaagcgactgctttccgtcaaggaaattgcggattatgccgtgtttttggcaagcgagaaggcgaagggcgtcactgggcaggctgtcgtccttgatgggggctacaccgcacaatgacataaaaaacacacttgctccgctagggaatcaagtgtgtttttttctttgcttatttccaaacatcattagcgatctcaaccacatggcggagcttcgcccattgctgttcttcagtcagcttgttgccttcctcagttgaagcgaatccgcattgagggctgaggcaaagctggtctaagcttacataacgggacgcttcttcgatacggcgtttcacgtcatccggattttcaagctcaccgaatttagatgtcactaagccaagaacaagctgaagatcagaccgttttacgtaacggagcggctcaaatccgcctgagcgtgaatcatcatactctaagaaaagtccgtcaagattcaagccgtcaaaaatggtttcggctgctgcgtcatagccgccttccgctgtccaagtggactggaagttgccgcggcaaatatgcatggttaccgtcaagtcatccgggcggtctgcaatcgcgtcgttaatggatttcgcaaacagctggcgaagctcgtcaggcgttgttccgaacgcttcgatttgttttaagcctttttctgataagaaaacggcccacgctgtatcatcaagctggaggtagcggcagcctctgtcataaaacgcttgaatcgcttttttatatgctttggatacatcgtgctggaaaagttgataatcgtttttgtattcatccttttccagttttccgcggaaaaacagcatattcggacttggaatcgtcatctttggcgtcgcgtcaccggcaatgctatggagaaatgagtaatcttcaagcattgggtgagttgaaaagtcgatatcgcctgtgactttaatgccgcgtgcttttgtctgtacgttatggaattgaatgccttgctcaggagtaaacggctcaacgccatctaagttttccaggaaatcaaagtgccaccatgctctgcggaattcaccgtctgtcacgacgttcaggccggtttccttctgtttttccacaatgcggatgatttcgtcgttttcaatttggcgaagctgctcagcggtcatttcgccggccgctttttgcagccgcgcttttttgacgggctcagatcttagcaggcttccgacttgatccgcgcgaaacggcggtttttttctttgaagtgatttttgttctgcgggtgttgtttgttgtgacatgttgtccattccttctttccattcaaatataaaaaagctcttcctttggataaggaagagcttgcgtgacaatctcaaccttatcttcaagagcaatcattgctctaaaggatttagcaccattctgttaaacagcggttgccgggtatcgcagggccagtccctccacctctcttgataaggaaaacctttttattaaattttctgatagtatctattattcacacattttctatttctgtcaatgatagattatctccacacatcgttggcaatgtcgatgacatggcgcagctttgcccattgctgctcctctgtcagaaggttgccttcttctgtagaggcgaaaccgcactgcgggctcaggcatagctggtccaagctgacaaaacgcgcggcttcattgatacggcgtttcacatcctcaggattttcaagctcgccgtatttcgatgtgatcaagccgagcacaatttgcagatccttgcgcttcacaaaacggagcggatcaaagtttccggagcggtcatcatcgtattccaagaaaaggccgtcaaggtttaagccgtccaaaatcgtttccgctacagcgtcgtaccctcctgatgccgcccaggttgagcggaagttgccgcggcaaatgtgcattgtgatcgttaaatcgtcaggccggtctgcgacggcatcgttaattgttttggcaaatatggctggcaatgtttctggatcaccgccgagcgcccggacaacctctctgcctttgtcctcaaagaagagagaccatgacgtatcatcaagctggagataacggcagccagcatcatagaaggctttgattgcttttttgtacgcttgggccatatcatgaaagtattcctcttgatcgtcataaatccctttatccgccttttcgccaaaaaacagcatatttggactgggaatggtcaattttggcgtcgcgttaccggcaatctcatgtaaaaattgataatcaccgagcgctgggtggctcgtaaaatcgagttttcccgtcactttgatgctgcgcgctttcgtttttgtgttatggaactgaatcccctcagccgggatgaacggttccacaccgtcaagcccttccaggaagtcataatgccaccaggaacgccggaattccccgtctgttaccacatcgagaccgatttctttttgtttttccacgatgcgggtgatctcttgattttcgatatcacgaagctgttccgctgtcatctcaccagccgctttttttgccgggcttcctttaccggaacggaacgaagcaagctgccgacatgatcggcgcggaaaggtgctttgcgttgtttttctgttttttgtcctgcaacattcgtttgttgagccatgttattcgcctcttttctgaaatattaagcatgtaaaaagctcttcctttgtgtaaggaagagcttgaacgatcaaatctccgcctcatctgcaagaacgcaatgttcttaaggatttagcaccattctgtttgaaacagcggttgccgggtatcatagggccagtccctccacctctcttgataaggtacaacttcatattcagatttcaattatcttaatattattacttttggatcaattgtcaatgctttttagaaaatactttcatcttcatcgttatataaaaccatatcaagcacgatagcgatggcagtgcaaatcagaacatcttcctcgtatgcaatctgcaagtgataggaatcaccccaactgagccactttttgctcactgacatccggacattttccccgtccgtcagttggaattcatccctccataaatcaccatctatttcccagttaagcccggaaatcacaaatttcggtttggaaaacgttactttcttcgttacctcacaaactgttttcccgccaattgaaatctcatagcgcggcaataaagacattagtttttgttctatggaaacgagcgttttcccagatgagtctgtcatttgtaatgagtctcctaacgagaaaaaacgcccctccaccttgaatgtttcttgttcatcccggtcataaatgtgaaatgcatctttaaatgagaacattttttgtttcataaataactcgatcattgctgaagtctcctttgggtttgccttgtatgaaattacggataggtggcgaaaaggtttcaggctctaaatcaaaacaattttaaaaggctgcgtgattcagcagccttttcgtttgaaatatagaattaggaaagatgcatccggcgtttttggcggatggcgtcaaggtcgattaggttgttgtgatgaggtgcggctgctggcagagggcttgtcttttgcggtttgcggcgattgtccttgctgaaagaaaaaagaagatagccgcataatgcgatgataataaataggatcatattacatacctcccaaaaaaagttttggtactctctattgtacggataaaatgccaaaaagtattcaaaaaattctaaatcaataaataacaagaaactgtccctctaaaacagtattacctgatgacctgaaaatagtcttgaattacgctgtttgctcttgttgatgattggttctatagttactatcgacgataaaataaattcctttatataacttttaacctaagtttacgtaattcgaattacctgtttttgggtgctgttttcttgcttgtttggtttataccctattttgcggaattgaacacaaaaaacccaaattacggagcatttgggcggtacgggtgaatacggattgtatttaggggatttgatgttttatttgaagaagcgtttgaacatttttctgattttttgaaatgggctggatttctttttcatgttaagcggcctggaaatgatccatttttttcaagagactcttggcagcgattgcatgttttgtcattgtttttcctcctcatttgttgatacttgttttacggaggacgtgtttaaaatgtttcattttcacacaaaaaagccagtccttttttggactggcttttggcgttatgcttgcgcttcaaactgctttgcaatctcaacgatgacatttacggctttgaccatgttgtcaactgagatgtattcaaatttgccgtggaagttttccccgcctgtaaagatgtttggcgtcggaagccccatgtaggacagctgtgatccgtcggttccgccgcggatgggggaaatcttcggttcgatgccgaggttttccatcgcttgcttggcaatgttgacgatttcgatgacaggttcaattttctctctcatgttgtagtattggtcgttcatatccagcagaatccggtcttgcccgtattcgttttgaagttcttcaacggcacgcttcattgtttcttttctgttttggaaattctctttgtcaaagtctctgataatgtagtggagctttgtttcctctacgtctccttgaatcgacagcaggtggtagaagccttcataaccttccgtatattcaggcgcttcgtctgccggcagcaggctgttcagcttcatcgcgattttcgcagagttgatcatttttcctttagctgttccgggatgtacgttgttgcctttaatcgtaatttttgcggcagcggcattgaagctttcatattcaagctcgccgagcggcccgccgtcaaccgtgtaggcaaaggatgcattgaaccgtttcacatcaaatttgtgcggccctcttccgatttcttcatcaggcgtaaaggcgactctgattgtgccgtgcttgatttcagggtgtttgatgaggtaatccatggctgtcatgatttcagcgataccggccttattgtctgcgccgagaagggtggtgccgtctgtggtgatgagtgtatggcccttatagccggacagctcagggaattgatcaggtgacagggtgacctgcagctgttcgttaagaacgatgtcttttccatcatagctttcgatgatttgcggattcacatttttgccggtaaagtctgtagcggtgtcgacgtgagcgagaaagccgattgtcggcacgtctttttcagtattggagggaagagttgccatgacatagccgttttcatcaatggctgcatcctgcatgccgatggacttcaattcatcaactagcatgtttcctaatgtcaattggccgggtgtggaaggacaagtgtcaacggattcatcggactgtgtatcgacttttacatatgtagtaaaccgttcaatgatttcttctttcatttccaatcatctcctttgtcttattttagcatggcgggatgagagatttctattgcacaataccgtttcgaatggcaaaaacgactgcctgtgtccggtcttgggcattgcatttttgcaggatgcggtgcacgtgggttttcacagtgctttcactgacgaaaagcttttcagcaatatcctcatttctcagtccgtaggccatttgctgaagaacctcaagctctcttttggtgaacggctctgccagttcttcggcatgagtttgctgtttcgcccgaaatgtctcactgatgattttagcagctgtgactgtacggaaaatcgcctcgcctctggccgcagcgcgaatcgcatctatcaactcctcaggaagtgtatccttcagcagatagccgactgcgcccgcacggatgccttcaaatacgtattcttccgtgtcaaaggtggttaaaatgactatctttgtatttggaagtgcggacataatgtctttcgccgcttcgatgcctgagcaacgcggcatctggacatccatgaggatgacatcgggttttgtttgttttgcgagtgctataatatcgtgaccgtcgccggcctcgccagaaaccgtcatatccgtctgtgcgttgatgacgtagcggaagccttcacgcacaagcggctgatcatcggcaagcgctacgcgtattttatctttgttcatctttttgctccttattcgttgtcatgagcggcaatgacagctcaattttcaggccgctcggctgtacggcactgaaagtaagggaaccgcctgctttttctgcgcgctctttcattcctgtcaggccaaatccataagtaaggctgccggtgaattgtccgtcgtcggtgattgtgacatagagatgggacttgtcattagaaatgacggccgccgcatgagaagcgtcagcgtgacgaatgatattggtcagcgcttcctgcaagatgcggtagatcgtttcgctcacgtttggaggccaagactcttctgacagtccggcagtatctaaagaaacgtgcaagccgctccgttcctccacttgatgaatgagcccccgcaaagcggtaagccccaccatcgattcactacggcccatttggtgaacaacagaccgcacttcttgaagacactccctggcgacactcagtacattttgaatgactttttctgaatcctccttgctgcttttaaggatatagggaagggattgaagctgaacaatcacagaagtcagctcgtgaccgatgctgtcatgaatgtcgcgggcaattcttgtacgttcctcaaggaccgcgtaccttaatgaaagaacagaagcctcctgcagctctgcatgcgctttctggagttctttatgagcatgctccagctgcacatgcatttttgccaattcagcatgattccgttcagcctcccttctcgcttctcgtctgaaacgcatggaggagaagaggacgtacagaccgagcatgatcgagatgttgctgatgatggtattcaagcttcccccttgtgaggataggagtaatatgttgcctccaattaaacatgctgtgaagatcaaggatagccgtgaagggagtctaaaggcggcatatatcattaaaaatacaatcaaaaaataggcggcaccctgctcttggccggaaacagcccaaaagaaatcggtcaggagccagagtccgatgaatatgctcaaactaacagcagtggatgccacatagggaatgatccaaatgaatgctaagtataccgcaaatacaaatgctaacaaaatgggatcagccttagttggatgagataaaaattgtatgcaattcaaaatgagaataaggctcggcacaagcttcttgtagtagtgccgagccggagtttgtccgttcatgctggtccttctttcggttattgaatggatactttgccagcggtcagtcgtctgtatgctttgtaaagcatgatgttgcgggctgtgatggtgccgaggggaacgaagaagatagaatgaataatggcaataaacatctcgttgctctcaggcagccatgttctcgcggccatgcgcaaagaaagtatcactagaatgaggataacactcccaagtgagccgcgtgaagtgacctttccggtttccgggtgaatccgtacatttaccatcttcccaatgccaaacccgcaggccagcccgatcagtaataaaatgccgctgatcgccacatgtaatacggaatgaaaatacgccggctgaaacgatgcagatacgccccataagagcaacagtggaatgatcagcaacttcccgggctttaccgttctttctcgatacatcgataaaataataagaatcaatacaataaaaatataagggctcatcgccatgtcatcaaatcctttctgcattaagcatagcgaaaataggaaagaaaaacgtcaaccggcagattgatttttcagctctatacttgttcgcgctgcataaagtcatgtaacatggcgtgaaaatgctgaatgtcttcgctgtttcttttccacatcataaacgtttgggacgcaggcaattctagatgtgcaggcgtgctgacagccatcagctttttttcggcttcttcctgtttgataatgtaggtagggaggaaagatgcccccattcccgctttcatcatgtggacagccgtatccgtctgcccgacagccatcatttgaagatacgggtaatgtgatcggatgttatctaaaaaggcatccccatatgacggatgatcatgcgttagcagccgatagcgggttaagacggatgcagcatccggtctgctttcttggaaaggagccgccagacaaagcgtaccttcgcatatatgctgataataaagagtgttggtgttcgggtctttccgcgacaaaccaatatcagcttcattgtgttccaccgcttgtttaatagcgtcagatccagccacatgagttgaaagctcgacatgcggatgtttttggatataggctggcagaaagcgaggcaagatataggacgcaatgtaggggtgtacggccagcgtgagtgatcggctgtacccctgtttccattgactgactttctgctttccagcttggtaaacatggatcatttctttggcataaggcaaaaagagcctgccttcgtcagtcagtacgactcgtcttccgctatgcaaaaacaacctcatgtccagttcatcttccaatttcctcatatgctgagaaacggcaggctgtgtgagatacagatgctcagccgcctccctgaagctctctgattccgctgcggcaataaaggtttgcagccattttaaatccatgaaatatctccttcactgcaagttatccataacaaattgttacgtttacatgcgtatttgtttatcactgattatacatcgattcgtttagtatacctatagaacgagaaaatagagagagggattcatatgaacatatacgtagaagcaaatccatatttacatgacaagtattcaaaatacgcggatgaaaaatataagagagaaggaaacccatttgtatcctttccaattcattttgatgacatcccgtccggagcaaagacgctcgcacttactttcatcgatcatgacgccattcccgtatgcggattcagctggattcactggacagcggctaatattccggcttacatcggagagcttcctgaacatgcgagtgaggaaagacaggacttgatgatacaagggcaaaacagctttgcttcaccgcttgcgggaagcaacgatccaaaggtgattcaccagtattgcgggccgacaccgcctgacaaggatcatgcgtatacattgacggtctatgctttagatgctgagctgaatcttcagccgggcttttacttgaatgagctctatcaagaaatgaaagagcacattcttgctgaaacctctatcgaattgctggcaagggtttaagctaaaaaatatgaaaaaactattaataaacgattaaacttcttaaaaatggatgtggaccggttctaaacactatataatgaaaacaggtcattttttaggagggtttacatcatggcaatacttgttactggcggtgccggttacattggcagccacacatgtgttgaactattgaacagcggctacgagattgttgttcttgataatctgtccaacagttcagctgaagcgctgaaccgtgtcaaggagattacaggaaaagatttaacgttctacgaagcggatttattggaccgggaagcggtagattccgtttttgctgaaaatgaaatcgaagctgtgattcattttgcagggttaaaagcagtcggcgaatctgtggcgattcccctcaaatattatcataacaatttgacaggaacgtttattttatgcgaggccatggagaaatacggcgtcaagaaaatcgtattcagttcatctgcgacagtatacggcgttccggaaacatcgccgattacggaagactttccattaggcgcgacaaatccttatgggcagacgaagctcatgcttgaacaaatattgcgtgatttgcatacagccgacaatgagtggagcgttgcgctgcttcgttactttaacccgttcggcgcgcatccaagcggacggatcggtgaagacccgaacggaatcccaaataaccttatgccgtatgtggcacaggtagcagtcgggaagctcgagcaattaagcgtattcggaaatgactatccgacaaaagacgggacaggcgtacgcgattatattcacgtcgttgatctcgcagaaggccacgtcaaggcgctggaaaaagtattgaactctacaggagccgatgcatacaaccttggaacaggcacaggctacagcgtgctggaaatggtcaaagcctttgaaaaagtgtcagggaaagaggttccataccgttttgcggaccgccgtccgggagacatcgccacatgctttgcagatcctgcgaaagccaagcgagaactaggctgggaagcgaaacgcggccttgaggaaatgtgtgctgattcctggagatggcagtcttctaatgtgaatgggtataagagtgcggaataagaatggaggccttctcaattgagaaggccttttttaaagaacaagggtgcctaaacaggcacccttgttagctgttatttgattttcacaataacatcattactgaattttagtttccaagtgccttttgcataagcttccttgtcaacttcaaatgcttttacacctgttactttaatattaggatttagatcactcaaaattttagagttatcaacttttgtctcagttgcatagtttacagaagcatcaatatcagaatcataagaagtaccatcagcatcaactaatttaacagttggaattgaaaaagagctaatcggctttttagatacgtttttaattgtatattgaacagctacaattgtacctccctcagatgctttcttttcaacatattgagtaccgacagtatctctgtcctctaccttcgtaaccgtcacttcagttttttcagtttttacggtatcaccgatattgtatgttttttcagtttctgctttgctgctgcttgatgttttggaagtggcttctgagccgcctccgccgccaatcatattaccgataataatgatgacaacaactgcgagaataaacgtaatgattttatgtcgcataaaaaagttacgttgatccttaccgcagttaggacatttttttacaccctttgcaatttcttgaccgcaagctttacagggtactagttttcctgccattatatttcctcctatgtaataaaatgtacgaaacatatgtactataatgcctatattatttctcttagtcaatataaaattatgaatttcttataattattatcatttatagttacattcgcttgtaaaatatatgctttttttcttatcggttatatctgttcttttttaatagataaatcgtatttttttccagcttatctgatgaaaactccgcaaataccccttgaaccaattcgaaccgtcccttataatgctaatattggaaagtgaaaaggatatgataaaaacagtggttttctagggttccgcaatgcaaattggactgtgaccgagagaaaacacatagcagcttggctgttatgacacggtgggataaaagcccaggagtttctgctctttttcgagagcgttctcctgggtttttttatttgctagaacagaacaatgaaaaggagtgttttcgtgatgaaaaagagaatgctggatgtacttatgcttgtgattggcgcttttttcttcgcgcttgcggttaatttatttgcgattcccaatgatcttggggaaggcggagtcactgggattacgctgattttgtattatctgtttcaatggtctcctggtgtcacgaactttatcttaaatgcgtttttgcttttaatcggctacaagtttcttgatggaaaaacaacggtttatacgatcattgcggttgcggcaaattcgctttttcttcatctgacacatgggtggagcattccgtctgatgaattgatcattaatacgattttcgcaggtgtatttgccggagtcgggatcggcatgattatccgggtcggcgggacgacggccggttccgcgattctggccagaattgctaataaatatttagactggaatatcagctatgcactcttgttttttgatttaatcgtagtatttagctcttattttattattggtgcagaaaaaatgatgtttacgatcgtgatgctgtatatcggtaccaaagtgatggacttcattattgaaggtttgaatacgaaaaaagccattacggtcatttcagaaaataagagtgagattgcagagcaggtaaataccttgatggatcggggcgtgacgattttatcagggaagggaaattatacgggccagtcaaaagagattttgtatatcgtcattaacaaacaggagctgtctatgctgaaaaaaatcattagaagctgcgacaaaaaagcgtttgtgatcgtacatgacgtacgcgatgtgtttggcgaagggtttgtggatatatctaaataaagaaaaatccctctgtacttgaaacagagggattttttcatttagaacggatatttgcggtattgcttctgtatcgaaatccatttcgtcacggtaaattcctcgacgacccacggattgccgaaacggccgacaccgcttgctttgtttccgccaaaggcaatattcggcgaatcattgacggactggtcgttgacatgggtcatgccgctgtcaatttgcagggcgaacttttcgcctttttctaaatcagaagtgaaaaccgcagagctgaggccgtattcagtatcatttgccatgtcaatcgcttcctggtcgctgccagctttaataatggttgcgattggggcaaacagctccgtttgggcaattttgctgttgttgtccgcaccgacaaagacgtacggcgtcagcacgtttccgacgcgttttccttcaaccgcaagctcaatgccgtctgtctttgcctgctcaatgatctccagcgctttctcgatttggcgctcgttgatcagcgggccgacaacggttttcggatcggtttgatcgccgtacggaagctgtttgacacgggcggtgaatttttctacaaactcatcgtatacatcttgatgaacgatgatcctgttgataatcatacagatttgtccctggtgaataaattttccgaaaatcgcggcatccacagcacgatcgacatccgcatctgaaagaacggcaaatggattgttgccgccgagctcaagtgccattcgtttgaaggcgcgaccggcgatttcaccgatgtggcgcccgactgctgttgaccctgtaaagctgattaatctcgggattggattggtgagcatgccgtccccgatttcctttacatccgtcagcatgacgttaaggacaccggcaggaagaccggcgtgttcaaacgctttcgcaatgatggtcccgccggaaatagcagtttggatatcaggcttgtgaacaacgctgttacccagcgcaattgcgggcgcaatggatctcatggatagattcattgggaaattaaatggagaaatcgatgaaatgacacctagcggaaggcggtaaatcttattggttttcccttcaatgtcggatggcacctctttgacgccgcctaattcaccagtatacgtcatggcttcatctaaaatcgcaatcgtttgttccagctcgattgttgatttaatgatcgttccgccagtttcgcgggcgatcatcataatgatgtcatcacggttttcgtgtaaatagccgcgcgctttttgcagcacggcttttcggtcttccgtcgtgctcttggcccactctttttgggctttctgtgcaatgtcaaacgcatcctcaagctgtttgcccgttgccaaagatgctgttgtgatcacagactggtcatacggattcaaaatgtcctccgtacgtccgctttctcccccagtccattttccgttgataaaacttttgtttaacgtttcgaaactcataagatgaccctcctttggtcctgcatgtcttcttctatttccgctgaagccaatatgtaaacgaatgaggtttccctttcagtttctcgtctatctataccggatatactcttttttagtggagaacatgtgtgtttcgccttatactgaatatacagatccttacataagagaggagactctatgaaatcgctgctggctatttatcccggttcgattgtgtctgaggagctttgcataagggaaggctgtctatgtttttttgatgagagcaatcagagatatatctccattccgaaaacagagatcagtgaaaaagaagtattggtgctgcagtcatttttgacgcctgcggatgagggcaatcaactgtctatgaaatcacctgaggaaaacaagtggttttcgttccttttttccagaggggaattgccggcgtatataaagaaacggacgagatttgttcactttcatttattcggcaaaatagaaaggacgtcctttacggaagcggttcgccatttttggccggtgtcttttgtgattgtgtggatccatgaggacagaggtgtgattgtcgagcaggaaagtgaagcggcggcggagaaggacgaactggaatcgctcgctaaggttcttgaaagtgatttctacttcagtgtccgtttttacgccggaagattttacgagccggatgagtgtctgcgaaaacattacgctcgtgaacaggcgtatttcctgtttgctgaaaaacggctgcctcaggtgcagagtgtgacctttgagatgatctttccttttctattattagaaacagaaaaagaaaaactggaaacactgctctctgaagaagctgagcttttatttggaagtgaatctgagctaaggaagaccattaagctgtttattgaaaacaactcaaacgtcacattaacagcgaaaaagctgcatctgcatcgcaacagcctgcaatatcggattgataaatttattgagcggtcagggatagatatcaaatcgtacaaaggcgcgcttcttgcctattttatctgcctgcaaaatgaaagttcagaataaattggaaatatgcacgaaaaatggctgggtgattttatgaacgctgcccattttagcgagagggaattgctgttacactcaatataagaaagcgtttacaataacaaagggggatgttagatggctgaattgcggatggagcacatttataaattttatgatcagaaggaaccggcggttgatgactttaaccttcatattgccgataaggaatttatcgtattcgtcggcccgtccggctgcgggaaatcaacgacgctgcgaatggtcgcaggacttgaagaaatttcgaaaggtgatttttatattgaaggaaaacgggtcaatgatgtagcgccaaaggacagggatatcgcgatggtatttcagaactacgcgctttatccgcatatgacggtctacgataatatcgcgttcgggctcaagcttcggaaaatgccgaagcctgaaatcaaaaaaagagtcgaagaagccgctaaaattctcgggcttgaggaatatttgcaccgtaaaccgaaagcgctgtcaggcggacagagacagcgggttgcgctgggccgggcaatcgtgcgggatgcaaaggtgttcctgatggatgagcctttgtcaaacctggacgcgaagctgagggtgcaaatgcgggcggaaatcattaagctccaccagagattgcagactacaacgatttatgtgacgcatgaccagacagaagcgctgacaatggcgacacggattgtagtcatgaaagatgggaaaattcagcagatcgggacgccgaaggatgtatatgaattccctgaaaacgtctttgtcggcgggtttatcggatcaccggcgatgaattttttcaaaggaaagctcacggatggcttaatcaaaatcggttctgcggcattaaccgtcccggaaggaaaaatgaaagtgctgcgtgaaaaaggctacatcggcaaagaggtcatcttcggcatccgtcctgaggatatacatgatgaattgattgtcgtggaatcatataagaactcttcgattaaggcgaaaattaatgttgcagagctgctcggttctgaaattatgatttattcgcagatagacaaccaagactttattgcgcggatcgacgcccgcctcgatattcaatcgggcgatgagctgacggttgcatttgatatgaataaaggccatttctttgacagtgagacagaagtgagaatccgataagatcaaaaaaaccggacatggagacatgtccggtttttttgctattgaaaatctcagaatcaaaccgatgaaaaaggaggaagaaatagacagaaagcaggagaacgatgaaacgattgtttttaagcatctttcttttgggcagctgtttggctcttgcggcttgtgctgatcaagaggcgaatgcagagcagccgatgccaaaagcggaacaaaagaaaccggaaaaaaaggcagtacaagttcagaaaaaagaagacgatacatccgcatggatcaaaacagagaaaccggcaaagctgccgattttgatgtaccacagcatttcttcaggaaacagcctccgtgtgccaaagaaagaattcgaggcgcatatgaagtggcttcatgataacggctatcagacattaacgccgaaagaggcatctctcatgctgacgcaggataaaaaaccgagtgagaagtgcgtgctgatcacatttgatgacgggtacaccgacaattatcaagatgcgtatccggtgctgaaaaagtacgggatgaaggcaacgatttttatgatcggcaaatcgatcggacataagcaccatctgacagaggaacaaatgaaggaaatggcacagcacggcatatcgattgaaagccatacgattgaccaccttgagctgaacggattaacgcctcaacagcagcaaagtgagatggctgattcgaaaaagctgttcgacaacatgtttcatcagcaaaccaccatcatcagctatccggtagggcgctacaatgaggagacgctgaaggccgctgaaaaaacaggctatcaaatgggcgtgacgacagaaccgggcgcggcttcgagagaccagggaatgtatgccctccatcgtgtgcgcgtgtccccaggcatgtcaggctcggcttttggtgcgtacatcgaatcaatgaaataaaaaaaggcggcgtttaatcgccgccccctccgccgccacagccggaatcgctgaaacctccgtcactgctgcatccatcatggtgtgagctatgatctgaataaccgaaatacccgctgtccgcctgctggcggcttttgtttttcgagggctgcggctgaatgactgaaagaaaaacaataatagatataaacaataagatgatcacaatcacttcgcgtcactcccttttttcaccatatctgttatacggatgaaacgctgaccggtttcatttcaaagtgatcgattctttcagtcggtctctgagccagcgctttagcaccccatgtcctttgtttgacaataaagtgccgacacgccaatacataggaggatgaggagcgaactgaaaatcaatcaatctgaaaaaccagcttttatcacgggtgagagaatcaatttgaagctcgtcttcacctgcttcagagctataggcactttgtttctgtatatcctcatcttgccgaaccgccaagattctcaaggcttcagccatttgtttgtaaccgccgtccagcaatgatgcgccaaggttgtcagcacgcacctccatccattgtgaacaaaaggattgatagagctggaataggataatgattgccataatgaaagcccaaagcgcaattttgtgggcctcgggatgggtgatatgctgctcaaacaagaggaaaatccccacgacagctccaagatatagaaaacgcaaaagctgtgatgacagaacgtcacgttttttgatatgaatcgcctcatgggccagaatgccttcaatgacacgctgtggaagtgttagtgtggcgcttgtcaggatgaccattgacctcccgacattcatgcctactgccattccgttgtaatcatcactctccgtttcgtatatgcggacatgggaaatgccggccgatctgaaaatcttatcggccgcggcctgtacatgcggatgatgacaagacttggcgtccatcgccgcccgcaacacacggtctgacatatacatgttgaatacccaatataggattacggcaacagccatgacccatggagaggcgtgtaatgcgtataacgcgagcaccaataaggcgtaagcggataccccttttacgctggcggcaaaataaagcttaccgagcagccgcttcacattttttcgatgataaaacggcaaaacagaaatcacattgtccacattgttttctgcatctgtgtattcctgaagaattgttttccatttttgcggttccttcaccgtcagaaacagtgtttcgccgggaagagacagtttaatgacttgctgaaagcttgttgtcaaatctaaacgggatgaatacatcgtcagaagcggatggagctttaagagatctgctgttgattcaagctgaatgttcttcaaatcggaaagcgggtatgtacgggtttcatagtgtgagctgatatgcaatttttctaaggctgctgaataaaaaacctttacgctaaaaacattcagtattcgcttcacaagtgcccctccgccggagatcattccgagaaggatcacatatttgagagggcttgtgtcaggtccatagatgaaaaaaatgacagcccctgcaaacacaatggcggtcagcgtaatgtctgacaggaggcgtgttttgtttttggcaagctcgatttcctgccagtctcccgaaggtttttccacacgctctgaaacaatgagatccattgcggtccaatagcagtagaacattgtcgcgagtgagacaatgccgtccatgaatgagagatgagagaagatgtaagccgcagcgccgacccatagaacaatatcaatccagaagtctatggccggaatgagttttgcagctagggctgatatcaaataaaatcccagcccgagaagcataaagagaaatagatgagttcccataggcatgccagattcctttctatctagtatttccaactattactatagcatgggatgggaacttgcaaaaacatggacatgcaaaaaagcaagctctttcgtttgacgaagaacttgcttgcggggatcaataaaactggtgcagcagcaataaggttaaggatactgtaatcgcgcccccgatgcgggtagacacctgggcgaaaggcattagctcaagcctttcagcggcgcttaaaatggcaacgtcacccgtgccgccttgcccagaatggcatgcattaataatggcggtttcaatcggatacatgttcagccattttccagtgaagaagccaacggccatcatggtcacaacgacagacagaatcgtgataatattgctgaggttaaaagcggcgacaagcttgtcccacggcgtcatggataccccaatcgcaaagagaagcgggtaggtcacagctgttgaaaagaagcgggacactccaaacgcgccattttcaattgaggcaggcaccaatctgaacagcttgattagaacagccagtaacagcatggcaacgggtgccggaaaaccgaaaaaatcgtgagcgagcatgccgactaagtataaagaaacagcaaggataccgcctgacgcaaataaagaaaggttgaacatttgctgtccgctttgagattcctccagcgcaggggactcttcttcggagcggtccactttgccgttgcctgtccattccggttttttctttccgattcggttcagcaatcccgctagaataatcgcgcacaagctgcccagcataatcgatggcagaacaagtgcaaacgcttccccttgagaaatgggcatgatgtcagaatatccgatggacagcgggatagcgccttctccgactcctccagccatgatcggaatgacaatgtacagcagggtatgctgaaatccgagtccgagcaatgtcccgacagccagtccgacaatagcggctgtgacagaaccgacaataagcggaataaagattttcatgaatgcttttacgagtgtttctcttttcatgccgagaatgcttccgacgacaataccggcgataaacaaatatagaaagtttgagttttctgtaaattctgtggtggatttgacgatatcattaggcagcaggtgatagtacacgacagcggacggaataaaagtagctaggatggccgggccgccgatagaacgaacaatcggtatcgatttgccgatttgggcaaaggtaaacccgaaaaacgccatgacggcaatggatgtcaaaatgtcactttttacatcgtgatgcataacaaaaacagtgattaatataaacagcaaggcatacacaggaagcggtatgatgcctacttttatattcatggctttcgcaaaccaattctcttttcgaaccccttcgtgaattgtatccgtttgcaattgcatgtgtgtttgaagctctcccattgaaaaacctcccctattcttgatgcagtgaaattgttcactatgttaagtatactaaaaaattgaaattattaatatattaaaaatttactattcaacttttctcctcttaccggttcaaatgaaaagaggcattctgactaaaatcggtttaagacggaatgctgagactcgagtgctggggcgggggcaagcattttgttcgcaaggaacgatgtgttgatgtacgataataaagggtcatttatcctagcagccgacataaataagcaacaaaatagacaaaaatccgtcacatagtgcgggactttttaggtattttaggctttatttttgaaatgaatcgttgtaaagtacttaatatgaaccagtcagagattgtgtcatttggtcagtctggcaatcttgcatcatattggatgactttttgacacatttgtgaaatattgagcaatatttttttcgtctattttgtgaattactgatcaaagtctcggttctatttgtgaagtagtgagcaaattaacagttttaaccggaaatggaggagaaagcatgagtgaattggtattagcccgcatacaatttgcatcaacaacgttgtttcacttcttgtttgtgccgatgtctatcgggcttgtgtttatggttgcgttgatggagactctttatcttgtaaagaaaaatgagctgtatctcaaaatggcaaagttttggggacacttattcttaataaatttcgcagtcggtgttgtaacggggattttgcaagaattccagtttggactgaactggtcagattactcccgttttgtcggagatgtatttggcgctccgcttgcgattgaagcattattggcgtttttcatggaatctatttttatcggattatggatttttggctgggaccgcctgccgaagaaaattcacgcgctctgcatatggctcgtatcattcggaacgatcatgtcatctttctggattttaacagcaaactcctttatgcaggagccggtcggctttacgatcaaaaacggccgcgcggaaatgaatgattttggcgcgttgattacaaaccctcagctttgggttgaattcccgcacgttattttcggtgcgcttgccactggagctttctttattgccggagtgagtgcttttaaactgctgaagaaaaaagaagtgccgttctttaagcaatcttttaaactcgcaatgatcgtcggtctttgtgccggtcttggcgtcggccttagcggacacatgcaggctgagcacttgatggaatcacagccgatgaaaatggctgccagtgaaggcctatgggaagacagcggtgaccctgctgcttggaccgcttttgcgacgatcgatacaaaaaatgaaaaaagctcaaatgaaatcaaagttccttatgccttgagctacttggcttatcagaaattcagcggaagtgtcaaagggatgaaaacccttcaggctgagtacgaaaaaatatacggaaaaggcgactacattccgccagtgaaaacgacattctggagcttccgcatcatggtaggagcaggtgttgtcatgattcttgctgcgttaggcggcctttggttaaaccgccgtaaaaagcttgaaaacagcaaatggtatttgcgcatcatgatcgcgttgatttccttcccgtttcttgcaaactccgcgggctggattatgacagaaatcggacgtcagccttggacggttatggggttaatgacaaccgctcaatctgtgtcgcctaacgtaacagcgggttccttgttattctcaatcatcgcattcggtgtgatgtacatgattcttggtgcactgcttgtcttcttgtttatccgtgagattaaaaaaggtgcggagcatgataatcatcatgatgtgcctgtatcaacagatccatttagtcaggaggtataccatggcatctcttcatgatctttggtttatactcgttgctgtattgtttgtaggattcttctttttggaaggctttgatttcggggtcggcatggcgacccgttttcttggccataatgaattagaacgcagagtgctgatcaacacgatcgggccgttctgggacgcgaatgaagtgtggcttttgactggcgcaggcgccattttcgcggcattcccaaactggtatgcaacgatgctgagcggttattacattccgtttgtcatagtgctgcttgcgttaatgggccgcggggtcgcgtttgagttccgcggcaaggtggatcatttaaaatgggtaaaggtttgggactgggtcgtttttttcggcagtctaattcctccgtttgtgcttggtgtgctgttcacgacattattccgcgggatgccgattgatgccgacatgaacattcacgcacatgtatctgattatatcaatgtatattctatacttggcggtgtgacggtaacgcttctttgcttccagcatggattaatgtttatcacgctgcgtacgattggtgatttgcaaaaccgcgcccggaaaatggcgcaaaagataatgggtgttgtttttgtagcggttcttgccttcgcggccctttctgcgtatcagacagacatgtttacacgccgcggcgagattaccattccgctcgctgttttgattgtcatctgctttatgctcgcggctgtatttattcgtaagaaaaaagacggctggacatttgggatgacaggcgctggtctggcgctgaccgtgggaatgatctttatttccctattccctcgtgtaatggtcagctcgcttcatagcgcatacgatttaacagtagctaacgcttcttctggagattattcgcttaaagtcatgtcaattgcagcattaacgctattgccgttcgtcatcggcagccagatctggagctattatgtcttccggaagcgcgtcagccataaggagcctatgacttattaatgggaaaagacctgtttcgatataaaggaatgaagcggattctcaccttgattacttgtttaacgttgattcagacagccgccattattatgcaggcagagtggctgagtgaggccgtaaccggactgttcaacgggaagggcattacctcccttttaccggtgatcggctttttcctcatcgcttttatcgcccggcacgggatgacggtggcgcgacagaaaatcgtctatcaatacgccgcccggacaggagcagatttgaggaaaagttttcttgatcagctgttccgattaggcccccgctttgcaaagaaagaggggacggggcaaatggtgacgctggcgatggaaggcatcagccagttccgccgctacctggagctgtttctgccgaaaatggtcagcatggcgattgtgcctgcggcagttgtcatttatgtgttttttcaggatcggacatcagccatcattttagtcgctgctatgccgattctgatcatctttatgattctcctcggccttgtcgcgcagagaaaagcggatcgtcagtggaaatcctatcagagactttccaatcattttgttgattctcttcgcgggctggagacattgcgtttcctaggtttgagcaagtcacacagcaaaaatattttctatgtgagtgagcggtatcgcaaggcaacgatgagcacactccgggtggcgtttttgtcatcattcgccctcgattttttcacgatgctgtcggtggcgacagtcgcagtatttctgggcctgcgcctcattgacggcgatattttgcttggccctgctttaacggcgcttattctggcgcctgagtattttttgccggtgcgggaagtggggaatgattatcatgcaacgctgaacggccaggaagcaggaaaaaccattcaagagattttgtcgcagcctggttttaaagaagagacgccgcttcagctcgaagcttggtccgatcaggatgagctgaagctgtcaggcgtgtcagtcggccgttcggtgtctgatattcatctctcattcaaaggcaagaaaaaaatcggcattatcggtgcaagcggcgccggaaaatcaacattaattgatattctcggcggatttttagagccggatggcgggatgattgaggttaatggtacaagccggtcccatttgcaggacggcagctggcagaagaaccttctttacattccccagcatccgtacatttttgatgatacgcttggcaacaacattcgcttctaccatccaagcgcttcggcagaggatacaacacgtgctgctgcctcagcgggactgacggagctggtgaacaaccttcctgacggattagaggggcggatcggggaaggcggccgggcgctcagcggcggccaggcacagcgtgtcgcgctggcccgcgcctttttgggaaaccgtccgatcctgctgctggatgagccgaccgcccatcttgatatcgaaacagaatatgaaataaaagaaacgatgctggatttatttgaggataagctcgtctttctcgcgactcaccgccttcactggatgctcgatatggacgaaattatcgtgcttgacgggggcagggttgcggaaattgggactcacaatgaactgctggagaaaaacggtgtgtataccaaactcgtgaaggcacaactgggggaaagagcatgaagaaagaagaatggattttgccgtatatcaagcaaaatgcccgcctgttcgttctggttatctttttgggtgcggtgacgattttttctgctgcttttctcatgttcacctcaggttttttgatttctaaagcggcgacaaggccggaaaacattctgctcatttatgtgccgattgtcgctgtgcgcacctttgggattgcgcgctctgtgtcgcgatatgtggaacggctcgtcggccatcacatcattttgaaaatcgtatctgacatgcgcgtccgcctttacaatatgcttgagccgggtgctttgatgctgcgttcccgttttcgcacgggggatatgctcggcattttgtctgaggatattgagcatttgcaggatgctttcttaaaaacgatttttcctgcgatctcagccttgctcctgtatgctgtgtcagtgatagcgctcggcttcttctcttggccgtttgccatattgcttgcgctgtatttgtttgttcttgttgtattgtttccggttgtgtctttgctcgtgacgagagcgaagaatgcgaagctgaaaagcggacggaatgtgctgtacagccgtctgacagatgctgtgatgggtgtcagcgactggatgttcagcggacgccggcatgcttttattgatgcttatgaaaaagaggaacgtgattggtttgagcttgaacggaaaaaacaacgctttacaagatggcgggactttgctgcgcaatgccttgtcgctggccttattttgctgatgctgttttggacagcgggacagcaagcggacggcgagctcgctaaaacgatgattgccgcttttgtgctagtggtgtttccgttgacggaagcctttttgccgctttcggatgccttaggcgaagtgccgggctatcaggattctatcagacgcatgaacaatgtggctcctcagccggaggcgtcacaaactgaatcaggggatcaaattctcgatcttcaagatgtcaccttggcctttcgtgatgtgacgttttcttatgacaacagcagccaagtgctgcacaacttttcctttacgctgcgccaaggagaaaaaatggcgctgctcggccgaagcggctctgggaaatcaacatcgcttgcattaatcgaaggcgccttgaaaccggactccggttctgtgacgttaaacggagtggagacagcgctgttaaaggatcagattgcggatgcggtggccgtgttaaatcaaaaaccgcacctgtttgatacaagcattttgaacaacatcaggctcggaaacggagaagcaagcgacgaggatgtgcgccgcgccgcaaagcaggtcaagctgcatgactacattgagtcattgcctgacggatatcatacctctgtacaagaaaccggcatccgtttttccggtggagagcgccagcggatcgcacttgcgaggattttgctgcaggatacaccgatcatcatcctcgatgagccaacagtcggcctcgatcctattaccgaacgtgaattgatggaaacggtgtttgaggtgctgaaaggaaaaacgattttatggattacacaccatctcgcgggagtggaagcagccgataaaatcgtatttctcgaaaacggcaaaacagaaatggaaggaacccatgaggagctgctggcggcaaacgaacgatatcgccgcctgtatcaccttgatgttcctgtaaaataaaagacagccctaaaaggctgtcttttttgtttgaaaaagaaaagggacaggaaaaataggaaaagaaagcagaggagggatagagatgaatgttccattttggacggaagagcatgtaagggccacgcttcctgaaagagatgcggagagccataaaggcacgtacggtacggctttgctgctggctggaagtgacgacatgccgggagcagcgctgcttgcagggcttggggccatgcggagcggtctcggcaagcttgtcatcggtacatcagaaaacgtaatcccgctaattgttcctgttttgcccgaggcgacctattggcgtgacggctggaaaaaggcggcggatgctcagcttgaagagacgtaccgggccattgccatcggaccgggccttccgcaaacggaaagcgtacagcaggcagtcgatcatgtgcttacggctgattgtcctgttattttggatgccggagcgctggcgaagcgcacatatccgaaacgggagggccccgtcatcctcacgccgcacccgggcgagtttttccgaatgacaggggtgcccgtgaacgaattgcagaaaaaaagagcggaatatgcaaaggaatgggcggctcagctgcagactgtcattgtgttaaaaggaaaccaaaccgtcatcgcgtttcctgatggagactgctggctcaatccaaccggaaacggggcgctcgccaagggcggaaccggtgacacgctgacgggcatgatattggggatgctctgctgccatgaagatccaaagcacgccgtattaaacgcggtctatttgcatggtgcgtgcgccgagctctggacggacgagcactccgctcatacgttgctcgctcatgagctatctgacatcctgccccgcgtgtggaaacgatttgaatgataaaaaagctgtcttcagagagaagacagcttttcttgataccccgcccgttttttcagacgcggtttcattaatacatagtaaagcacagaaggcacggccaagccgataatccatgcgatgtctccgccgccaaacattttggcaagcggtccgatgtaaaagcttgtgttgataaacggaatttccagcaagatagacagaacgaacgcaattgtggtgatccaattgacctttccataaggcccgtttacgtcgaacatggctttgacttgatactttccgtggcggacgaagtagtaatcgactaaattgattgccgtccacggaattaagaaataactgatgaaaaagataaaattcaaaaacagttccataaaattgctctgtcccagtaggcttaagactgtgccgacaagcgtgacacccaggatcatgatgattctgactttgggcgtgacttttaatttcagaaacggctccagcgttgttgtcgtggacatgaaagccccatacaggttaaaaacattgattgccatttgcccaaatagcacaatgatcagcataataaacgagaagggaccgaacaattggacaatctggctgcctgagtttgccgtaaagtcaggaagtgaggttgtcagcaatgcgccgagcagcatcatccagatggagctgacagatgtacctgcatagctgtaccaaaatgtttttgaagccggtgttttaactggcagatatcttgaataatcggcaacatacggcgcgtaggcaagctgccacgtcgcaactgcgctgactgccactaggaaaattggcagatcaatcgctccgggtatccagctgcctgccggaatcggcaattgaaaaatgagaatcgttgcagcaaaaaatacagcaaaagaggtccaagaaaggattttttgcattttgtgaatcaaatcatggccgaaaatggtgagtaaaaaacatacggcacttaagcctataatgctccatgatcccgggatgggaacaaagctgcttaaggttccggccgccagaatcgtgctgcttgcgaagaaaccaaggtagataaacatgactaagaagaggggaagaatcgctccgattacgccgaattgggcacggctttgaatcatttgcgggatgcctagctgagggccttgcgcggaatgagaagccataaatatggcaccgattaaggttccgcaaataatagcggcaacactccaaaacagattaagtcccattgcaacgggaatcgtgccggtcactaacgtggtgatatgcatattagccccgaaccatacgggaaataaatctttcgctttaccatgtctttcttcattcggaatatattcaatcgttcgcctttctactttcaatgcatcgtcctccatattggatgtttttttgaaatcgacataaagtcatagcttaacagactataagggggtttacaaataaggatatgcagccaaacggccgggaagcctgatctgtcaatggctgaaaagaattgtaaaaaagatgaacgcttttgaatccggtgtcgtctcataaggcagaaaaacaaaaaaggggggatcacggtcattggatacacaagaagaacagcggctgatccagcaggcgaaagagggaaacgacgaggcgtttacagcccttttccactatcactattctttcttatataaatacttgttaaagctttcccttcaccccgatctcagcgaggaacttgttcaggaaacctttctgaaagggtacatccatttaagaagctttcagggccgttcaaaattctccacatggctgatctccattgcatcgcggctctatctcgatcaccagaaaaagagaaagagagaatggaaacggaatcagacagttacggaggaaacaatccgcaagatcaagtgggacgtgtcggcgaaaggggcagagtggagcgaaacgctcgatctgttttcaaagctggaccctaaactgcgcacaccggttttattaaggcattactacggctatacctacgctgaaatcggggtgatgcttcaaatcaaagaaggcactgtaaagtccagagttcataaagggctccagcaaatcagaaaggagtgggatgatgaataaagaaaagctttctgatcatttaaagtcagaatggaaaaaaattgatcaaacagccaatccctctataccgaatcaaaaagaactgcttcaccagctgtcacaaatgaaagctgaatacagaaaaaaacttcttcaagagatcattttatttgtattctgcgcgctgatggttgtgagtgctgcaatcttagctttcactcaagctcctgctgtgtttattgtgcttcaggtttgtgtgcttgcggtgctgccgattttgattgcggctgagaaaaaaaggcatctcggcgaatgcgaggtgaaacgcggatgacacaaacagaaattatcataacggttgcggcttgtctcatcgtattggcgcagggaatctttttatttattgatgcgaaaaaacgtaatcacatggcatgggtttgggggattgtcggattgattcaagcaccgatgcctctgatttgttattacttttttgtcattaggccggatcggaagaaaagggggatcaagcaatgaatatttcttgggaaatgattttgccgctgattgtattacagctggctttggcggtgtttgcccttatcagctgtataaaagaagagcggacgaacgggccaaagtggatgtgggctgcaatcatcgtatgtatcaatattatcgggccgattttatttttcaccgtcggcagaaagcaaaggtaagccgatatgctgtctattgaatcattatgcaaatcgtacaggcaccatgaagctgtaaagaatgtcagttttcacgtgaatgaaaatgagtgtgtcgcactattaggacctaatggagccggcaaaaccacgactctgcaaatgctggccggactgctttcgccaacctctggaaccataaagctgttaggagagaaaaagctggatcggcgtttgattgggtacctcccgcagtatcctgctttttattcgtggatgaccgcaaatgaatttttgacatttgcggggagactgtccggcctttcgaagagaaaatgccaagagaaaatcggcgagatgctggaatttgtcggtttgcacgaagcggcgcacaaaaggatcgggggctattcaggaggcatgaaacaaagactcggtctggcacaggcactgctccataaaccgaagtttttgatattggatgaaccggtgtctgcgcttgatccgacaggacggttcgaggtgctggacatgatgcgggagctgaaaaagcatatggccgttctgttttctacacatgttttgcacgatgcagaacaggtgtgtgatcaagtggtgattatgaaaaacggtgagatttcatggaaaggcgagttacaggagctgaaacaacagcagcaaacgaacgtttttaccctttcagtgaaagagaagctggaaggttggcttgaagagaagccttacgtctcagctattgtctataagaatccgtcccaagcggttttcgagctgcctgatatacacgctggccggtcattattaagtgactgtatccgaaagggattgaccgtcacccgctttgaacagaaaacggagtctctagaagacgtctatctaaaggtggtgcacgcatgaaggtgatgatggcgctattgcagaaggagtggctggaaggatggaaaagcggcaagctgatttggctgccgattgcgatgatgatcgtcgggctgacacagccgctgaccatttattatatgccggaaatcatcgcacatggagggaaccttcctgacggcatgaaaatcagttttacgatgccctccgggtctgaagtgatggtcagcacgctttctcaattcaacacgcttggcatggctctggtcatctttagcgtgatgggcagtgtagccaatgaaagaaatcaaggggtaacagcgctgattatgtcgcggcctgtgacggcagcccattatatcgtgagtaaatggctcatccaaagcgtgatcggcattatgtcgtttgcagctggatacgggcttgcttactattacgtccggctgctgtttgaggacgcatcattcagccgctttgccgcaagccttggcctttacgcgctttgggtgatatttattgtgaccgccggccttgccggaagtacgatattccggtctgtcggagcagctgcggcttgcgggatcgggctcacagcagccgtttcctttgctgtttcattatttccagatggtgcgaagtggcttccggctgagatttgcaagcaggcggagcatatccttcttcatggagagcgggcagattttttcggatggtcactcactttctccattctgtgcatcatgcttctggccgtgttttctgtgtggcgcttccggcggtatgaaagctattaattgatcatgttacgtttttgcgcgagcatcacaaaaaaggcggcaaatgccagagacccggctccataaaaaactcccgcaagcccgacaagctgtgcgatttttccggcaagaaggggcccgaggaagatgcctagcgcataaaatgattgataaaaccccatcactgacatttttaaacgggcagaactgatttcgacgacatggcttagcagcagaggaaaaacgaagccgagcgccagtccgatacaggcgtgtgtgatgcaaaccgtgaacaatgcagctgaaaaaggaacgtatagcaaacagaccccggtgacagcgaaactaatgagcatcacgaagtaagcgatacggcttgtaaagcgcagaaacacaaagcttaatgtggcggctgcgtgtgggaggaaaaaggcgctcatcacccaaagaagctccgcgtcgcccattccgagctgattcatgtaaagcggcgtaaaaccaaacactgtgataaataatacggcatgggccgtcatagacaggatggtgaaaagcttcagctttggcagccgcaatgtatctttgatgtactgattgacacgaatggtgccacggtttgcgggaggagcagacggatcctgaataaagcagcagatcaccagacctgcggcagaagctgccagcgccatccaaaaaggaacctgcctccctaaatgggctgcggcgagcccgcagaacacaatgctggcaaactgaggcatgacggtaaaaaactgcatgatgcccattgcttttgatgcattgccattgttgaaataatgtgcgtataaaatggtcgccatcacccacgtagaagcagtgattcccgcgaaaagccgggcggccagcacgaagaagaaagaatcaaacatcagaaaaagcaggctgctgaggacggaaaagccgaacccggcaattaacaattgcttgcgcaaggaaaacaggatgtctgacaaaaggccgagcgggaatcgcagaaggatttgcgtgaccccgtagctgccgagaatgatgccgattgcgccatatgaaaagtgcagatcctccaaatacagactgaatacaggaacgtaaatatagcctgaaaaccagaaacaaaataccatgcataaaaaaacggcgtgatctaaagcgccgattgtttttttctgaggaatcaagtcctgctgtaattccatcgtatctctccacccctttccttccaagtacaacacaattattgaaagcgtttcaatagaaaaataaaaaaacagggcttctaaaaaagccctgttcgctgttgttaatacggatcagacggatgactctcctgttcagcctgctttgcagcctgttccgtttcagttgtgccgatcggcccgttgctgttgttttcggagaccttttttagcccttctgctacgcgttttccgtagtcaggatcagcttttgtgaaattctcaatcatttgatcctgaatttcttttcggcacgtagaaagcgtattcaccaaattcgtaatcaattcgttccgctcaaattcagtaaatctccggtacgtttctccagcctgtccgaagttgtttgttctgtcaatcgcttcacgctttacatcaccttcgacatgcggcgtatggtcttttccgtcttgcttcgcttccttcagcccgcccataatggatggctcgtagttgacgtgcgggttttgtccttctgctctatcgacccgatattgcatttgcccgccttcctggttggtggcgacatgctttttcggcgagttgatcggaagctgcaggtaatttgcgcctacacggtagcgctgcgtatcagagtaggcaaacgtacgcccctggagcaatttgtcgtctgaaaaatcaagcccgtcgacaagcactcccgttccaaatgaagcttgctccacttccgcatggtagttttccggatttttgttcagaaccaatttgccgatcggtttccatgggaaatcgtctttataccacagttttgttggatcaagaggatcaaagtccagttcaggatgctcatcatcgctcatgatttgagcatatacttcccactctggataatcgccattttcaatcgcgtcatatagatcctgtgtggcatggttaaagtttttcccttgaatctcttctgcttccttctgtgtcaggttgcggatgccctgcttcggttcaaaatggtatttcacgagaacggccttgccctcctcattcacccatttataggcatgtacgcctgaaccctgcatttgccggtagttggccggaatgccccaaggcgaaaacaagaaggtgatcatgtgtgtcgcttcaggagattgagaaatgaaatcgaagatacgttcaccatcctggatgtttgtcactggatcaggctgaaatgcgtgtacaagatccggaaatttcagcgggtcgcggataaaaaagattttcaggttgtttccgaccaaatcccagtttccgtcttctgtatatagctttacagcaaaaccgcgcgggtctctcaatgtttcaggcgagtgttttccatgattcacagttgaaaaacggacaaatgccggtgttttcttgcctttttcctgaaagagcttggcccttgtgtatgttgaaatcggttcgtctccgaagcttccgtacgcttcaaaatatccatgtgcacctgctcccctggcatgaacaacccgctctgggatgcgttcccggtcgaagtggctgatcttttcgagaaaatcatagttctcaagtgttgtaggccctctattcccgacggttctcacattctggttgtcagtaacaggatgcccctgcctattcgttaaggtatcctctgactcgtttttcccggatgtcttatgagaaaacgcttcctcgctcccttgggcatttgattggtgctgcttgttttgatgatcatctttcaatggttggccctccttttttgaacggtaacaatattccctgaatggaaagattttaaaacagccgttttttttgatctgcttcgggaatggtacaatgtacaaaaatcggtaaaaggagaggtcgattcgtgacgagagaaaaaaatccgctgcccatcacgttttatcaaaaaaccgctcttgagcttgccccatcgcttctgggctgccttcttgtaaaagaaacagacgaaggcacagcgtcaggctatattgtggaaacagaggcctatatgggggctggagacagagcggcccacagctttaacaaccgccggacgaagcggactgagatcatgtttgcagaagctgggcgggtatatacatacgtgatgcacacccatacattgctgaatgtcgttgcggcggaagaggatgtcccgcaagcagtattaatcagggcgattgagccgcatgaaggccagctgttaatggaggagagaaggccgggcaggagtccgagggaatggacaaacggaccaggaaagctgacgaaagcgcttggcgtcacgatgaatgactacggacgctggatcacggaacagccgctttacatcgaaagcgggtacacaccggaagcaatttcaaccggcccgcgcatcggcattgacaacagcggggaggcacgcgattatccatggcgtttctgggtgacgggaaacaggtacgtgtcgcgttagcatgtttaaggaagaggcaatcaggggaatggttgagaaaaaagaagggagaatcggagctttgaaaaagatgatcaaaaccgttatcaaatgggcgccggtcatttacccgattgttcgaaaaatcatgaaggaccgcaaggcgtctaaacaaaagaatatgtccgcatctagaacagccggctgatcccggctgtttttttataggtcagttttccctctagtcctccggatgttcattgacttgccattctctccattatagaatttatatacatttcgcatcccttcatcatcctttctgcctattcactgaatccctgcatctactagttaggaggtttttctcatgcttcatgggcgactacgtgatattctgcgcttgctgatggcggctgaagccccggtgacaagttcgttttttgccgcgcaattaaacgtaacgacgcggacagtccgcaatgatataaaggaacttcaaggtgtgctaagcggccacggtgcctttgtacaatctgtaagaggctccggctacaagctccgcattgatgacgagcaagtattcagaacactgctgcaagatgaatttcagcaaaaaaagggcctgccggtattgccggaggagagaatggcctatcttatgaaacgtctgctgctggcggaccattatctcaagctcgatgaacttgctgaagaactatttatctcaaaatctacactccaaacggatttaaaggaagtaaagaaacgtctgctgccttaccgcatcgtcatggaaacacgtccgaattacggcttcaagctgcgcggggacgaggtgcagatgaggtactgcatggcggagtacattgttgatgaaagagaaacggagatagatgttttaaatgaaaaggctgatattttgccaaaagaagaaattgagatcatccgttccgccatcttgaaaaaaatgaaaaacgaccgcatccctctgtccaacatgggactgaataacctcattatccatatcgctatcgcctgtaaacggatcagaacggaaaactatgtttctcttttcccgaaagatatggatcatatcctgcatcaaaaggagtaccaggctgcagaagccatcgtaaaagagctggaatcaaagctttccgttacgtttccgaaagacgagacggcctacatcaccatgcatctccttggcacaaaacgaatgacacaatcacaatgcggagaggacacattttcaatagaagaggaaaccgatcagctgacacttgccatgatcaaagctgttgatcgtgaactgaagcttggcatcctgcatgacaaagagctgaaaatcggcttggcactgcatatgaagccggcgatcagccgcaaccgatacggcatgaatcttcgaaatccgatgctggcagcgatcaaggaacattatccactcgcttttgaagccgggatcattgccggaatcgtgataaaggaacaaacgggtattgagattcatgaaaacgaaattggatatttggctctccactttggcgccgcgattgaacgaaaaaaaacagaaagcccgccgaaacgctgtatcattgtatgcgcatcgggagccggaagcgcccagcttctgcgcgaaaaactgcgttcccatttcggcaagcggctcgatattcttggaacggctgagtattatagtcttgatcaaatgtcctacgaatcaattgattttgtcatcagcaccattccgattaaaaaagagctccctgtaccagtactgaaggttaacaccatcttaggcggaactgactttacaaaaatagaatctattctgagtgatgaaaaggaaaaagccaatcgctacctaaaaaaagaactcgttttttttcaggaggatctgcgctcaaaagaagaagtgattcaatttttagggcagaaagtggtcgaatgcggctttgccgatgaagaaatcatagattccatttttgaaagagaagacatgtcgccaacgtgttttggcaatcttgttgccatcccgcacccgcttgttccgcagacgaaaacaacgttttgggccgtttgtacgctcaaaaaaccgatcgattgggagagtcagcgagttcaatttgtctgtctgctttgtgtcgaaaaggagaacaaagcggatttacaaagcatgtataaactgcttggcagcattttggatgacccggcggcgatgaaccagctgatcaaatgccgttcatatcaagagctttcggatgtgtttgaccaaaaaatgctgagctgacagcctgtatataccttttttccgttgcctgcggaaaaaccctgagtgtttatgaaagcgatttcataatatgatgatagcaacagcaggacattacaaaattgatcaaactctagggggtcttttacatgaatatattactcgtttgtgcagcaggcatgtctactagcttactggtgagcaagatggaaaaaagtgcgcaggaacagggaaaagactataccatttgggcagtttcaggcgattctgtacaaaatcatatcgataaagcggatgtattgcttctcggtccgcaagtccgttacatgcttccgcagctcaaaaaattaggagagtcaaagggggttccggtagacgtcattaataccgtccattatggaacgtgcaatggggcggaagtgctgaaatcagctgaacagcttggacatgtgtcatagagaggggcgggctatgtgaataaagtcaatcagatcttagaagaaaaggtcatgcctatagcgggaagaattgcgggacagcgtcatttgcaggcgctgcgtgatggtatcatcctcacgatgcccctgattatcatcggttcctttttcctcatcattggcaacctcccgatcccgggatacgctgagtttatggcaaaaacgtttggcagctcctggtctgaaaaactggcctacccagtcgacgcgacctttgaaattatgggtcttgtcgccgcgttcggcattgcctaccggctcgccgagaaatacggtgttgatgccttgtcggccggagccatttcccttgcggcatttttattagcaacaccttatcaagtgccgtttatgccggatggcgcgacgaaagaaatcatggttggcggcgggattccgctttcgctcatgggaagcaaaggcttatttgtcgccatgattatcgcaatggtgtccacagagatttaccgccttattatccagcgcaatttagtcttcaaaatgccggacggtgtcccgccggcggtaagcaagtcatttgtcgcgttaatccccggctttgccgtcatcttcctaatttgggcagcccggctgattgttgaagcgacaccgtttgaaagccttcataatattgtaagcgttttattggggactccgctttccattctgggaggaagccttggaggaagccttgtcgccgaagccgtcaaaatgcttttatgggcctgcggccttcacggtgcaaacattgttggcggcgtcatggcaccgatttggtacggcgcaatggatgccaaccggatcgcattccaagccggtgaggagcttcctaagattttcacccagcaatttttcgatatctgggtcaatattggcggaagcggcgccacattggcactggttgtcacgatgttcctgcgcgcccgaagcaaacaaatgaagcagctcgggaagcttgcggtcggcccggccatcttcaatattaacgaaccgattatattcggaatgccgatcgtcatgaacccaatgctcttacttccgtttatcatcacgccgcttgtcacagtgacactcacgtacatcggaatgagcaccggccttgtcgccaaaccggcgggtatcgcagtgccgtggaccatgccgccgatcttttcaggctacttggcgacaggaggaaaagtctcaggcgcggtcatgcaagccattaatattgccgtgtcctttgttgtctactatccattcttcagaatgtgggataagcagaagctgaaagaagaaaacgatctggagctggtccaaacgcctgcagcaacagatgacaaagaagcggctctgtagagaaaggaagtgaatcgcgtgaatgaggaaatggaacaaatcatttttcaaatcatccttcacggaggaaacggtaggagctccgcaatggaggccattgccgctgcgaaaagcggtgacgcagaagaagcgcggaaaaagcttcaagacgctgctgaagaattgtcaaaagcccatcattatcagacagagctgatccaaaatgaagcgggcggagaaaagacggaaatgacgcttctgatggttcatgcacaggatcatttaatgaatgcaatgacagtgaaggatatggctgcagagatcattgagttatatgaaaaaatcaccgagcaaaggggagcaagcatatgacaaaaggattgaagattgtaacgattggcggaggttcaagctatacgcccgagctagtggaggggttcattaaacggtatgatgagctgcctgtccgtgaattatggcttgtcgatatccccgagggcgaagaaaagctgaatattgtcggcacactcgccaaacggatggttgaaaaagctggcgtcccgattgacattcatcttacgctcgaccggagaaaggcgctgaaagacgcagactttgtcacgacccaattccgcgtcggacttttgcaggcaagagcaaaggatgagcgcattccgctaaaatacggagtgataggccaggaaacaaacggcccgggaggtctgtttaaaggattgcgcacaattccggtcatccttgagatcgcaaaggacatagaagagctttgcccgaacgcttggcttgttaacttcacaaaccctgccggcatggtaacagaagccttgcttcgctactccaacctgaagaaagtcgtcggtctttgcaatgttccaatcggcatcaaaatgggcgtagccaaagcgcttgatgtagatgtggaccgcgtagaagtccaatttgccggactgaaccatatggtattcgggctggatgttttcttggacggcgtaagtgtgaaggagcaagtcatcgaggcgatgggcgacccgaaaaacgcgatgacgatgaaaaatatctcaggcgccgaatgggaaccggatttcttaaaagcgctcaatgtcatcccttgcggctatcaccgttactattttaaaacaaaagagatgctggagcacgaactggaagcatcacaaacggagggcacccgcgctgaagtcgtacagaaggtcgaaaaagagctgttcgagctttataaagatccaaaccttgcgatcaaaccgccgcagctggaaaaacggggcggagcttactacagtgatgcagcatgtaacttaatcagctccatttataatgataaacatgacattcagccggtgaacacgatcaataatggtgcaatagcgagtattccagacgattccgcagttgaagtgaactgtgtgatgacgaaaaccggccctaagccaattgctgtcggcgacttgccggtgtctgtccgcggccttgtccagcaaatcaaatcctttgaacgtgtcgcggcagaagcggcagttacaggtgactatcaaactgcgctccttgccatgacgattaacccgcttgtcccgtccgatactgtggccaaacagattttagacgaaatgctagaggcgcacaaagcgtatctgccgcagtttttcaacaaaattgaagcgtaaaaaaagccggcctgtaatgggccggcttttttcttacttgctttcagtcagcgctgcgacttcggtcgtccatccgaattcgtctgcgacagcgcctttttgaatgcctgtaatcgtgtcatatagtttttttgcgatttctcctgtttcaccgttgttgatcgaaagtgtttcatcctgccagatcagctcgccgactggggaaataacagctgctgtacctgttccgaaggcttcttccaggatgccgtctttatgggcttggatgacctcatcgatcgcaatttttcgttctgaaacttgaaggccccaatgcttaagcaaggcgatgactgaattgcgcgtaatgccttccaggatgctcccgttcagcatcggtgttacgatttcaccgttgattttgaagaagatgttcatgcttccgacttcttcgatgtatttcttctcaatgccgtccagccagagtacttgagaaaatcctttctcttcggctacctgctgcgcttttaagcttgaagcatagtttcctgcggttttggcatttcctgttccgccttttaccgcacggacaaattcactttcaacagcgattttgaccggcttaatgccttctttgtaataagagccgaccggagaaagaatgatcaagagcttatacgtatgagatgccgcaacaccaaggaaaggctcggttgcgatgatgaacggacggatgtaaagggacgtgccctccgcatttggaatccagtctttatcaattgcgacaagctgctttaagccttcaagaacctgttcttcatcaatttgcgggatgcagaggcggtcgtttgattgattcaggcgttccatatttttttccggtctgaaaagcagaacatggtcatcctctgacacgtaagcctttaacccttcaaacacggtttggccgtagtgatagaccattgcagccggatccattgataagggttgataaggaatgattcttggatcgtaccaacctttatctgcggcatagtccattacaaacatgtggtctgtaaacactcttccgaacgaaagctgatttgggtctggtttcggtttttttgttgatgtcaattcaacgcgaattgtttgtttagtcatggtcaatctccctgctgttaaattgtttatattatcaaacttatttgaaaataattatattctattgtataccttcaacaaataatcgcaataggtttgctcaaatttgtaagaaattcatatgaaaaaagcaggagaaattaattctcctgcgtgttcatttgctcgaataacctgtcataatcggcgcgagtggcatcccgaagaccttcaacacgttcatttgtaatctcctgtttgccttccttcaagccgtccaagaaatattgaacatattcttcagatgaaatgccccggtacgtcaggccttgtttatcgcgtgatttttggtttaagcccgtgtccaccataggcggtgccatttcaatcacttccacgctcgtgtcgcggagctggtgtctgagcgtaagcgagaacgagtgaagtgccgcttttgttgcgcagtacaccggataaacagctaacgggttaaacgcaagcccggatgtgacctgaacgattgccgcctcgggctgcttcatcaaatgaggtgtgaaaagggcggataaatggacaggcgcttggaaattaagttcaatttcatcaccgtccacaaaaagctcctctgtcccttttttaaagtcaatttccttttgaatgccggcgttgttgacgagaacattcaagttcggatattcctttaaagcccattcatacaatgcttcccgctgcgaacggtctgcaacatcacattgctttgtatggatgtttgggagctgctgcttcgcttctgcaagacgtgcttcgctgcgtccgcaaatgataacttcattgccaagttccagcaggcgcttggccagttcaagcccgatgccagcagaaccccctgtgattaaaaccgtattatttgtcatcttcattggatgtaacacctcttaattaagttggctgtgattcctttactattacaaatcttagcaggaaatatgcagccgcgtcctatgagatgctcaggatgaagtgacttttccggttttataaaattcgtcaattgctttatcgacatacacccagcctttccagccgatgtgaatggtgtctttcatgaaatacgggtcatattcatgccctgagaaatcagcaacctggaagcccttcgctctgatttgtttatttacctttttgtaatagtcagtgcgtccttttttcgggaagcccgtgtaatcgtaccatttcccgttaacaggaatggtgacaaacataggctctgcgcccgcatccttcaggatatcgagcatcatttcaaagtcgccatattccggtgacaccgcatacgatcttcctttgtttttccctttcagcttaggcactttcggcttcagctttttatagacagggttgtcgatgtgaaaatcgttagaaccggagtggcgtttgcccgattgatccgctagtttattcaattcagaccatgacttatcctttactgactgcgagatatagcgctttggcccggatgattctgtcgttgaataatacagatctttcttttccagcatgctgtaatacactttcgccgccggcttcagcgcgttcactttccacgtctgaccgtttaccattgctttgtacagctcagaaagaatggcatcgttttgcacagccttaaagcgaagcatgcgtttcatcattttctttttaatttcaggatcgatctgatcgttaaatgccaaatcaagcccttgcagcgcagaatagttcggcgcgaaatgctgttcatcagacccgcgcttaataaaccattgcggagacacgatgaatacgatttttttgcccttcagctgatccatgtgggcagcgaagtttaaagaatgaatcaatgactgggatccgcctttgccgacaaggtatggcgtgaatccctcattgtttacctgaaaataattagatgggtggaactcgtccagccgagaaagctcagaagacccgtaaatcggaagatatgtcggatctttgagcatctgatcttgtaaatatagcccttgaaacatactcggattcaaggctgttgctgactctttcacacgcttatcggtgatgaagcctgtcagccatgaagatggaattgcgatggcgcctgcgaatagaataaacgccaaaataattggaccgaaaaaacgctttttcattatttcaactcagacagctgatttacaatgttgttaggtgtattccaaacgtcccggtcaaattcagtgatcggcactaaaatatcaaaacggttttcaatcgcaagcagcaattctactgttccaaaagaatcaagcaaaccttcttcaaaaatttcaatatcaggattttcctttacgatgtcatcctggcaaacctctgctaaaacgtctaatacctcttgtttaaaatccatagctttctaatctcctttaatggtggtgatgaaatggttttcctgagaaaatataaaacccgaagcaaacgaaatggaatgtgatcacaatagcgagaatggttgtccagcggttggacggcagccatttatatttcttattccacttctcgaaaaagttgtaacacgtcatcagaacggcgtgatagaggccgtaaatgatatattgcggcgcgagcccgtgccaaacccccatcagcataaacagcaggaaatacccgatgtttgagacggccatacggtttttgatccactttttcttagtcatccaaaatacgaatctcataaacacataatctctgaaccaaaatgacagagacatatgccagcgattccagaaatctttaatatttttactgataaacggtttattaaagttttctggtgatttaatgcccataatgtagctgaccccgacggcaaacatcgtgtagccggcgaaatcaaagaataaatacatgctgtagccgtacatgtacagcaggttcccaagaatcttattgtgcgtgattgcgggaagattcatgatgaagtacgtattgatcgcgtagccgataataaatttatacaggaaaccgatgaagattttatggattcccgtatacagcaggtcggcgtattcttctttcgtccaagccttctgttcatccttgacgaaccggcggtatctgtcgatcgggccggaggaaatcgtcgggaaaaacaggatgaaatacagcagacggtgcaatggcagctgttctttcagcagtccgtctcttgcttccataatcagctgaacgcctttaaaggttaaatatgaaatccctaaaaagctgatcaggttatgcggcggatgatgcggctgcgggtgtgaaagaaacggccatatttttgacagaaataaaggcagaatagacgcgataacagctccgcaaaagacaaagccgctgttcgctttctgccggtatgccagatagccgctgatcaggagcacctgccatattgtaaacaggcacagcgcgatgaccccgtgtaagtcgtgcgaaaaaattaaagccaatataatgatagatatgaacatgttgtatgcttgaaatctttttccgtttaagccgagaatgatcgtcggcagaagaagaatgccaagcagtataaagaataaaaacgagctgtaaggcgtcatacaagaacctcttcgccaatgcgttttcggtcaattttgccgttagccgtcatttgaatgtgatcctgatagataaattttctcgggatcatatatgccggaagagaagcggcaagctcttttttaatagcgcttgtcagctggaattccttctcgaactcatgctcctcaggcacaatagcagcgatcagatactcaactgttccgtttggctgataaggaatcacgacagcagaacgaacgtactgtgactgtctgacatggaactcgatttcctccagctccattcgatagccgtgaagtttaatctgaaaatccaaacgtccttggcagaaaatctgaccgtcttgaataaagccggcatcgccagttcggtatgcccactggccttcatgagagaaaaacgctttttccgtcagctctggctcaccaaggtagcctcggcttacactcggccctgcaatgacgatttctcctttttctccctcaggaagcggctgtccctcttcatccataatgaaaatgttcatatctggtttggcgaagcccactggaagcgattcgctgcggctgatgacgtcattcgtaatttcaaccgatgtgacagccactgtcgcttcagtcgggccgtacgtattaaaaatcttcgctttcggaaaacgctcaagcagcgctttggccacagaaaccggaagaacctctccgcaaaacataaatgtgtccgcatgaggcagcagatcctgtgaaaaacccggatccatcaggcacatttgcacaaaggaaggtgttgatgtccacacattcagcccggacttcttcagctcttcaaataagactttcggcttattcacagcatcctttgtcacgcaatgtaaagtcccgcctgattgaaggcacggatataggtccatgacagacaaatcaaatgagaacggcgcttggtttaaaaatatttttcctccgctgactggaaagtctgcacaaatccagtctgtgaagctttgaaggttcgcagcggaaatctgcacgcctttcggatttcctgtgctcccggaagtgtaaatgatataaaacgtttcgtgttctttgacccattgatcttggctgacagagccgccttcgttttccagcagttcttccgcagaaactgtctgaatctgctggccgactgcatcaattgagagtcctgctgcatggatcagcaattctgctccagagctttcgataattttcgcaatccgttcggacggaatagacaggtcaaccggaatataaggatgtcccgctttgacacttcccaagaaggaaacgatcatgtgcggctccatgtggccgtacacaaggataggagatttcttttccccagaaatgcgtttttggatcgcggcagccgcgcggtcagactgctcccataattcctgatacgtgagcgactggccttgagagcggaaggcatcggtttgcggataagtttccgcatgtgtttgaatagcatgtaaaagtttcatagttattctctctccaattagaaatcgttataaatatatgaaccggtattcgcggtgtgaaaaccatacataaaaaacaaaacaagcagtatcatcaaataaaagcctgtatgacatgtccacttgacagcgggtttttcatacagctgtttcattaattgcagcatatcaaaaattcccttcccgttttttcgacaatcacatgattatttgacgatcagatgctcaaaaagtttcattttttccctaatctccctcaaattaatatatcggcgtatgtttttgaaaatgaatctttatacctgcaagggcaagaatggaatgtttcgagctgattcataataaaggaaaagatacctggagtcaaaagatctttttaacttttaaaaagtgtaatgtacttaaaaaaatttttctgtacctgttcgttcaagtgaaagcagaaacctaatgaaatcagggcgagaagcgtataataagaaagaaaacgccttcttgcggtatcttgtgaaataagggagaagtcattatgatagataaggaagcaaaaggagttttttattaagctgccggctgaaaaaaagtaagccttttaatagaaaggaagaggaagatgaaccaaacaaataagggtgagggtcagacagcgccgcaaaaagaaagcatggggcagatcctttggcagttaacccgtcctcatacgttaaccgcatcgtttgtgcctgtgctgctcggaaccgttttggcgatgttttatgtgaaggttgatctgctgctgtttttggctatgctgttttcttgcctatggatccagatcgcgacgaacttatttaatgaatactatgattttaaacgcggattagatacagcagaatcagtcggaatcggaggggccattgtacgccacggaatgaagcctaaaacgattttgcaattagctcttgcctcatacgggattgccattttgctcggtgtctatatttgtgccagcagcagctggtggcttgcgctgatcggccttgtcggcatggcgatcggctacctgtatacaggcgggccgctgccgattgcgtacacgccgttcggtgaattattctcaggcatttgcatgggttcggtgtttgtgctgatttcgtttttcattcagacagataagatcaatatgcagagcattttgatttccatcccgattgcgattcttgtcggcgcgattaacctgtcgaacaacattcgtgatattgaagaggacaaaaaaggcggacgcaaaacattggcgattttgatggggcataagggagctgttactctgttagctgcgtcgtttgccgtcgcttatatctgggttgtcggcttggttattaccggtgccgcaagcccatggctgtttgtcgtctttttgagcgtgcctaagccggttcaggcagtgaagggcttcgtccagaacgaaatgccgatgaatatgattgtcgcaatgaaatcaacagcccaaacaaatacatttttcggattcctgctctcgatcggattattgatcagctatttccgataataaaaaagaccgctcgtttcatgcggtctttttttgttacaatcgaccgcattttgtaaaaaaattcatagaaccttgcagcagacagggacgtctagtacatggacagcggataaagttccgttaaaggagatgacgaacatggatttatctgtaacacatatggacgatttaaaaacagtaatggaagattggaaaaatgagttattagtttataaatttgcgctagatgcgctcgatacaaagttctcaattatcagccaggaatataacctcattcacggacacaacccgattgaacatacaaaatcccgtgtaaaaagctttgaaagcatcgtgaataagttaatgagaaagggctgtgagattacgacgaaggaaatgaaggagcatattcacgacattgccggcgtgcgcatcatctgttcctttatttctgacatttataatgtcgtgaatgtgttgaagcagcatgaagatttgagaatcgtaaaggtaaaggattatatccagacacccaaaccgaatggctatcgaagcctgcatttaatcattgagatgcctgtgaatttaacgaaccgtgtggaatacgtcaaagcagaaattcaaatccggacaatcgcgatggatttctgggcgagccttgaacataaaatttattataaattgaacaatgacgttcctaagcaattaacagatgagctgaaagaagccgcggagattgcccattacctagatgagaaaatgctggggattaagaaagaagtggattaaaaaagacggcacccaagtgccgtctttttttatttgatatcttcaaaaatgtcagatgctttcgccttcatttgtttcttaatggttttcggtttcttctcttttttcacagcctcatagacagcggctgtcacaagatcgcctgcttgctggaggcgttctttgctgatatgttcgatcgagtcttcaggggtatgataccacggctcaacttcttctgtttccgggtctccccaaataaagttagcggaatcaatgccggcttcgtggaatggcacatgatcagatgatcctccctgtgtcagagacaggctgtcaaacccaattttttcagcagccgtacggctggattcccaaacatagttagattggccatccaatgtgttgacatacagctcagacgctttttcccagcttgtgcctaccatatctaagttgaagttcacttcgcttcgtttcagctctttttccgatagatgatctacatagtgagaggagccgagcaggccgagctcttcggcgccgaaagcgataaagcggatttctttatcagatggaacgctttttaagacacgcgccatctccagcataacagaggtacctgagccgttgtcatttgctccgggcgaaaaaggaacactgtcgtaatgggcggtcacgtacacaatgtctggatgtttgatgttctttggttttttgattccgatgatattctgggaggtttggtttgtgaatgcttttagttttaaggtggcttctttttgctgggtaagtgcttcgccgtcttctttcttaatgccgacgaccggaatgccgactttatttcccgacaggtttggcgtcataggcacgaggctttctttgttgttataaatgatgacagctttcgctccggcggcttcggcatttttggctttctcgtaataagtcaggtctcctctggaaatcaaggcgattttgcccttggcgtcagcggtaaagtccttttgatagcccaatcccgcattgtaaagcggggccgtcagcccttgttcctcagtcggagctgagcccgacgccgcttggagaagaatatcgcgtcctgctgaagacagtgtaccctcaagccggtcaggaatgttgaatcgttgaaccttcacatcaagctttaattttctcattgatgaggcgatcaatagggcactctttttttcagctgcagttccggctattctggggccgattgcttcacttagctgagaaatggtagagtacgcatgttttgctttgaatggaagctcgcgctcgctatttgatatttgtacagcgtgcgcggcaggggtgacactctgtgccggcaagagcagtgtgccggcagttaaaacagccatcgtcatgacagtcaaaagctttttcatcaaaaataaacctcccctaaatgtatggttggggaatatttcgggatgctaaaggagtttcctgcaagatggagagcgtttttgaaaagacagtgctttatacctgcaaaaaaacgcttatgaatgaagggtcataagcgtttcggaatatcagattattggagctttaaaaacttgcgtttgccgacttggatgatcatattctctcttatctctgctttggcgtgaacatctgttactttctctccgtcgatgcgtacacctccgttttgaatcatgcggcgcgcctcgctcttcgaagagaggagctttagcttgacgagcagatcaatcatcgctatcgttttttcgcctttccagtttacggccggtatatcttccggcaggctgttttcctgaaagactgttttaaacgagtgttcggcagcttctgctgctttctctccgtgatacattcggacgattgttctggctaaaagcattttggcatcacgcggatgaacggcgccggtttctaagtcttttacgagctgttttttctcttcaagctctaagtctgtcgccaagtggatgtactttttcatcaggctgtcgggcagtgacatcgtttttccgtacatgtcgtttggatgttcgttaatgccaatgtagttgtgtttcgacttcgacattttctcgacgccatccaagccttccaagagcggcataaggatgacgacttgtttttctttgttgtatcgttcttggaaatgccgtcccatgaggacattgaaatgctgatccgttccgcctaattcaatatcactttcgagaacgacagaatcatagccctgcatcaatgggtaaaagaattcatgcagtgagattggtttttgcatggcgatgcgttcttcaaagtcgtcgcgctccatcaggcgggctaccgttattttccctgctaattcaatgacatcttctagattcaatgttttcagccattttgagttatagtgaagctcgactttttctggatcaagcacttttccgaattgctcaaagtaggttttggcattgtgctgaacttcttcatcagtcagttgctttctggctgccgattttccggtcggatcaccaatttttcctgtgaaatccccaattaacagctggacaatgtggccgttttcttgaaattggcgaagcttatttaacacaaccgtatggcccaaatgtacatccggtgcagacggatctaatccgagcttaattttaagcggcgtgcccgtggaaattgatttcacgagctttgcctttaattcctccggcggtatgacttcgtgggcgcctgtcatgtatagctgaagctgtctttctacctctttttgttgtgacgctgtgagctgctcaaatgttctcatcatttttcctccttttttacaaacacaaaaaagagcccatcccaataagggacgtggctcaatgcacgcggtaccaccctggttgaagacattgtcttccgctcattcgaataacggtttcccgttctttgctactaaggttcacaaagaaagcttggggaggtaattcacgtttgcctgtgcgccggctcgcacctaccgccggctctctgaaacagggagacaaaccgctactggattcccgtcaaagcttatgttgtatgaagattgtcagctacctttctaagcagccctgtcaatattttctgttcgtccttcgtcattcccgcaatgagctctgtttcccctttgtgaaactccgggtagagttcttcgatcgcttgtttgccggaatcggtgattgagacaaacacgagtcgccgatctcttgtgtcgatgcttttacggcaaaaactctttttttcgagcgttttgatcacgttgcttgctgtagctgtagatatccctgacagctcagcgatttttctcgtttcgagcgctccccatacccatagatcataaagaatggagaaagcggtccaagaaaggttataggtagaaagaacctcagtctccattttgacacggagcctttgtgcagaccgatacagattcgtagcgatcgaaatggcttccaggttgagtgactcgacgggcatttgtttgagcttagaaagtgtatcgtgttcttccttccgaagctgctgatgttgatgtgaacgttccattttttaggcctgccttaaattatcagaatcattagctatgaaacgaattttaacagagtctggtgtgaacttcaagcccatatatcggttgaataaaaaaagcccaaacaacgccaaaataaacaaaaacccgaaaacgggggtgcagttttgcaaaaatatgttcaatccgactataagcatgatccgtttcatctgttttcgacagagcatgtagtgacgttagcgattatctcccttttggccattctgttgtttttgttccaagatgaggtcaagcagccgagggccagccggtttttgcgttctctgtttgtgtttcttttgcttggttcgcaaatcggctatcaaatatggatggtcgccacggacaggtggtcggtgcgcacttcattgcctctccagcttagtgacctgtcggtgtatttgtcagctattatgttagtgacaaaaagcagaaagctgtttgtgtttttgttttttgtcggcatcggcagttcgattcaggctcttgccactcctgacctcggtatgttttcatttccgcatatccgatatatcctcttttttatttctcacgggtctgtgtttttatcctgtctgctgatggctgtgattggcacctacagaatgggccagcgctcgttatgggtgacagtcctgcttgttaatgtgtacggcgtctgtatttttctgattgatcgctggcttggcgcgaattatatgtatttgacgaaaaaaccgggcggttcctctctcttagatgttctcgggccatggccgtggtatatcgtctcggctgaagccatcacaatcgcaagctttttcattctttattggctttatcgcatcttcaaaaaatgacaccttttttgttgtatcacacattctgtttaaaaaaatgtcggagaacgtgtttatttttttgaaaaagggtatgtaacttgtacaacaaaaagggagatgaataccattgaggaaagatgaaatcatgcatatcgtatcatgcgcagatgataattatgctcgtcatttaggtgggatgttcgtttctttattgactaacatggatcaggagagagaggtaaaattatacgtcattgatggcggaattaagcctgataacaaaaaaagactggaagaaaccactttgaaattcggagtgccgattgagtttttagaagtggataccaacatgtatgaacatgcggttgagagcagccatattacaaaagccgcgtattaccgcatttcgattcccgacttaattaaggatgaaagcatcaaacgaatgatttacatcgattgtgatgcgcttgtcctagaggatatttctaagctatgggacttagacattgcgccatacaccgtagccgctgttgaggatgcggggcagcatgaacgcctgaaagaaatgaacgtcactgatacagggaagtattttaactcaggtatcatgattattgattttgagtcttggagaaagcaaaacatcacagaaaaagtcatcaactttatcaatgaacacccagacgaagactttcttgtgctgcatgaccaagatgcactgaatgcgatcttgtatgatcagtggtatgaacttcatccgcgctggaacgctcaaacctatatcatgttaaagctgaaaaccccatcgactctgttagggcggaagcaatataatgaaacaagagaaaacccggcaatcgtgcacttctgcggcggagaaaagccttggaactccaatacaaaacatccgtatcgcgatgagtatttccattacatgtcctatacgaagtggaatacgattgggaatccggcgatcaaccaataaatcagataaaaaaacgcttttgagatgatcaaaagcgttttttgtttgtctcagcgtgcgactgaccgttggtagaaccgctgaatatgcatggcgatgtagcacaattctttttcaggaaactcaaagccgtattccttcttcacaaaggtgccgatgcttagggcacacaggaaggcatccttaaacttctctttaatgatgtcaatcatttctgcgtccagctcgtaaatggattcgcctgctttgatatgctgaatggcaaagcggagatgggtcacgagcctttcataagagatggtatcttcaacgatattaatagacagttgaatttcgataatctcgataatatcacggatcattgttgtaatatcaagcgtttgtgtcatatcgccggcattgtttcttgctgtgtggatatgcatggcgatattgccgatttcatcatcaggaatgtgaatccccagtttatctttaatcagtgctctggcccataagccgatctggaactcctttggataaaggactttgatttcattcagcagcggatttttgataaccatcccattgctcaggcgttcaattgcaaaagaaagatggtctgaaaaagcgacatgaatgcgctcgttgattttgatgttcagctctttttcggcatgagagataatttgctcagaaatctgaatgtggtcttcaggcaatgtttctaaaatctcttcgaactgcttatagtcaggtgtatcttttctgataaaggttttttctatttttgacggatcgacaatatcattcttctttttgttaaacgcaattcctgcacccaagagaatcttctcttcattttgatcctttacgacgatagcattatgatttaagattcttttaattttcatagcttttttgtcctttcatcccccgttttatgaatgaaatcgaataaatccagttattctgtctcttctttaaacccgagaaacaatgtagctataaaagcagagacggctgcgatcaagaaaccgatcatataatgaacaaaattagcggcgccaaacggcagcacgattgaaatcatcggaatgcctgtcagtccgtaggaatttgccacaacttgtaccgcaaccacgtatgctccgccaatagcaccgccgatggctgctccgataaagggacggatcaatttgagatttaccccgaatacaatcggctcaacaatgcctaaaaacgcggtcagagaagcggggagcgcaattttcttcaggcttgattgtttcgttttgaggaataccgcaagccccgctccgccttgggccacattcgccatcgaccatatcggcactaaaaagttgacaccgacatgcggattagcaagcagcgttgcctcaattgcataaaagctatgatgcaatccagataggacgatggtggagtagatgccgccgaaaagagctccggcagcaatgccggcgtgatcataaatatagacgatcgattgtgtcatgatctggccgatgatggacgcggcgggattcatcacaatcagcgcgaggcaccctgtcaccatgaccgtaataaagggaatgatcacgacatcaagcgacttcggcacaatcgattttaatagcttctcaattttgctcatgacaaaaacggaaagaagaatcggtatcatggaaccctgatagcccatcattgggatatgaagcccccatatgtctaaagaagacggggttttgctgccgagcatagacgggtccagcagatcaggatgcgtcaaaagccctgcaatcactgcccctaggtatgggttgctgccaaattgccgtgcagcactgaagccgactaaaatcggcagtaaaataaaggctgtgctggacacgaggtcgagcattttaatccatgggctgccggcagcgaaccaatgaaacaccttaatcatgccgatcagccccatgagcaggccgcttgctgttattgccggaataatcggcacaaaaatatcggacagtgttttcgcaaaagctgcggcagggttcagcttccggctggcttttttctggtggacaggctcttcagaaggcgcggtctcccatacatgaacgacttctttatatattttgttgacgacgcctgctccgaagataatctggaaaagcccatagcggaaaaaggtgccctgcacaccttgcaggttctcaatggcatgtatatcaattttcgtctcgtcctttacatcaaaacgaagacgggtcgtacaatggctgatgctgataatattgttttttcctcctgcgagcagcagtaattcttttgcaatctctttatgcaagcaattaaaacctcctttgctgaagaaaagtcggcttgttcatcgtatcaaatgaaaagttgacaatcaaaatgaaaaaagtgagaaataccggctgaaaatgacaaaaatgcccgcgtcgacgacggagcatgagaatagggggttgtccaaggcgccgttatgagcccaacacgaaaagaagagttaaaatgccctgttttttaggcattaatactccctttgcatcattgggtcttgcctgcctgcccagtcacaatcccgccatatgtggtgataactgtaataacgttcattttatgctgttcatggctgtatagcaatagtatgaaaagcctgtacaatggatgggaaaaaggttgtgtgtggtgttcttagaatgaaaaaaacctttaagacttggaatgcaaatcttaaaggtttttggttactttttcggtttgacggcgttcagccgtttttgcagctttgttttttcattggatgcttttaattgattcactgcagactgagcggatgtctttgatttctttgttttgtctttttccgctttcttcacttttgcctttgcagtttccactttttttgcttcagccgccgccacctttttcttcactttgtctaaccgtttttgcaatgccgttttgtccttgcctgcttgaagctgattgacggctgattgtgcttttgccgcatttgcatcagttgatttcttttcagccgcagatacggattgctgtgccgtcttcaaattggtgctcttcactttgttaaggcgtttctgcagggacgttttttctgaacttgcaggcagcttgccaattgctgattgtgcgctgtccacatctgttttctttttgcttttttccgctttcgcaactttgtctttcgcttgctttgacgcgatgtatcgttttacttggtctaagcgtttttgaaggttctttttgtctgttccgtttggcagcttgttgatggcagtttgtgctgtgtcaacggtttgctgtgttttatatttttctgcctttgcgactttgtctttcgcatcttttacatttctgtatgactgtactttatccagtcttttgtgcagggcagttttggcgtcggagttcggcagctggctgatgagttctcgcgctttgttgatatcgatttgtgcttttgtttgttccgcttttttcaccgcttgctctgctgccgcgtacgctgaatctgttgcctgtgctttatactggattaagccgtagccaaattgctgatcgcggcctgcggtaccaagatcaacgatgtttttccgcatttcctcgcgaagctggacgtttgtctcggcaggatcacgctgttttaacaaggcaaacatggcagcggcgtgcggtgtcgcttgggatgttccgcttcccgttgcataatactggtttaagtaagtgcttgtgatgtttgtccccggtgctgaaaattcaacttcatctccagttgttgaaaaggaggcaagctgattcttttcgtttgttgctgaaaccgcaacgacactgctgtatgccgccggataattcactggcttgccgtttccgtcgttaccgcttgcggcaacaagcagaacaccttgttcatatgctttgttcacggcgtcatgaaggattttgctgtctgacgtcgtgccaaggctcatattgacgatgtccatcctgtttgcgatcgaccagtcaattccttggagaagactttgaagatcccccgagccgttctgatcaagcgctttaaccgcgtatatttgtgcttccggtgcgatgccgtcaattccgtagccgttatgcttggctccgataatccctgcgacatgtgttccgtggccgttatcatctttgtaagaagaggtataactgacagctgaatacccgccggcaatcgacaggtcatcgtggggggagatcccgctgtcaatgacggcaattttgatattttttcctgtcagtcctgccttccaagcctgtttcacctgaatgggctcaaggttccattgctcaaagttgtcagaggtgtcagtgccgtctgacagcactttgaaatccgtgctgtctgctgcggtaaatgatacgttgttttctacatacaaaatatcaggatcctgctttaattcttttactgtctcctggtctgctgtgaccgctaccgcgggaagatgcttatactgctgttcaacatcagcatcactgtccaggatggtttcctttccggccttgtttttataaaccacaataacctctttctcgctgctgttttgcgcatgagcgagagggcctatggtgagaaaactgaaaaacagagtgactgatacaacaagtttgcaagacatgtttttcatgattcatctcctttttctatgatgtttgatatatatatcggagaaaaaaagagagattaatagtaagaaggaaaaaatttttcatgggcagggttgtttagcaaaatgcagattttttccgcatgaagaggaaattttccaaatgaatttgtaagcgttttcaaaataagataaagaaaacattgcggaggttgttcacaaagcaatgagaaaagggggtttttaagatgagcacattcactcgggtgatggaggaaaaaataatgcctgtcgccgggaaaattgccgggcagcggcatctcagcgctttgcgtgacggaattatcctgaccatgccgctgattattatcgggtctgtcttcttgattttaacgagcttgccgattccggggtatgctgatttcatggcgagtgtgtttgggaacgagtgggccgataagctcggatatcctgttaacgcttcgtttgatattatggcgatgattgccgcttttgggatcgcctatcggctggcagaaagctatggtgtcgatgccctttctgccggagcgatttcaattgccgcatttctgctggcaacaccgtttgaggtgccgtttacaccgcatggctcaacggagtccatcatggtagggggcggaatcccgatcacgctgctcggcagcaagggcttatttgtcgccatgctgatcgccttgttttcaaccgaaatctatcggtacattattcaaaaaaatatcgtcttcaaaatgccagacggtgtgccgcctgcggtaagcaaatcatttgtcgcgctgattcccggctttatcattgtgcttctcgtatggctggcgcgtcttctgattgaaatgacaccttttcagagtctgcacaatgtcgtaggagacctgcttggcacaccgctttccatccttggcggcagtctcggcggaagcctgatcgctgaatttgtgcagatgctgctttggtcgtgcgggattcacggggcttccatcattggcggaatcatggcgccgatttggtacggcgcgatggatgccaaccgtctcgccttccaagcaggcgaggcgctgccgagtatttttacgactcagttttttcaaatttggatcaatgtcggcggaagcggggcgacgctggcgcttgtcctgacgatgcttgtgcgctcccgcagcaaacaaatgaagcagcttggacgattaggaatcggccctgcgctatttaatatcaacgagccgatcattttcggcatgccgattgtcatgaatcccctccttattgtcccatttatcatcgcaccgctcctcacgattaccgcgacttatatcggcatgagcaccgggctggtggcaagaccggccggaatcgcggtgccatggacgatgccgccgctcatatcaggttacctggcgacaggcggaaaggtgtcgggcgcagttatgcagctggtaaatctgctgatcacctgtgctatctactatccgtttttcagaatatgggatcatcaaaaatggcgggaagagagtgcggttgaatctggggataaaaatgtgatgtgatagatgatcagcctgtcatagggctgatcatctctttcaaacgaaaggaatgttagaatatgtaaaggaggtgcgcatgctagattatatatggttagatgacgaatcaccaatcttacaacaagtaccagttgaatactcatctgctgctcttatcttttctccttttatccaaatgcctgaaggatgggagaatgcaaaaagaaaaaatgattatgaacatatttatccaaacgataatgaaataagaggaataggcaaggctgtttcctggaagaaggttatgtcttcttgcggctttcaaacacatgctgagctggcgctggctttaatgacgtcgataggcgctttaagggacgagttcgcgagagaggatttggctgaggtgttacatgaaaacataaatggagacctctattatcccagtgaggatcatatttcaaattttcatattccgagtttggtaaaggtattaggtgcgaacggatccaatcggttttattacgcagaaccgattgtggaaaaccgcggcgttttggacataactgaagccaacttgcggacggttcttgatgaagccgcaacagagctcgttttaactgatgagaaaatggattttgtgtttatgagtgtatatgactcattcattaatgtctttttagccaaagataaaaacatccatgaattggttgagcgtatgggctgggaagctatgatttgcgatgagtcaacgtatatcagttggtatagataaaaaagaacgtacatcacaaaatgtacgttctttatttttaccgctgaaagaactcaatccactcaccgtcagggccttcgatatagaaataacggtatccgtttggaagtgttgtgatctcctcgtcgataaattttgcgttcattttttccgcttttgtatattcagccgcgatgtcatccgtcagcagggcaatgtggtgcacttttccttcagcgggaagctcgctgctgtagccttgaatcagttcaatttctgtttccgggccgtcttcaaagccaagaaaagcaagctcgattacaccgttcgtgtgagtgatgcgatccttcaatttcatgcctagtacctcttcataaaatgtgatggacgcgttaatatctcttaccatgatgcctgtatggtcaattcgttttgccatgctgctcctcctcgtaactctttttgtctatcgtagaaaaacctttcctttctgtcaatgcagacatcttggcgttttgtggtaccataagagaaagcaaacggaaagaggacgacatatatgaagctactcaccctaaaaaaagcacacgctgccaaaataaaaaaaggctatccccttattgaaaaagaagctctcgcagggagtgcggggcacatgaaagaaggagacctcgttgatatcgtgtctgagagcggcggcgagtttctcgcgcggggctattacggcctgcaaaacaaaggggttggctggacgcttacccgcaataaacatgaacagattgaccaagcattttttctcagcaaattaacaaaagcggcccaagcgcgcgccaaactatttgaggctcaagatacaacagctttccgcctgttcaacggtgagggtgacggtgtcggcggcgtcaccatcgactattatgacggctacctgctgattcaatggtacagcaagggaatttacacctttaaagacatgctgatttccgcattggatgagatggatcttgattataaagcgatttacgagaagaaacgcttcgacacggctggacaatacgttgaagatgatgacttcgtgaaagggagaaggggcgagttcccgatcatcatccaagagaatggcattcaatacgcggtggatctgaatgaaggcgccatgacgggcatctttttggatcagagacatgtgcgcaaggcgatcagagaccgctatgcaaaagggaaaaccgttttaaatacgttttcttatacgggtgcattctccgtggcggcggcgcttggcggagcggagaaaacaacaagcgtcgacgtggcaaatcgaagtcttgccaaaacgatcgagcaattcagcgtgaacaagctggattacgaagcgcacgacattaaagtgatggacgtttttaactatttttcatatgctgcaaaaaaggatttgcgctttgatctgattattctagatccgccttcctttgcgcgcacaaaaaaacgcaccttcagcgcggccaaggattataaaaacctgctgaaggaaacgatcgccatcactgctgacaagggtgtcattgttgcctctacaaacagcagcgcctttggcatgaagaagttcaaaggctttattgatgccgcctttaaagaaacaaatgaacgctacacgatcattgaggaatttacgctgccggaggatttcaaaacgatttcggcatttccggaaggcaactacctgaaagtggtccttctgcagaaaaaataatgaaaaagctgccctgttcaggggcagcttttttttatgtagaaacgatctgctggtcgcggccgatgcggccatcttcaagacggactttaatgccatgcggatgaaagtttgatttcgtcaaaatatccttcactgtccctctcgtcagttttcctgttttttgatctgctttcaatacaatatcaacctgcaaccctttcgaaatgctgtttcgctcttgcccgttcataacgcacatcctttcttttgttcattatagtcattatggtttaaaagtaacagccggctgatgaagtgtatgtttgtttttttcagccttcattaaatataatgtcaggccaaagcctgctatgctcagaatgccaaaaagcaagtagactgcgaagatcgacacgtagtcaaaaatgtacccgcctgcaaatgtgcagaaccagttgccgaacccgttgccaatggcggcgtacatggtcagcgccgtcgcttcaacgtgtcttggggtaatctttttcacatattgaagcgccgccgggataaataaaccgatggccactccctgaagaaagaccgtcgcataaatgatccatagtgaaggcgccgtgaaatagagcgcccacctgaataatgagactccgcctgacagcataatgacgttgagcagccccattttatctataaatgtttgggcgaatctcataaatggaatttctgaaatgacaccgatgaaaaataaaatgccgatagcggaaagtgacgcgccgcttttgtccagaaaaagactgaaatacgtattgttcgctaagtttggagcaaatgtcgtaaaggtgatgatcataaagatgaggaaagttttgttgctgataagctcccggaatcctttgcggatattgacctttgttgttttctgctggccgggcacttgtgaagccaatatggcagcaatgcacagaaaggcacagccaaagataaagatcacgtgaatggggtacagctggttcgtcacctgtcccatggcaaacaccgcgacaccgaagccgagagaaccaaacaggcggattccgccgtagttgccgtttgtttcttgtgtgtaccttagtgaaatgctgtccgaaagtggaataatcgtgctttgaaaggctgcaaaacaggccgcaatcaaaataaacagagggaaactgtcaaatgcaatataggctaatccaatgatgcctgtgattgatgtgcaaaccgccagcaggcctttcgttttttgcgtatagtcgctcagcatgccccaaaacggctgaaagaaaatcatcacaatcgggcccagtgacatgatcaagccgacctgtgatccgcttaaatgctgttccttcgttaaatacatactgagtaagggaattatgctgcccgtaccgagaaaagcaaacaaataaaatccttttaacgcggcataatgccgcctcacctgcaagttgtgcatcagggtgcctcctttggtatccacaaatacattatattggaattcgccagcttttcaataaggggaagcacataaaaaaaactgccctcgagaggacagttttttacataaatgaaagcaaaaacggcgccgcgcaaagcgtcataatcgcagctaagatcatcgacacgctggaaatcgtgccggacacagagctgagctcaaatgcctttgacgttcccgctccgtgcgcgcttgtgccaagcagcacgccccgcgcaatttcgttatcaatgcggaaataacggatgaccatcgggccgatcactgtgccgagcaaagcggttaaaatcacaaacacggctgtgacggcaggcataccgccgatcatttcagatacgttcatcgcgatcggcgttgtcactgatcttgggacgaggctgtcaattaagccggtgccgaggtgaagccatttcgcaataagagcggtagaaataatcgcgatgcatgaaccgacggccacattcaaaataatttccactgcgtatttctttaaaacagggaaatatttatataacgggatcgcgaatgccacggtggccggctgtagcatatcggtcagcaatccgccgccgagattataggactcgtacgggacattcaccagcagcagcagaccgactaatacagcgggcgtcaccaatagcggcgacgtataaacacgcggaaagcgttgatataccttttttgctcctaaatacaccaaaaccgttaaaaacaaacttacaattccgatgaacacgtatgctttttctcctttctctttgcgatgagttgtgtaagcgttcctgtagacaccatcacgacaaacgtgctgatgatgacaacaagcagaatgctgacaccaaatttcgacataatgtctccgtattcaatcactccgacggcagacgggataaaaaataaaagcagctccccgagaagccacgctgcaccaagctcgatccattcaagcttgataatgttaaagtgcaataatgtgaaaagaatcacaatccctattatactgccgggaatatttatatgaagaagggctgtcacccaattaatcagccgagcaaatataaataacagagcgatttgaataacggttagcaacagttttttcatattgatgcctcccttatatacttattgtacataaggtctctctataggtaaaatatatattaagaataagaagtattccttttgtctatagaaagggtgaagcgcatggatatccgccatttaacatatttcttggaagtcgcccgtttaaaaagttttacgaaggcttcccaatccctttatgtttctcagccgacgatatcaaaaatgatcaaaaatttagaagaagagctcggaattgaactgttttaccgaaacggcaggcaggtggaactgactgatgccggtcatagcatgtatgtgcaggcgcaggaaatcattaaatcatttcaaaacctgacgtcagaattaaatgatattatggaagtcaagaaagggcacgtacggattggactgccgccgatgatcggatcggggtttttccccagagtgctcggcgatttccgtgaaaactatccgaatgtcacctttcagctagtcgaagacggttctataaaagtccaagaaggtgtcggggacggctctcttgatatcggcgttgtggtccttcccgcaaacgaagatatctttcattcgtttacaatcgtaaaagaaaccttaatgcttgtcgttcacccttcccaccggctggctgatgagaaagaatgtcagctgcgtgagttgaaggacgagccttttattttcttcagagaggattttgtcctgcacaaccgaattatgacggaatgtatcaaggctgggttccggccccatatcatttatgaaacatcacaatgggattttattagtgagatggtatccgccaaccttgggatcgggcttttgccggaacggatctgccgcggccttgacccggaaaaagtgaaagtcattccgcttgtcgatccggtcatcccttggcacctcgccattatttggagaaaggacaggtacttgtcgtttgccgccagagcttggctcgaacatacgaaatcgtatttatgggacccgaaaaaagatagtaaaggatgatgcaaatatggatgcacaatcagcagcaaaatgtcttacggctgtccgccggcatagcccactggtgcatagcataaccaacaatgtcgtaacgaatttcacagcaaacggcctgctcgcgctcggcgcatcgcccgttatggcgtacgcaaaagaagaggtcgccgatatggcgaaaattgcgggtgcactcgttttaaatatcggaacactgagcaaggagtcagtcgaagcgatgatcatcgcgggaaaatcagctaatgaacatggcgttcccgtcattcttgatcctgtcggtgccggagcaacaccgttccgcactgaatcggcacgtgacatcattcgtgaggtgcgccttgctgcaatcagaggaaatgcggcggaaattgcccataccgtcggcgtgaccgattggctgatcaaaggtgttgatgcgggtgaaggtggaggcgacatcatccggctggctcagcaggcggcacaaaagctaaacacggtcattgcgataactggtgaagttgatgtcatagccgacacgtcacatgtatacacccttcataacggccacaagctgctgacaaaagtgacaggcgccggttgcctgctgacttccgtcgtcggtgcgttttgcgctgtggaagaaaatccattgtttgctgctattgcggccatttcttcgtatggggtcgccgctcagcttgccgcacagcagacggctgacaaaggccctggaagctttcagattgaattgctgaacaagctttcaactgttactgaacaagacgtccaagaatgggcgactatagaaagggtgactgtctcatgactcgtatttctcgggaaatgatgaaagagttattatctgtatacttcattatggggtcaaacaatacgaaagccgatcctgttacagttgtacaaaaagcgttaaaaggcggtgccaccctgtaccagttccgtgaaaaaggcggggatgcgctgacaggagaggctcggattaaatttgctgaaaaagcgcaggcagcttgccgtgaagctggtgttccgttcattgtcaatgatgatgtggaattggctctgaatctgaaagctgatggtatccacatcggccaggaagacgcaaatgcgaaagaggtaagagctgctataggtgatatgattctcggcgtttctgcccatacgatgtctgaggtgaagcaagccgaagaagacggagcggattatgtcgggcttgggccgatctatccgactgaaacgaaaaaagatacgagagcggtacagggtgtatctcttatcgaagcagtgcgccgccaaggcatcagcattccaattgtcggcatcggcggaatcacaatagataatgccgcacctgttatccaagcgggggccgatggcgtcagtatgatcagcgccatcagtcaggcggaggatcctgagagtgctgcacgcaagtttcgtgaggaaattcaaacgtataaaacaggaagataatcgttcattttccttcaaagggctgttctgtaaaaggacagcttttttgctgtccatcaaggttttcagaccttcaaattttaattgacaaaggacaggaactggctatgattatgttatacaatgataatcattttcaattataggaggaacatgatggctcgggggctggcacttattctattcagcttgttgatggttttcggttctgcggcacatgcggaagatgatccgatcgccgcattaattcaattaaacaagcaaatgatcaaatccgtaaaagacggggatatggattcggcacaacaaacgtttgacaccttcaaggcgaagtggaaaaaagaagaaccttctattaagaaagaaaacctttcttctcacagtgaaatggacgcgaatatcgcgatgatttctctttcttttatcaatcaagacgcacgtaagctcaaaacacagcttgaagagcttgcgtctcatttagaaacctatcagcaggctgtcgtgctgaaaaagacatcctcaggtcaatcaagggcgtccttaacagcctatatacaaagcttgaaagacacaaaacagttcatagaaaaaaacaattggatgaagcgtcatccgcaatcgacaatttagttacatcctggctcgctgttgagggagatgtcgtgtcccaatcgaaagaagcctatacgacatcggaggaaaatctggcgctgatgaaggcggagatcggcagccatcctgaaaaggtatcaaagcaaattgacgaaatgattcaattgctcgagccgatcgcttcaagcagctacagctggtgggatgcggcgctgatcccggttcgtgaaggaatggaggccctccttgtcatcggagcgctattaaccatgacaaaaaaagcgcgggttacgcgttcctcgacatggatctggggcggggcgtccgccggcatggctgtttccttagcagccggcatcggtgtcacggttctgttctcctccagtgtattcggagaaaacaatttcttgcttggcggcgttaccggcgtactgtccgctgtcatgcttttgtatgtcggggtgtggctgcacagaaacgcctcaatggataaatggagagaaaaaatcaatatccagaagtcacaggcactaaaaaaacgaagcctgctttcctttgcgctcattgcatttctggcagttgtaagagaaggtctcgaaacggtcatctttttcatcgggcttgtcgggaagctcccgctcactgaactgatcggcggaactgccgcagggcttatcgttctcgtcatcgtcggtgttctgatgatcaagctcggaatgcgcattccattgaagccgttttttcttctatcaatggcggttgtcctgtatatgtgcgtgaaatttctcggaaccggcgttcacagccttcaactggcgggcattcttccgtctgatgcagaaagctggctgccgtctgtatcggtgctaggaatttatccgtctgtgtacagcacgattccgcaaatgttgattttactctttttactgattgcgcttgtttcagaagcggcaaaacattttacaaacggaaaggaactgacaaaatgaatttcacaaaaatcgctgtatcagccggatgcatccttgcgctgtgcgcaggctgcggagccaatgacacatcttcaaccaaagaaaaagcttcatctgaaaaaagcggggtcactaaagaaatcaccgcatccgtaaataaaatggaaaccatcatttctaagctgaatgactcagtggaaaaaggagaccaaaaagagattgaaaagaaggggaaagagttaaacagctactggctttcctttgaaaacgatattcgcagcgactatccattcgaatatacagaaatcgaaaagcatcttcagccaatctacacagaagcgcaaaaagacaaaccggatgcaggaaaaatcaagacagaatccgagtcattgaaagcatccttagaagacctgacagaagcgaagaagagcggcaaaaaggctagcgatcagctggcaaaagcagcggatgagtataaaggctatgtcaaagagcagagtgaccagcttgtcaaagcgactgaagcatttacgggtgctgtgaaatccggcgatatcgaaaagtccaaaacgttatatgcgaaagcgcgtgtttattacgagcgaatcgaaccgatcgctgaaagcctcggagatcttgatccgaaaattgacgcacgagaaaacgatgttgaagaaggagacaaatggacaggcttccataagcttgagaaggccatttggaaggatcaagatatttccggggaaaaggcaacagctgaccagcttctcaaggatgtaaaagagcttgacggttcaattcaatcactgaaattaacacctgaacaaattgttgcaggcgcgatggagcttctgaacgaagccggaatttcgaaaatcacgggagaagaagagcgctactcacgaattgatttagttgaccttatggcaaatgtggaaggctccgaagccgtttatcaaacagtgaaaagcgcgcttgtaaaagatcactccgacttgacggaaaaactggatacggagttcagcgaatttgaagttttaatggcaaaatacaaaacaaatgatcagtcctatacgtcttatgataaattaagtgaaaagcaaatcagagagctgagcactaagctgacgactctttctgaaaccatgtcgaagattgcgaatgtgctataaaaggagttttgtaacatcatgagcgatgaacagaaaaagccagaacaaattcacagacgggacattttaaaatggggagcgatggcgggggcagccgttgcgatcggtgccagcggtctcggcggtctcgctccgcttgttcagactgcggctaagccatcgaaaaaggatgaaaaagaggaggagcagattgttccgttttacggaaagcatcaggccggaatcacaactgcccatcagacgtatgtctattttgctgcactggatgtaacagcaaaagacaaaagcgacatcattacgttatttagaaactggacaagtctcacacagatgctgacgtctggcaagaaaatgtcagcggagcagagaaatcagtatctgccgccgcaggatacaggtgagtctgctgatttatccccttccaacttaacggtcacattcggattcgggcctggcttttttgaaaaagacggaaaggaccgcttcggactgaaaagcaaaaaaccgaagcacctagccgctcttccagcgatgcccaatgacaacctggatgaaaagcagggaggcggggacatctgcattcaagtgtgtgcagacgacgagcaagtggcgtttcacgcgctgcgtaacctgctaaatcaagcggtcggcacttgtgaggtccgttttgtgaacaaaggctttttaagcggtggaaaaaatggtgaaacaccgcgcaacctcttcgggtttaaagatggaacaggcaaccagagcacgaaggatgacacgttgatgaactcgatcgtgtggattcagtctggtgagcctgactggatgacgggcggcacctatatggcttttcggaaaatcaaaatgttccttgaggtatgggaccgctcttccctcaaggaccaagaggataccttcggccgcagaaaaagctcgggggcgccttttgggcagaaaaaggaaacagatcccgtgaagctgaatcaaattccgtctaattcacacgtcagtctagcgaaatctactgggaaacaaattttgcgaagagctttctcttacacagaaggacttgatccgaaaaccggctatatggatgcaggtctcctgtttatcagttttcaaaaaaatcccgacaatcagtttatcccgatgctgaaggctctttcagcaaaggatgcgttaaacgaatatacacaaacaatcggttctgctttatacgcatgcccaggcggctgcaaaaaaggagaatatattgcccagcgtttgctggaatcataaaagaagcctttacaggcttctttcagcgtgtcgacaaaccctcgcattcgttgtcaagcctgtgcgttggtgctcacgaattagagcattcgctccgctccaatgctcggctttcctagacttcaagggttttcaatcacgctgaaaggatgacaaaatcctaaaactttttaggattttgtcatcaatctgaaagaagcctaaatcggcttctttattaaaaaacagttgtaactttaattgttacagtttaaaatcaatttagtatgaaaggagattatcatgacagtacacattaaagtttattcagattacgtctgcccattttgttttgttggaaaagccgcttttgaagaagcgataaaaggaaaggatgttgaagtcgagtggatgccgtttgaactgcgcccaagcccatctcctcagcttgatccggtcaatgatccttctaaacagtacatgtggcagacatcaattcagccaatggcggagaaattaggagtcgagatcaattttccaaacgtctcgccccatccgtatacagacctcgcgtttgaaggcttccattttgcgaaggaatacaataaaggacatgaatacaacacccgtgtctttcaggcatttttccaggaggaccaaaatatcggcgatattgacatcttgacgaagctcgccgaggaagtgggattagacggtgcatcattcaaatcagcactggaaacaagaacatatcaggacgtgcagcgccaagccttgaagcacgcctatgaagaggctgacatcacagccgttccaacctttattatcggtgacactgtaattccgggtgctgccggcaaggatgtatttgaaaaagcgatttctgacgagcagaagaaaaagtaaggaaaaagctctcgataaagagagctttttttattcctgttccatatggacgccagtatgcgccttcacctgaatttctgcaaacgtatcttcatcaattgttttatcagacgacagcaccgttccgagccacgcgccgagaaagccgagcgggatggaaataattcctggattagatagcggaatgagcggatcaccggtaaaaatagcacctccggccgggtcccacacactagggctcatcgataccagcacaagcgcgctgatcaggcctgtcaggctgccccataaagcgcctgaggcattgaatcgtttccagaagactgtaaacacaatcagcggaaggtttgcgctggcggctaccgcaaacgcgagtgcaacaaggaacgccacatttaaggattgtgcaaaaatcgcaaggagaatcgagagcactgacacggcgacagaagcccatctggccgctttcatttgttctttttcagttgcttctccctttctgatgatctggctgtaaatatcatgggcaaatgctgaggcggcagacagcaccaaccctgtcacgacagccaaaatggtggcaaaggcgatggctgatacaaacgcgaacagaaagtctcctccgagcgcttttgctaaaagcggagccgccatatttcccgcttgatcagccgccgtaatcgcgtcaaaaccgacaaatgccgcggcaccaaagccgagaaataccgtcataatgtaaaacacaccgataatccatgtcgctgacacaacggatgtacgggccgtcttggcatccttaacggtataaaaccggatcaatatatgcggaagcccggcggttcccagcacgagtgccaagtttaacgacaaggtctcaagcggcaccttgtatttatttccggggttcaaaaaatcagcgccaagcggagtagccgttttcatctgttcaaacatggtattaaggctaaagccgaatttcgaaaacacgataatcgaaatcacgagtgtgccggccatcagcaaaacagctttaataatttgaacccagcttgtcgcgatcatgccgccaaacacgacataaatggtcatcagcactccgacgatgaggacagccgcggtataatccagccctagaagcagtttgatcagcgcgcccgcccccacgagctgggcgatcatataaaaagtagagatggcaatggtattgagagccgcgacaccgcggattttcttttctttaaagcgagcggcaatcatgtctgccatcgtgtactttccaagattccgaagcggctccgccacgatgtacaagacaacgagataagccaccagaaaaccgatgctgtaaaagaagccatcaaatccatataacgcaatcattccggcaatcccgagaaacgaggcggcagacatgtagtcaccggcaattgccagtccattctgaacgccggtgagcccgccgcccgccgtataaaactcactcgtcgttttcgtccgcttcgcggcaaaatacgtgataataagcgtcaggccaacaatcgccaaaaataataaaaaagcagtcatattcatgtctgttcacccttcagatcctcttttaaagcgcttacatacttatcgaaatgggcggctctccgggaatacacagtactcagtatccaggtcatagcgaattgggcgatggcgaacagccaagcccatgaaacagctccaatggccggtgcattcaaaaaggtgaaataagatgtcaaaacagggagtgaaaaataaaaaacaaaaaagaaaatcgcagaaggaacaataaaagcgcgtttctgctttaaaaaagcttgaaaagacggcgttgcagcaatctgtttataatcagctttgtacatggctttcctccttttattcgctaaacgtaagcaaaaaggtacaccaataggtatgtactgaaagtccgatttatgcgttgtacaatagctggaggatgaaaaaagaaggaagtcgtgaagaggtgaacacagtggtctaaagacaggcgaaggttttcaagctcggccgtgtataaacgagtttgctttcaaaacctcaccgaatgcagcttgttctcagcaaagctgctgtttaccagagcacggttatcatgttcgcatcacctctttatgacaatgcatgtgccaagaggtgatcgcatcaccggctgtctgtcgtagttagctgacacaccgtttgtcctcaagctcagcgcagcgatttgcttttgaatagaggatatggtgaaaactcagatcaggtgatagaaaagccagaggtaaatagatccgcctgttcggactagtcttgccggacggtttttttgtggtttttctttcttgatgctgtctcagattctaaaaactgcctcacatcatgaatgcctaatccaatggatctagcttcttgaattaacatatgccaacctttgtccaaatcttttttaacatgagttttcatagtaacctccaattgtataaaatgttttcctgcaacatgcgggcaataaaagacaagccagcgcgatgatggaggcgagtacaacaaatttcacacatagttgctcggtgttcacaaactgaaggaaaaaccacctacctattccctaaaaaaatgactaatataaccaatggaccttatttataataataaacaattaaatactgactggatagtatgtaaatgaaaataaatcatttagcctattaaaaatgacccctgggaaaccgaatagcataaccgtttaaagaaataaataccgctaaagattgatccggtgtaagataagggtaatcattaccgccaggagaaaaatatgaaaaaaaacaaatttcaaattaaaagagaagcaacatttgaaagttttatagacgctggcgtgaatttgttgattgaccgagcgtatgatccggtttctgtagaagatatcagcagagccgccgggtacagcaaaggagcattttatgttcattttgtcagcaaggacgattttctgctgtaccttctcgaaaaacgtcagatgaaaaaaaagatcattatagggtatcttgatcaaatggagcgggagtcagtgaaatcgctgacattggacgaggctgcaaaacacgctgcagaactgctttattcctattacataaataagccgtcgtgggacatcacctcgtttgccatgaacatgccgacatataaagtcttaaagaaatgcaaggcctatgtccggctgtacgaattgtgggtggaagaaaatgtgttatatattaagtggctgaaggagagaaagctgattgacgcctgtattgatcctgaatatacggctaaaataatatgtgcagtcctcgacggaatcatcaaacaatcatatgtattgggccagccagccaccttccgcagctttttagacgcactctcggtattttttactttagacagagagcacgagaggccaagaattttgaaaagtttttcagaaagcgaggaacatcagtgaagtatagagaaataattatgtatatcattatgggggttttcacaaccattgtgaatatcgccagcttttatatattggtagagatcatgaatgtggattacaaagccgccactgttgccgcttggattttgtccgtgctgtttgcttacataacaaataaattatatgtgtttcagcaaaaaacacatgatctgcagagcctgctgaaagagctcactgcttttttcagcgttcgggtcctgtctctcggcatagatttaggcatgatgatcattcttgtcggccagttcaatacaaatgaaaccttggccaaaatactcgacaacgcggtcattgttgtcgtcaactatgttgcgagcaaatggctcgtctttaaaaaaacaaaagaagaaggggtatgagaggactgcagcatatgatctgccgttttctatgaagaaataaggggaataaaaaataaaaaccagaaaggtgattgcacatgcgggaagagctaaaggggatatttgcaagtgtattcggagaaaaagaggggttacggtttttttcgcacctggaagagtgaatctgattggagaacatacagactataacggcgggcatgtctttccgtgcgcgctgacaatgggtacatatgctgctgttgcagaaagaaacgacgggcttgtccggatgtattcagataactttagaaacgcaggcatcaaggaatgcagccttgacgacattcgctatcaaaaagaagacgactgggcgaactacccaaaaggcgtgatttatgaatttcaacagaggggatatgcagttccccatggctttgacattgtattttcagggaatattccaaacggggcgggactgtcgtcttccgcttctattgaactgctgatgggggtcgtgctccaaagttattttcatcctgaagtagatgcgcttgagcttgtgaaaatggcgcagcatgcggaaaaccattttatcggcgtcaattgcggaattatggaccaatttgcaattggaatggggaaaaaacatcatgcgatgctgctgaactgtgacacgcttgactatgaatatagcaaactcaatgtctcaggcctcgcgctggtcatcgcgaacacgaacaaaaaaaggacattggctgactccagctataatacgagacgccaagaatgcaatgatgcattgcttgatctgaaaaaaggcctcgatattgccgcactgggcgacatcaagccttctgatttcgatgcgcattccagcctgatccaaaatgaaacgaacagacgccgggcaaagcacgctgtatacgaaaatcatcgtgctattaagacggcccatatgttcaaagagaacaatatagatgaaatcgggcagttaatgaaggaatcccacctttcattgaaggatgactatgaagtaacatgccctgaacttgatgagcttgtgtttgcggcatgggatcacgaaggtgtaattggatcaagaatgacgggagcaggctttggcggctgcaccatcagcattgtaaaagatgagttcgttgatgattttattcagaaggttggagacagatatcaagaaaaaacagggctccgagcggacttttatgtcgcggatatcggagagggagcgagagaactaaagggggagtgacatatgagtattattgaacatctggaacagctgcttgagtatggcctggaacgaaaattgatttcgatctgggatcgggaatatacgagaaaccgtctttatgaagcgctgggcatcacacatcccgagccgaactccagcaccagcatcaagcagtcacaaagcctgccggacttgctagctcccatctataaatgggctgccgaaaccggccgaatggaagcggatacagatacgtaccgtgacctgctcagcgcaaagctgatgggctgttttgtgcctgccccgtccgaggtcattcgcaaatttgaagagacaaaagcattatacggcccaaaacaggcgacaaaggaattctatcaatattcagaggatgtctattatatacggactgacagaatcgccaaaaatgttcattggacggtgccgaccgaatatggcgagctggaaatgaccattaacctatcaaagcctgaaaaggacccgaaagcgattgcggctgcaaaagagcaggaacagacaaattatccgatgtgtttgctgtgtaaagaaaatgtcggcttcgagggaagcgtgaatcatccagcccggcaaaatcacagaatcattccggtcatccttgaggacgaacaatggttcctgcaattctcgccatatgtctattatccggagcactgcattgtcttaaaaggtgaacatgaaccgatggagatcagcaaaaaaacatttgaaaggctgctgtcatttcttggccaatatccgcattattttatcggttcaaacgcggatctgccgattgtcggcggcagcatcctaagccatgatcatttccaaggcggcgcgcatgattttccaatggcacgtgcagaagcggaagacgtttatgaattaaatgattatcccggcgtgtcgctgggcttagtgaagtggccgatgtctgtgctcaggctccaaggagacgaaccgggtcatgtcgccgaagctgctgaccatatcttccgcacgtggcagacgtattccgatgaaaaagccggcattgccgcctatacaggcgatacgccccataatacggtcacaccgattgcgcggcgcaggggagacttgtacgaactcgatatcgtactgaggaacaaccggacggatgaggagcatccattaggaatatttcatcctcatcaagaagtccaccatattaaaaaagaaaatatcggcctgattgaggtcatgggattggcgatattgcctggccgcttacaggaggaaatgaaagaaacggcagcggcgctatgttctgctgatccgaaaacagccttagaacaaaatccgctcactgcaaagcatagtgagtgggctcttcggacgatggaaaaaagaaccataacaaaagagaacgtagatctagtcataaaagaagagctgggacatgtattcgcgcgcatccttgaacacgccggtgtatttaagcagacagcagagggaaaacaggccttcagaaggttcatcgatcagttgggcgccaaaccagtcaaaagcctcaaccgctagggttgaggctttttcgatttttatggcaaaacaaacacccaaagcgctgacgcttcgggtgctgctgcttttatcctctttttctggttaacaggcttactagaaagacaacaatggctgcgccgattaccgctggaataatggcaaatccggctaggtgcggcccccatgttccaagcagcccgtgtccgatccaggcgcctataagacctgcgatcatagacccgataattcctccgggcatatctccttttacaaacaggcttccaagccatccgataataatagcgacgataagtgaaataagaaaactcatcatgcaacacatcctattttttatttatttgcttatatcattcctcttttttgtataagataaacaactggatgctctcataaaaaaatacggacaattcagagcatattggctcttcattgcgccttttctttcaatatttgatgcgttaaaatggtaaccgtgtgaaaagatgctagacgaggaaaaaataattcctatctagaaagtttaacaaaatgaaatttttgattgacctaagttttttattgtggtaaaccttaatttgtcagaattagttcttcatcatctttctttactttatatgcggaaataactagaaacttttcatcttaagcgatagatgtgaataaagttggagcaatttttgtcgattttatgacatttaagcgaaaatgggatgaagtttataaaaaaataaagctaataagtgaagtttttgatagcataacaaagtagagaaaagattttgaggaagtatgcacttcagatttattacatcaataggaaggatggtgatcttcttgttcagagcattaaaaccgttgcttgtattagcgctgttaactgtggttttcgtccttgggggatgcagcaatgcttcagtactagatccgaaaggacctgtagctgaacagcaaagtgatttaatcctgttatctatcggatttatgctgtttatcgtcggggtcgtctttgttctatttaccattattttagtaaaataccgcgaccgtaaaggcaaagataatggatcttataacccagaaattcacggtaacacgtttttagaagtagtctggacagtgatcccaattttaatcgtcattgcactttctgtgccaacagtacagacgatatattcgttagaaaaagctcctgaagcaacaaaagacaaagagcctcttgttgtttatgctacttcggtagactggaaatgggtatttagctaccctgaacaggatattgaaacggtcaactacttaaacattcctgtcgaccgcccgatcttgttcaaaatctcatctgcagattcaatggcttcgctatggattcctcagcttggagggcaaaaatatgcgatggcaggaatgctgatggatcaatacttacaggctgacaaagtgggtacttacgaaggccgcaacgcgaacttcacaggtgaacattttgcagaccaagagtttgatgtgaatgcagtcacagaaaaagactttaacagctgggtgaaaaagactcagaacgaggctcctaagctgacaaaagagaagtatgatgaattgatgcttcctgaaaatgtggacgaattaacgttctcttctactcacttgaaatacgttgatcacggacaagacgctgagtacgcgatggaggcgcgcaaacgccttggctatcaagccgtttcaccgcattctaaaacagatccgtttgaaaacgtaaagaaaaacgaatttaagaagtctgatgatacagaagaatgatattgatcaggaaaggaggaagcctgcatgaaattcaaatgggacgaatttttcgtaactggtgacccattaattctgggcgcacaagtttccattgcgctttcaaccattgccattatttttgttctgacttacttcaaaaagtggaaatggctgtggtctgaatggataactactgttgaccataaaaaactcggaatcatgtatattatatctgctgtaattatgttattccgtggcggtgtcgacggtctgatgatgcgtgcccagctagcgcttccgaataacagttttttagactcaaaccactataatgaaatttttacaactcacggtacaatcatgatcatcttcatggcgatgccgttcttaatcggtcttatcaacgttgttgtgcctcttcaaatcggtgcccgcgacgttgcgttcccttacttgaacaacctgagcttctggacgttctttgtaggggcgatgcttttcaatatttctttcgttatcggaggttctccgaacgcaggctggacgagttatatgccgcttgcaagtaacgacatgagccctgggccgggtgagaactactacctcctcggacttcagattgccggtatcggtaccctgatgacagggatcaactttatggtaacaatcttaaaaatgagaacaaaaggcatgacattaatgcgtatgccgatgttcacatggacaacactgatcacaatggttattatcgtgtttgcgttccctgtacttacagtagcattagcacttttatcatttgatcgtttgttcggcgctcactttttcacattggaagcaggcggtatgccgatgctttgggctaacttgttctggatttggggacatcctgaagtatatatcgttattcttccggcgtttggtattttctcagaaatcatctcaagctttgcaagaaaacaattgtttggttacaaagcgatggttggttctattatcgccatctctgtattgagtttcttagtttggactcaccacttcttcacaatggggaacagtgcgtccgttaactcattcttctcaattacgacaatggcaatctcaatcccaaccggggttaaaatctttaactggctctttacaatgtataaaggccgaatcagctttacaacacctatgctgtgggcgcttgcgttcattcctaacttcgttatcggcggggttacaggggttatgcttgcgatggcagcagcggattatcaataccataatacgtacttccttgtatctcacttccactatgtgctgattgcgggtactgtatttgcttgtttcgccggatttattttctggtatccaaaaatgttcggccacaagctgaacgaaagaatcggaaaatggttcttctggatctttatgatcgggttcaatatttgtttcttcccgcaatatttcttggggcttcaaggcatgccgcgccgtatttacacatacggaccgaatgacggctggacaacattgaactttatctcaacagtcggagctttcatgatgggtgtaggattcttaatcctttgctataacatctactacagcttccgttactctactcgtgaaatcagcggagattcatggggtgtgggacgtacgcttgattgggcgacttcttctgcgattccgccgcattacaactttgcggtgcttcctgaagtcaaatctcaagatgcattcctgcatatgaaagaagaaaaaactgaattataccctgaaagcaaattcaagaaaatccatatgccaagcaactcaggcagaccgttctttatgtctgttgccttcggtctcgcaggctttggacttgtctttgaatggtactggatgggcgtagtcggattgatcggagtcctgctctgcatggttctgcgttcattcgaatacgacaacggctactacattagtgttgatgaaataaaagagacggaaagaaagatttccgaataaggaggcgtgagttatggaacatgcagaacacggcaattctaacgcgcctatggaatatcaatctgaaaccggcagacttaatattctcgggttttggatctttttaggggcagaaattgtgttgttctcaacactatttgcaaccttcttcgttcttaaaaacagaacagctggaggtgtcttgccagacgaactatttgaagtcaatctggtaatgattatgacgttcttgctgctgatcagcagctttacctgcgggatcgctgttcatgaaatgcgccgcggaagtttaaaaggcgtagtcatttggacaattatcactcttcttctcggtgccggcttcgtcggatgcgagatcaacgagtttgttcactatgtacatgaaggagcggctctcagtacaagtgcgttctggtctggattctttgttttacttggaactcacggaactcacgtaacaatcgggattttctggatcacaggaattctgattcagttgaagaaacgcggcttaactccgcaaacttcatctaaaatctttatctcaagcttgtactggcacttcttagatgttgtatggattttcatctttacaggtgtctatctcatgggattggggggtctgtaaaatggcaaacaaatctgctgaacacagtcactttccatggaaacacattgtaggttttatcctgtctatcgttttgaccctgctggctctatgggttgcagtgtatactgacctgagctcatcagcaaaactttggattatcttcggcttcgccttcattcaggcggcgctgcagcttctcatgttcatgcatatgacagagagcgaaaacggcacgatccaagtcggaaacacgctgttcggattctttggcgcgatcgttatcgtacttggatccatctggattttcgcggctcactatcaccatggtgaccatatggacggaaatcctcctggaggcgctgaacactcagagcattcaggccataacgaataatacaaaaaaccctcttcagtggaagagggttttttgctgtcttcagctgcttcgctttctgcgaagatacggaaggccgtaaatgataaatgcggcgatatgagcgacaatgacgttaacggcaaacaagataatcatgagagtgtgtccaagtggagaaaggctttctgttgcgtaaaagaagaagaatacccacattaaaatgattggcggaatagctgagagtgcgacttttttgttatcaagccaaataaagagaggcgttgcgctggcaaccaataagtaagcaaaaaacatgtccatcatacccgtctcctttcattttgtgataacgtttacaaaaatgaaatagaggaactgagttgtgtctgttttgtgattgttttttgaacattctgttacaattattataccatgttttccagaaattgatacgtgtttttgcagaaatggactggatctatcgtcttattttttcgtttaatgtgctaggagaatgtatgggcatggggctctgaatttttagctatttctatatgaggtatcacattatttgggaacataacacattatcgcattcgttttttaacaaattctattggtatggcgtttttttcatttgaaaagttttgtgtcaatcgaaacatttcggtttatgatacgtcatatttcgtgtagctgaaaaagcgccgcaaatgctgaaaaaacataaaaggaagcgagcttcacgtgtcatcttgaacgtggttcatgtataataaacattagtgattttccgatgaaaatgtaaggcgggatagaatgagtcgatataagaaacagcaaagccccttttaccagggggatttgatttttatatttggtgtgttttttattataagcgtagtatcaatatatgctgccggtcagtttgggcagtatgggaacacggattggattcagcaaattgtgttttatcttttgggggctgtagccattacagttcttttgtactttgatttagaacagcttgaaaagttaagtttatatatttttatcattggtattttatctttgattattcttaaaatcagtcccgagtctattgcacctgttattaaaggggcaaaaagttggtttaggatcggtagaataacaatacagccgtcagagtttatgaaggttggtttgattatgatgcttgcttcagttattggaaaagcaaatcctaaaggagttcggacgcttagggatgatatccacttgttattaaagattgcgggtgtcgcagttattcctgtaggtcttatcctgatgcaggatgctgggactgcgggaatatgtatgtttatcgttcttgtaatggtttttatgtcagggataaattggaaattgattgcgatcatagctggttcaggtatcttactcatttcattaattttattagtaatgataaactttcctgacgttgctaaatcagttggaatacaggattatcaaattaagcgggtcacttcttgggtgtctgcttcaaatgagacacaggaagattcaaatgacagctggcaagttgaccaggccatcatggcaataggatctggtggtattttaggtaatggtatttctaatttgaaggtttatgttccagagagtacgactgactttatcttttctataataggtgagtcatttggctttataggctgtgcaattgttgtcatcatgttcttctttttaatctacaggcttgttgttctgatagacaaaatacatccgtttaaccgtttcgcttctttcttttgcgttggctatacggcgttaattgtgatccacacattccagaatatcggaatgaacattggcattatgcctgttaccgggattccgctgctgtttgtcagctatgggggaagctcgacactttccacgttaatcggatttgggattgtatataatgcaagtgtgcagctgacgaaatacagaagttatctttttaattcttgatatgcagacagcctttacagaggctgtctttttttgtgcagagcatttcacttttgagatcactttttttcggatatgataaaaagtgataaggaggtttttgtgatgaataacacaatcgaaaccattttgaatcatcggtcaatccggtcttttactgatcagcttttgacagctgaagaaattgatacattagtgaaaagtgcgcaggctgcgtctacatccagctatgtgcaggcatattcgattatcggggtttctgatcctgagaaaaaacgtgagctgtccgtgcttgctgggaatcagccttacgttgagaagaacggacacttttttgtattttgtgcggatttgtaccgccatcaacaactggctgaggaaaaaggtgaacatatttctgagctgctcgagaatacagaaatgtttatggttagcttgattgatgcggcgctggcagcgcaaaatatgagcattgccgctgaatccatggggcttggcatttgctatatcggcggcattcggaatgaattggacaaggtgacagaggtgctgcaaacgcctgaccatgtgctcccgcttttcggactggcagtaggccatcctgcgaacctttccggcaaaaaaccgagattgccaaagcaggccgtttatcatgaaaatacgtataatgtgaacacagacgatttccgtcatactatgaatacgtatgacaaaaccatttctgattactatagagaaagaacaaacgggaagcgggaagaaacgtggtccgatcaaatactgaactttatgaagcaaaagccgcgtacgtatttaaatgactacgtgaaagaaaagggctttaataaaaactaaagcaaacctctccgtctggaggggtttttatgtttcacgtgtaacatattccgacaaatagggacatgctttcacaaataaatggcgaatgataggggacactgataagcagtgtgagcggctttggagaaaaaataggggatcagtgatacgatgaggatgaggtggtagggatggtttcattaagtatattagatcaatctccagtatcagagggcagcaatgcagaaacggccttacagcaaaccgttgcgcttgcccaagctgctgaggaccttggatataagagattttgggtttctgagcatcacttttcaaaacggctggcagggtccagtcctgaggtgctaatcagtcatatagcagcgaaaacaaagcgaattcgtgttggatcaggaggagtcatgctgccgcattacagtgcttataaagtagctgaaaactttcgtgttctggaggggctgacaccaggaagaattgacctggggcttggcagagcaccggggggaatgccgattgcatcatgggcgctgaatgacggtggtaagcgcaatgctgatcagtatccgcagcaaattaaggagctgaccatgtatttgcatgatttggcggatgacaaacaccgttttccgaatctgaccgctgcgccgcatatttcaacggctccggatgtgtggctgctcggctcatctggagaaagcgcgctgctcgcagctgaatctggcgctggctatatgtttgcccattttatcaatggagagggcggagagggtactgtcagacagtataagaggcgattcaaaccgtctgtgttaggagatacgcctcgagcggcagttgctgtttttgttctttgtgctgacacggaggagaaggcagaggagcttggggctgtgcttgattttacacttttggcgggagagcagggtattcctttagagggagttccttcgtatgaagctgttcggaaaaatacgtattctccttatgaacagagacgaattgctgataatcgaaatcgaatgattgttggtacgaaagaacaggttaaggagcggctgttagctttgagtaacgcgtatgaaacagaggaaatcatggtggtgaccatcacgcatcattttgaagataagctccgatcgtatcgcttattgcaggaggcgtttgctgactgatctttaaaaagccctgccgaatcggcagggctttttcttattcaacagtgaaaggttcttcggtcaaaacctggcttgacttgcctttgttcgcggcatatgcgagcaagtaatactctccggccggaagtttggttccgccattaatcgtgccgtcccagtcaaagtactggtaacctttatcttggtttttataaatgccggcttggcctgcgaaatcaaggttgctgtcatagacgaggaacgccagctcttccgctcccgcaggaaggtaggtttcaatttgataggtaccttgtacagacccttcgctgacagagacagatgtgactctcggataatcgggctctttcacaatcagcaatgtaggtaccttagcgaccgtttttccgccttctctgacgataaccgttccttcataggtgccagcttttgttttcttcgtattgacctttacttttgcagtggctttcccggtttgatgtgccggaatcacaacacggcttgtgccggatgtggaaatgccgctgccattaaatgagtattcaagtgtgtatgactttctaatggaagattgattttcaatcgtaaacgtttcattttttgtttcgtttccgttttccttcaagaacgtgccgtatgaatagcttccaggtgagacgagcgaatcggctttgattgcgttcataattcttgcgctgcctgcgccttgagcgttatgcggatatacttccccatcgctatcctttaaagtgacagcggtattcatgatggcggctttaatctgttcaacgctccactttggtttggcttgtttaataacggcaaccgctccggcaatatgaggcgatgccatgcttgttccttgttttgatccgtagccgtatggatggtcaggatcgtgtgttgggatcgtgctcacgatattgacccctggcgcggaaatatcaggcttaatcatccacgtatccataacagggccgcgtgatgagaaatcagcgacttgttcaccgagcgcttttgagaccgtcaacttgaatgttgtttttgtctcaccagctttcagggcgctgacgagtttttcgccgtcttctaatgaaagcttaatcgttgggacagacatgcctggcacattggcttcaatttctccagagaggttgttatacacaaccatgccgattgcaccggcttttttagcgttatccgctttatccacaaatgcaatgctgcctcgtttgacaacggcgactttgcctgtcaggtctttcccttcaaaatcctttgcttcgccgattcccgcttcgacaagctcaacttctttgttattgagcgctttgacgtcgtcctctttgttgtagcccatcacttttgctgaagagtaggagccgaaagtgacggcgtattcattgagcggcagctgagtcgcaccgacagaaatcgcttctcttgatgtgcccggcgatccgactgtccagccgttcggtccgctgttgccgtttgaggtaacagcgacaacgccttctgacatggcccagtcaagcgctgtgcttgtcgcccagtccgggttgtttaaagagtttccgagagacaggttcatcacatctgccccgtcctgcactgcacgttccacgcccgcgatgacgttttccgttgtgccgcttccgccaggccctaacacacgataagcaagaagtgtggcatcaggcgctacgcctttaatcgttccgtttgcagccacagttccggctacgtgtgtgccatggtcagttgcctcgcccctcggatcgccggttggtgtttcttttggatcgtaatcattgtccacaaaatcgtatcctttatattgtccaaagtttttcttcagatctgggtgattgtattcaaccccagtgtcaataatcgccaccttgatgccttttcctgtgtagcctaaatcccatgcatcgtttgctccgatataaggcgcactgtcatccatttgcggagatacggcgtcttcggagattgtgacgtctttatccttcatattgtctgttttatatgtgacgttcgggtacactgccttaacgtcttttaccgctagaagttttggaatctcattagctggaagcttcatagagaagcctgagaatacctgctcatattcccggtttacttttccgtttttcactgctttgattgctttgttttttgctttggtgcgagcggttttcagcttgcttttcgattggctttctcccgcttccttcgcttctgccaaggatttttcttttaattccactataacggttgtttttttgcttgtcgtcatatcgatatcaccgaatacctcggctttttccagatcagccgacgtttttgaagaagccggagctgcctgaacgcccgtaatgcctgtggataacgcaaaaaataagacgaaacttacaagcagaaagcgaatgatcccctttttcaatgtgtttccccctttgtatttagaaaaaatgtgaaagatctagtatatatttcttgaaaattcaaaaaaatccttgtgtcatttggaccatttattggattttgtttgtgtataacgaaggagttatacacagaaccctgtgtataagtgaataaacctgtgtatatatatagttaggaatatacgttcgtatacaaaatatagatagagtttgtggacatgtggatatctcttgtgattaagttgttcttatctttgggataacttgtgtataaagttttcaaagcggttctccaattttcatttcaattctttcagctttcaacaaaacttctaaaaactagttggttttttcactcatattgtgacaaagaattctctttccacggtctatcatagagtcatgagttttgctagagccgctagtttgcgagaaaagaaatcggccgtcttttcttgcgggctgcggctgagaaaacgggctgctaaaaaggctgcctgccaaaaagaagcggagggatgtttttctatgaaacgtttgcttgtatctttacgggtgtggatggtctttttgatgaactgggtgacgccggacagaaaaactgcggctgccgcggtctattcggctcagcgtacataccaaagaaaggcggctgtgcaggccgcaggactcgtttcgttttatgaatggcggatggctgtgaatgaggaagaaaagcagaaagcgaaagccgccgcgctttataaaagaagatgtttgcaagccttcaaggaatcgccaaagcaggagagagcgggcccgcatctttacatggcggtcaaaaggaggtaaaatcccagtcaaaagcaaattggcgggagagataacctcttgaaaatctataaagtattaaacaacaatgcggctttaataaaagaggatgatcaggaaaaaatcgtgatgggaccgggaatcgcttttcaaaaaagaaaaatgatctcatccctatgaataaagtggaaaagatctttgtcgtgcgcgacgagaatgaaaagttcaaacaaatcctgcaaacactgccggaggagcatatagaaatagctgaggatatcatcagctatgcggaaggagagctcgcggcgccgctgagcgatcacattcatatcgcgctttccgaccatttgtcctttgcgatcgaaaggattcaaaatgggctgcttgtgcagaataaattgctgcatgagataaaggcgctctataaaaaagaatatgagatcggcctgtgggcgatcggacatgtaaaagagacattgggcgtgtctctgcctgaagatgaagcgggttatattgcccttcacatccatacggcgaagatggatgcggagagcatgtattcagcgctgaagcatacgaccatgatcaaagaaatgatagagaaaataaaacaatactttaatcgaaaggtggatgaaaacagcatttcctatcaacgccttgtcacgcatttgcgatacgcggtcagccggttggaatcaaatgaagcgctccatcgtatggacgaggagatgctttatttcatccaaaaaaagtattcattcgcctatcaatgtgcgctggagctggcggagtttttgaaaaatgaatatcaattacatttgccggaatccgaggccggctatatcacgctgcatgtccagcgtcttcaagatctctcggaataaccgctttgacttgcagggagtgatctctggaagtttttttattgatcaggattcagtgtgtagtacatccagcccatcataactattcccgcggtcagattgccgagcgtaacggggattaagtttctgactgctcccatcagtgtcactgtatcagggtgctcgatcaaaagcgagatggcgaatgtgcacatattggcaatgctgtgttcaaagccggaaataaagaagcagaaaacgaaaagcatcatggtaaaaagctttgctccttcccctttgagagacattggaatgaaaaaggcgaggcacacaagccaattgcacagcattcctctgaaaaacaattcggaagccggcggctccattttgtgctctgccaaatgaatcaaaaaggaatgaacagaaggctcctcaaaaagtcccgtcgcgctgatcaggatggcaaacagaatggcgccgattaaattgccggcatagcttgacatccacaagtatagggtgtcgcgccagctgatttttttccggagcgcggtataggtgaaataaaaggtgttgccggtaaataaatctccgcctccgtaagcaatcatcagaatagcggccccgaaagtgacagcggctgccggaaaggcaaacggagaatcagccataaagaaatagctgcctgttttgcttgcggctgtaatgccaaaaccaataaatatactggccaaaatggaccgaagcacataacggattttgcttgaagcgaatatgttttgttttttcaaagcatactgttcaaccttttgtaatgcttgagtttccattgtcttttcctgctttctttcatgattgagcatagtatagcacgatattgtgaagtatttcacaattaatttttacgaatttttgtctacatgttatatcaaactatttaactaaaaaaatagttgacgaaaacgctatcatgatttatgatgaaagcgtattcttaatctgaataagcgggattgtgactggtaaagcaggcaagacctaaaatttgcgtaaatgaaaaaggatcgctgtgtcctttattcgttggcgaattttaggtcttttttgtttaaataaaagggggagaaatagatggattacaaagagactgcaaaacgcctcattgagcttctcggagggaaagaaaatattatcagcgcggctcattgtgcaacaagactgcgtttagtgatgaaagatgaatcaaagatagatcaagcacaagtagaagagcttgatggcgttaaaggggctttcagcagctctggccagtaccagatcattttcggaacaggccttgtgaataaagtattcgatgccttttctaaagaagctgatatcgagcgtgaagaacacgtcaatcatcaggatgcggcaaaagaaaagctgaatcccgctgcgagatttgcgaaaacgctttctaatatttttgttccaatcatcccagctattgtagccagcggcctattaatgggattgctgggtatgatcaatgcgtttcattggatgagcaaggattctgcgcttttgcagctgcttgatatgttttcaagtgcagcattcattttcttgccgattctaatcggggtcagcgcttcaaaagagtttggcagcaatccatacttgggagcggtcatcgggggaatcatgattcatccgaatcttttaaatccatggggattggcggaagcgacacctgattacatgcatcttttcggatttgatatcgctcttctcggctaccagggaactgttatccctgtcctgcttgcggtgtatgtgatgagcaaggtagagaaatggacgagaaaagtggttccacatgcggtggatttgcttgttacaccatttgttactgtgattgtcaccgggtttgttgcttttatcgcgattggccctctaggcagagcgcttggctccggcattacggttgctttaacttatgtatatgaccatgccggttttgtcgcaggtctgattttcgggggcacgtattcactcatcgtgctgacaggcgttcatcacagcttccatgcgattgaggcagggctaattgcagatataggcaaaaactacttgctgccgatctggtcaatggcgaatgtcgcacagggcggggcaggtcttgccgtcttctttatggcgaaaaaggcaaagacaaaagaaatcgcgcttccggcagcattttccgcttttctcggcattactgagcccgtcatattcggagtcaatctgcgctaccgaaaaccgtttatcgccgcgatgatcggaggcgcattgggtggggcatatgtcgtctttacacatgtagctgcaaacgcttacgggttaacgggaattccgatgatcgccattgcggctccgtttggcttcagcaacttgattcactatctgattggcatggcgattgcggcagtgtcagcgttcattgcagcatttgtcatgaagattaatgaggatgaggagaggaaaaaatgacagcacatgaccaggagcttcgtcgccgggcttatgaagaagtggagaaaaaagagcccatcgctaacagcgatccgcaccgccagcattttcatatcatgccgccggttgggctgctgaatgacccgaatggcgtgatttattggaagggcagctatcatgtattctttcagtggcagccgtttcagacggggcacggcgcaaaattttgggggcattatacgacacaggatgttgtgaattggaagcgggaagagattgcgctggctccgagtgattggtttgataaaaacggctgctactcgggcagcgctgtcacgaaagacgatcggctctatcttttttacacaggaaatgtcagggatcaggatggaaatcgggaaacgtatcaatgccttgctgtttctgacgacgggctgtcctttgagaaaaagggtgtcgtcgcccgccttccggaaggatatacggcgcattttcgcgatccgaaggtatgggagcatgaaggcacatggtatatggtgattggtgcgcaaacagagaatttgaaagggcaggctgtgttgtttgcttctgataacctgacagagtggagatttcttggcccgataaccggcgcgggcttcaacgggctggacgattttggatacatgtgggaatgccctgatttgttttcccttcaaggatcggatgtgctgattgtttcgcctcaagggcttgaggctgacggtttccgttatcagaacgtatatcaatcaggttattttgtcggccgcctcgattataacaagcctgaactgaagcatggtgaatttacggagcttgatcaaggttttgatttttacgcgccgcaaacacttgaagacgatcagggaaggcggattttatttgcatggatggcggtgcctgatcaggatgaagggtcccatccgaccattgactgccactggattcactgcatgacgctgccgagacagctgacgctttcaggacagaagctgattcagcagccgctgcctgagctaaaagccatgcgcagaaatgagaaaaaaatacacatcaacatgcatggatcatctggtgcgcttccagtggaaaaacctgaaagaactgagattctactggaagacattcatacggagtctggcttttcaatcagtatccgcggaacggctacgttttccttccataaagacgaggggattgttacgctggaacgaaagagctttgacggaaaaagaacagaagcgagacattgccgcatcaaggatttgcataccgtacacatgtttctcgacgcgtcatctgtggaaatctttatcaataacggagaagaggtctttagtgcaagatattttcctttcccgggaaatcatgaagtaacagccagtgcgaccgggaaatctgaaatgaatgtcggaatttggacacttatgtagaaaatccttctattttcttatgtgaaatctgagccatctgtgctattcttcaacgataacctactatttttttctgtaaaaggagttgttttcttgaatatacatgaacagaagataacaccggaatgtttggaaaaggctgctaaccaagttgaagataagcgagaagaatataaggatgtgctgcttcagctgaaaaaaatgcttggcggaacaacgccgcacagtgaaacggcggaaattctcacgcgggcatatgaacaaatgaaggaatatgcactttttgttcagtcgatagaaacatttttgaggaaatctgcaaacaatttaaaaatcaaataaacaggctgccgatgggatcggcagttttttctgtgaaaagtcttcggtgatttaaaaagggctgcctctctgtaaggcagcccctttttttatgattgttgattcaggcgcagtgcagaatgcttcgtaggaccaacatactggtttagcgggaaggattctttaatggccgctgtgatgaattctttcgctgcgtaaatggcttctttgacttccgcacctttggcaagctccgctgtcacggctgctgagaatgtacagcctgcgccatgtgtataaggcgtatcgatcatttcgctttcaaggacttccgctgtttctccgtcatagagaacatcaacggctttctcgtgtttgagtttgcctccgcctgtaatgacgacatattgagcgccgagtgcgtgaatttttttcgcggcttcgatcatatcgtcaactgtttttagttcatccatgccgctgagctggctggcttcaaacaagtttggcgtaatgacagtggctagcggagccaattgctcacgcagggcttgggcgtgctccggataaaggacttcattagcacctttgcaaaccataaccgggtcaattaccacattttttaattgtttttctttgatcgtttttgccgcaagctcgataatgtcaacggttggcagcattcctgttttcatggcgtccacgccgatgccgtccgtaattgttgcaagctgggcgcggattgtatcagtatcgatcgggaatacctgatggttccagctgttgtttgggtccatcgcaacgatcaccgttaaggcggtcatcccgtatacgttttttcttgaaatgtttttaaatcagcttgaatcccagcaccgccgctggaatctgagccggcaatggtgagtgctttatgcatagacatgtcttgaacctccatcatgttttgtctttcattatagttagattttctctgtatcacaatatagaagatctataggaatcatttgacaatctcaacgggctttcgtaaaatgctacataagaaaactaggtaggggttttgagatgttaaatcgtgagctggttaagggaagcacggttatattggtattgacgcttctgaacgagcggccgatgtacggctatgagcttgtaaaagaaatgggaagccgcagcggaaatgaactgcagatgaaagaagggaccttgtatccttctcttcacaagcttgaacgccaagggtatatttcttcctactgggagaagcaggagaaaggaccggaccgcaaatattaccggattacagacgagggcaaagaagtgctggcggaacgcacgaaggaatggagcgtattttcagccatgatggaccgaatactgaagtggagcggacaaaatggataaagaaacatatgtatccgaaatcaaaagcgggcttaaagggcttcctgagggtgaggcgatgatagaagagattgagagccatattgaacatcatctgtttcgctcttttcaggaaggaaagagtgaggaggaagctatgcagactttattgcaggcgtttggaacaccaactgacattgtttcttcgtttaagaaaatacagccagtaacgtttcgtgcgtttttgatgttccatcttttctgtaacagtgccctattcgctgtcggcattgcgattacaataatgcatgtatggcttgaatcaccgtttgttcaagcagtatggaaaggcatttctgtttctgtttggctgatcttagctgcatatatgatctactgggtgctgattgggtatcaaggcgtgaaggagtttggaaaacgcggagaaaagcttgttctacatacgattctgatctcaatggtgccaaacgtcatttttatgcttgtttttctattcaatgtaattcctgctgcgctgtttcaatccttgttgacaccttggtttgttggaacttgtgcttttgcaacgctgttatttccgttatttggccgaatgggctgttatattggcaggcgtcagcttgtctgattttttaggtatatacatagaatttctatgtaaaggaggtgtatgtcgtgaggattagctcttgtttatatggttttgtagctcatggggcagtatttttgtttactggtggctgcatgctcttggctatggcagccagcttgccttttgtttttctgcttgatcggctgcctgatgtcgtctttacagcaggtgccattcttacgctgctatgttcatatgcttatgtctggttttgggcggtccgatttgcatataaccagaaaatgcgcctgtttgaggttcaattggggtcctttgtgttgctagccctcatgatatctttgtttttattggatggatctagtatgaaagacatcatgatgaattgggacgatgcaggctgtgcttttgtgccgccggcttttacatttttgtgtctttcttatgcactggtgctgctgccggtctatcaatctaagctgtggcgtcttatccttccgaatggcgtccgcatgaaagatatctttcatgtctttggagatctgatgctgatcatggtgcttctgatcggagccactttgctgtttctatcattgtagtatgccgtttcagtaggatattcccactgatctcccgtccaatatatgttttaatagtacatgactatgaaaatgagaaggagagcatcatgaagatttctatcgtaattgtgacctataatcggattccggctttgtgtgagcttttggagtcgatttcccgccagaccttgatgccgtatgaaattattattgtgaatgatgccggggaatcggtcgtgccggtcaaagcactttatccggagctgccgattgctgtcatcaatttagaaaagaactcggggcatgtggctgcgagaaatgccggtgtaaaagaggcgtctggggattgcattatgctgtgtgatgacgatgatttctttacgccagggcatatcgagaaaatggcaaaggaaatagaaacggcagacttcgttcattctgatgcggaaatagtttcgtttgaagagaaaaacggaacaaggtatccagtgtcacggaaattgtttgcttataccgctgactatgaggatatgagagtgttttctacatacgtgccgtcgggcagcatgtacagacgttttctgcatgatgaaatcgggtatttcgatgctgatgtgcacaattactgggactgggatttttatttgcgcgcggccaaggattaccgggtgaagcgtgtcccttgcgccagcgtgatttatgccttcagtgacgcgggagacaatcagtctgctgaccttggcgccaagcggaagcaatatttggatcgtttaagtgaaaagcacggactcggggagctgccgacgaaaaactttgccgtcctgcttgaagagcctgagatgaagaggcgggaagcaaaaagtgaaatggtttgggatggcgagcctgtctattccagacttcatcgttcgtaaggaggcctgaatcttgaaacagcttttacaagacagctggtggaatcagctaaaggaagagtttgagaaaccgtattatcaagagctcagagagatgctgaagagggaatacgcggagcaaacgatttatccggacagccgggatattttcaacgcgctgcattatacatcatatgatgatgtcaaggtcgtcattttgggtcaagatccgtatcacgggccgggacaggctcaaggtttaagcttctctgtcaagcccggtgtaaagcagccgccttcgttaaaaaatatctttcttgagctgcagcaggacatcgggtgcagcatcccgaatcacgggtcgcttgtgagctgggcaaagcaaggcgttcttttgctgaatactgtgctgacagtaaggcgcggacaggcgaattcccataagggaaaaggctgggagcgactgacggaccgaattattgacgtgctgagtgaaagagagcggccggttatctttattttgtggggacggcatgctcaaatgaaaaaagaacggatcgacacctccaagcattttatcattgaatcgacgcatcccagcccgttttctgcgagaaacggatttttcgggagcagaccgttttcccgggcgaatgcctatttggagaaaatgggagaggcgccgattgattggtgtattaaggatttgtaaaaagcgcaggtgatctgcgcttttttatttgagtatttttcgaatcattcgcagcccgtttttggaggaaggataacgaaatgcgaagtcgaaacggttcgtttgtttgacgacgctttttttgtgcgtgaatgtgttaaaactgtcaaacccgtgatagctgccgatgccgctttccccgacgccgccgaatggcaaatacggcgtcgcaacatgcattaacgtatcattgacacagcccccgccaaacgacagatttcctaaaacagcgcgctcaatttctttgtttgtggtgaagagatacagggcgagcggcttagggcgcgattggactttctcaatgacttccccgatattgcggtatgtaaagagcggaagaatcggcccgaaaatctcctcctgcatcactggagagtcatctctcacttgttcgagaatggtcggcgcaattttgtgatgattgggatcagattgtccgcctgtgagcgggatgccatcattcagaaagctgagcagccgctgatagtggcgctcactgacgattttgccgtactgtggattccgttccggctgagggccgtaaaattctctgatcgcacgcttcatttcttctgtgagcttcgttttgatgtcctcgtggacaaataaataatccggtgcgatgcaggtttgtcccgcatttgtaaatttcccgaagacgatgcgtttggcggcaagctgaatgtcagcatctttatggacgatgcagggacttttgccgccgagctccaaggttacgggaattaattgtttggcggcggcctccatgacgatttttcctacagctacactgccggtaaagaaaatgtagtcaaagggctgctgtaataatgctgtgctgacatcgggcccgccttctgccatagcgacataatcagttggaaaaacgctgctgatgagtttggaaagaatagcagaaacagccggcgtatattctgatggcttgagaacgaccgtgttccccgccgcaatggcgccaatcaacggagaaagcgccagctgcaagggatagttccaaggcgcaatcaccaaaacggttccatacggctcagggatgatgatgcttttggagcctagatgagtcaacggcgttttgactcgtttcggcttggaccattttctcagccgtttcatgacaaagctgatttcctccaagacgattccgatttctgttgagtatgcttcttgctcggatttatggagatcctggtagagagcggctatgagatcggcttcatgagttctgacggcttgtttcagctttcgcaaaatgttcagtctcgattcaagcggtctcgtatgtcccgccgcaaaataggctttatgcttgctgatgatagaggggatgctgttcattccgtttctcctttttgtaaggtatggtgatttattatgtgaaaaatctcttctgcttgtcaatcgcgcaaggtttgtcagaaaaaataacaaactcatatctgcgttttcagcaggaatttgataaaatgcaggaagacaacatttatttttttggagggtgcttcatgaacattcatatatctgctttgattcaaaagatggaagaagagctaaaaaaagcaaaaacggctgaacgggatgaggagctgaagcgttatgtagcggttgtccgttctctgtgtgatgtcgtgcttgatcagccggagaacgcgagcgcgccccgcatacagccgagcgttacgccaagtcccgccgcgccgccatcgacagaccagctgatgatggaaaaaatgatggggagcgcgggattaaacaaatatcgaaagcaagaaaaagagaagcaggaagaggatggaaacggagagtctttatttgatttttaaagagagaggttgagcttacgtgaaattggttcttggcgcgctgcaatggacagcgtttattattgctgcggcgattgttgttccggtggcggttgcccagtcgtttcatctggatcactcagattctgcaagattgattcaaagcactttttttgtactgggaattgccgccgtcattcagtgtttgaaaggccacagactgccgatcaatgaaagcccagccggcttgtggtggggagtgtatacgatttacgcagggctgacgggaactgtgtttgcgacatatggagacacactgcggggtttgcagggagctcttcttgtaagcgctgtatgtttctttttgttaagtgttttcaaggtcattgacagacttgcaaaattgtttactccggttgtaacgggcgtctatttattgcttcttgtcatgcagctgagtcagcccattataaaaggaattctcggaatcggttatcgacaggacggggtggacggtcttgtatttggcctggcgcttgttgtgatcgctgccgcttttataatgacaaattcgaacatcatgttttttaagcaatattctattttattagccttgttcggcgggtgggtgctgtttgcggctgccggagccgcaaagccgattgaaatgccggaccggctgtttcagctgccttccctgtttccttttgggaccccgttatttaacagcggcctgatcatcacttctatttttattaccatcttgctgatcgtgaatatgctggcgagcatgaaggtcgtggacatcgccatgaaaaaattcagcaaacagcctgatggaaagcatcatgaacgccatgccggttttgcagcttcattcagccatctgcttagcggtttgacgggagctattgcgcctgttccgatttcgggagccgcaggttttattgaaacgaccaagatgccttctaaaaaaccgtttatgctcggcagtattctggttatcgtgatcagcgtgatcccgttttttatgaatacgtttgcgagcctgccgtcacccgttggatttgcggtgaattttgttgtgttctccgcaatgggcggtctggcctttgccgaatttgattcatatgagaaagaagaatcaaaaagggtgaggtctatcatcggtatctcactgctgacaggggtcggtatcatgtttgttcctgaaactgcgttaaagggattgcatccggtatttatttctctattaagcaacgggctcgtattagggacgcttgctgcaatagcagctgaccagttccagctttggcgcaggagaaaatccgacaatctcgtgtcaacggagaacaaacattgaattttggtgcaggtgcgataagataaatgatatgagtttaacgaaaaggcgggagagatagatgaaagtttttatcatattaggggccattaacgccctgcttgccgtgggactcggagcattcggcgctcacggattagaagggaaaatacctgataagtatcttcaggtttggcacacaggcgtgcagtatcatatgtatcacgcccttgggttattcgttgtcgcgtttctggctgataaattatccggcataggcagtgtcacgacagccggctggctgatgtttgcgggaattgtgctgttttccggaagcttatatattctaagtgtgacgcaaatctccattcttggagcgatcaccccgctcggcggtgtggcgtttattatttcttggattatgatcgttgtcgcagccgtcaaatatctataaacaaaaaagccaatcctcatcatatgagtgattggcttttttcttatcttggcgaataggacgccatggaatatggatacgtataagcaatttcttcatcaaatgtaatgtaatcgaggtagattgtcaggagcaggtagcgtgttcctgatttcgggtcgctgataataatgtgatcccggcccgcagcttcgatgacgccgcgaaaaatcttcgagccccattccttgctgttttcaaatgtcatataaatggtggccgtttttccccgattcaggcgcaaaatattctcgatgtaagattcctcaacaggcagcatgccgggaacgctttggcccggtcctgacggtgtaggccccgatggaatttgaaaaccgccgccctgctgctggcccgggaatccaaatccctgctgtccttgttgtccttgctgtccctgctgcattggcatcattggctgcatccccattgtctgcatttgtgagccttggccttgctgcgggtacgggttggcgccaaactgaggctgatacccctgcatattatcaaatgcctgcatttgctgatattgattttttttcggtttcatatcgttcctcctttttatgaaaaccattcaaaacatgttctggatgtataggtgaacgctccgcgatgactcacctccgatggaaaacgatcttagtcgctggtgcgatttttatctctttcaccttatgaggctgatgcttggattatgctgaaaaagaacagcggaccgatcagatttcgctctgggcagccgctgtttttcagaaacatacacaaacttttcgcatattggtttgtatccctagcgcaacttgagcataagcaacataagataacgatagtttcaggtgtgaagttccaagaaggaggtgtaggatttgcctaaagtatcagtcattatgacgagctataacaaaagcgattatgtggcaaagtccatttctagcatactctcacaaacgttttcagattttgaattgtttattatggatgacaactccaatgaagagacgctgaatgtaatccgtccttttttgaatgataaccgagtgcgtttttatcaaagcgatatatctggagtgaaggaaagaacagaaaaaacgagatacgcggcactgatcaatcaggcgattgagatggcggagggtgaatatatcacctatgcgacggatgacaacatctatatgccggaccgcctcctgaaaatggtgcgggagctcgatacccatcctgaaaaggctgtgatttactcagcctccaaaacctatcatttaaacgagaatcgtgacattgtaaaagaaactgtcaggcctgccgctcaagtgacatggaacgcgccgtgcgcaattgatcattgctcggtgatgcacaggtattcggtgcttgagaaggtaaaggagaagtttggctcctattgggatgaaagcccggcgttttaccgtataggagatgcccggttcttttggagagtcaatcatttttatccgttttacccactggatgaggagctggacctgaattatattaccgaccaatcgattcactttcagctgtttgaattagaaaaaaatgaatttgtcaggaaccttcctccgcagcgaaattgccgagagctgcgtgaatcattaaaaaagcttggaatggggtgagagcttgtcggcctatttaagcaattattgggtgctgtaccggaagtacgtggagctttttgacaaacttcgctacaaagggattccgcttgggcttatcagtaatttttatcaatacatcagccctgaactgagggtgatgatggaagaagaaccggaattattcggatcggtggatcagcatatcgatgagggacagattcagccgttttttgaagaaagaatccaaaacatcgttaaaacaaatgacgaacctgttaaagggaaagtcattttgcactttgattacctgcgtttttcaaacgaaaattactatcaatttgatcctgaaaaaacggctgttttggccagatggagtttgccgcattattgtgatctgcctgtaattagcaagcgggagattgcggattcatgccaaaaaggcgattcgaagcagtatctcgaaacagcctgttcgcttctcgccccttatgatgatcacccggcatttggtgatcaagcgtttcgcgaccggcttttcaaagatattcctttatttatagaggccattgatacagttgatgcgctgtttgaacaggaaaagatttcagctgttattgtcggaacggcagaagacatttacagcagggtgctcgctctcatgtgtcaaagaaaaggggccgtcagcatttgtcttcagcatggcgcattgatgggagatgaagccttcattcctgtttttacaacctatcaagctgtttttggtgcgtatgaagcagagtggttcatacgaaaaggctgtaaacccgagcagattctcgtaacgggacatccccgcttcgatcagatttttaacagaacgcctatggatatgtccatattctatcgaaaacttgcttttcagccgactaaaaaaattgtgctcattgccactcagcccttttcagaagacttttattccggtgtgctgcaggggctttctgatcagaagcagctgcaaatcattatcaaaccccacccgtgggaaatcggaaaaaacaagcttgatctgtatcacgaggcggcgaaaaaacatcaagcatgcagagtcatcaaaaaggagctggagctttatgatttgctgccgtatgttgatgccgcagtgacgcaaacctcgacagtcggtcttgaagccatgctgtttcaaaagcctgtgctgataggaaaatcgtccggaaatcgctcgtatccgtattatgagtctcttggcgattttatgtttgaccagccggatgaactggcgcacaccttggttgaggttcttcgaagtcccgacgtgcatcaaaaagcagaagaggcgcgcctggcattcatagcggctaattatccggtggcagaatcaacaaatgctttatttgcggaactgaaagccaaaacaggggttgattacaggcgggaagatactgaataaaatgataggagcgcaaagaaatggtgcaaaagagaaatcattttctcccttactcattgccgttaatcggtaaggaagaaattcaggaggttacagaaacgcttgaatcgggatggctctctaaaggcccgaaggttcagcagtttgaaaaagagtttgccgcgtttgtcggggcgaagcacgccgtggcggtgaattcatgtaccgcagctttatttttggctttgaaagcaaaagggattgggcccggggacgaggtcattacctctccgcttacgttcagctcgaccgccaatacgattattcatacgggagcgacgcctgtgtttgcggatattgacgaaaacacgctcaatattgacccggtaaagcttgaggcggccgtcacaccgcgaacgaaagcagttgtgcccgtccactttggcgggcagtcctgcgatatggatgcaatattggctgttgcccaaaatcatggtttattcgtgctggaggatgcggcacatgcggtatatacgacttataagcaaagaatgatcggttctatcggggatgcaacggcattcagcttttacgccaccaaaaacctcgcgacaggggaaggcggcatgctgacgactgatgatgaggagcttgccgataagatacgggtgctaagccttcacggcatgagtaaagccgcatggaaccgttattcttcaaatggcagctggtactatgaagtcgaatcgcccggctataagatgaatatgtttgatttgcaggcggccctcggacttcatcagctgaaacggctggatgatatgcagaaacggagagaagagattgccggccgctatcaaaccgcttttcagcagattcctgggctgatcacgccgtttgtccatgatgacggcaggcacgcctggcatctatatgttctgcaagttgatgaaaaaaaggccggggttacgcgcagcgaaatgattacggctttaaaggatgaatacaatatcggcactagcgttcattttattccagtacacattcatccgtattatcaaaagcaatttggatataaggaagcggactttccgaatgccatgaattactataaacgaaccctttctctcccgctctatccatcaatgtctgacgatgatgtagatgatgtcattgaagctgtgcgggatatcgtaaaaggggctgattaagtgtatacggtaaaagaaaatgtctccaaagaggcaattgaggaatttctccaaagcagaaagcttacattggatgttccgtatcaattttccctcggcctttttgaaaacagcaggctccaaggcgtattgctttacgaagattctttgtgggaaagcaaggtgcttcagaagaaagtcatgaacgtcaaacttcttgcggcaaatagtaccgggcagctaaagaggctgtttgaagctttttatactgtacgccaaatggatgaaacggattttatctttgtccgtgttccggctgaagatatcggagccgcgcatgtgatacaacagcagccatcctcttactttgtcgggagtttgctgaagctggcgatgcctccgtctttttatgacaaaacaccgccattttttgaactgggcccgcctgagcccggagacacagaagcgatatgtgagctggcccgagactcgtttacaaaaagcagatattttcaggatcctcatctcagccgcgatgcagcaaacgaaatatttcaggagtggacacgaaacaatctgaatggaagggcggcggtcaatattgtcgctaaacacaatggcgaggtcatcggctatcttcagggcttatcaagagatgatgagtgcattctcgatttgatggctgtaaagccgggatttgaagggaaacgtattgcgtttcatttattggcgaatctcatagaacaaccggagacccagaagcatagaacggtaacagcggggacgcagcttcacaatgtaagggcgatccgcctttatgaacgaatgggcttcaccgctgaacaatcgtattactattatcatatttggccgggcaaggaggcgaaataatggcagcgtttcagatcgcgaataaaactgtaggcaaagacgctcctgtttttattattgctgaggcggggattaatcatgacgggaagcttgatcaggcttttgcgctgatagacgccgcggcggaagcgggagcggatgccgtgaaatttcaaatgttccaagctgataggatgtaccagaaagatcctggtttgtacaagacggcagcgggcaaggacgtctctattttttctttggttcaatctatggaaatgcctgctgagtggattttaccgctattggattactgccgcgaaaagcaggtgatctttttaagtacggtatgtgacgaggggtcagctgatctgcttcagtctacctcgccgagcgcttttaaaatcgcatcctatgaaattaaccatctcccgctgcttaaatatgtcgcccggctgaacaggccgatgattttctcgacagccggagctgaaatctctgatgttcacgaagcttggcgcaccatcagggcagagggaaacaatcaaattgccataatgcattgtgtggcgaaatacccagcaccgccggagtacagcaacctcagcgtcattccgatgcttgccgccgcttttcctgaggcggtaatcggcttctccgatcatagcgagcatccgacagaagcgccgtgtgccgcggttcggctcggagcaaaactgatagaaaagcattttacgatcgataaaaatctgccgggtgctgaccactcgtttgcattaaatccggatgaattgaaagaaatggtcgatggcatcaggaaaacggaagctgagctgaaacaggggatcacaaagccggtctctgaaaaactgcttggcagttcatacaaaacaacgaccgccatcgaaggagaaatcagaaactttgcatacagaggcatttttacaacagctccgattcaaaaaggtgaagcctttagtgaagacaatatcgcagtgcttcggcccggacaaaagccgcaggggctgcacccgagattttttgaactgctgaccagcggtgttcgggctgtaagagacattccagccgacacaggcattgtctgggatgacattttactgaaggacagcccgtttcatgaatgatattctctttatcattcaagcaagaatgggttcaacaaggcttccgggaaaagtgcttcggccgctcggatcgaatcgtttacttgatattctcgttcaccgtgtccggcaaagcgcgttttaccaaaaggatcgggataatcttgtcatcgccacgtctgacaaagaaactgacgacatattagaggcgcactgtatcaaacaaggctttcgtgttttccgcgggagcgaagaacgtgtcctcgataggtttgtgaaggtcatagaagctgttaaaccgtcagtcatcatccggttaacaggtgataatccgtttgtcgatcctgagctgctcgatgtaatgattcaggcgcattttgatcaaggctcggattatacgtatatcctgaatgccccattagggatttgcggcgaagtggtcaacgccaacctgttaattgacatcagccgtattcaggctttggaggatcaatatcaggagcatgtcacgttatatataaggaatcatccagctctttatcgtgttcagtttttagaggcgccggaacgatttcgcgcccctcaatatcggctgaccattgatacaaaggaagactatgaatcgataaaggccctctatcaaaaagcaggcgagcgccccgatgtatccgcctcagagcttatcacccttctgaaccggaaccccgatgcggcaaccgaacgagaggctgactagccatgcatgttgggatcttcgcagacggcggctatgaaaagggaatgggccatgttgtccggatgaagaggcttgcggaggggctcaaacagcgatgcttgattacgttttatacgaatcaggattctgaagcgtttcttcatgaagagcattggcaggtcatcgtaaagccggagctgcagcagcacgaatttattctccgggaaataaaaagcaagaagcttgatttgcttttgtttgatattctaggcgcgcctgcagagctgttaaagaaaataaagacggagacagatgcgaaaattgttctttttgaagagaaaaacggtaaatcgattcaatatagtgacgcagtcattaacggaatttacggtgacatcagaagcagggtgtacgttcagggaaacacacgcatctatgaaggtccggactatcttattcttcaccccgcctttcaggccgcaagagaggattacacacttaagaaagactgccgcaatatccttgttgcattaggaggaagtgatccgaagcagcttatttttaaagtgctggctgccgctgatcaagtccccgacataaaagacaaaaacatgatgtttgtgatggggagcgcttcaccgcatcaagaggcagtccgaaggcggatcgaaaagaagccgcagtacaagatgatcgaacagacaaatgatatggcaggtttgatgaaacaagcggacgcagccattgtcgctggcggcatctctctatatgaagccatttgcatcggcgtgccgtgccttgttctttctcaggttgagcatcaaacggctacagccaaaacatttgctgaccaaggcgccgctcttgatcttggattgggtgagcttgtaccggatgaaacactcatctatcagatgtcacgcattatgagcagctatcctcttcgcctttctttgcacaagggaggaaggccgctcgtggatggcaaaggcattatacgggtaacagctattcttcaagatttatatgaacaagagatataaaaatgcatgtaaggaagtgttaatgtgaaaggtgttattttagccggaggaaacggctcacgccttatgcccttaacgaaagccgtcaacaagcatttgcttcctgtaggcccgtatccgatgatatactggtcgattatgaagctgcaggaagccggaataaaagacattttactcatcagccaaaaggagcatatgccgcaattttacaaactgcttgggaacggggaagagcttggcgttactatcacttatcaagtacagccggcagcatcgggcatttcggatgggctgtcttatgcaaagcgctttacgaaaaaagagtctttcattttattattaggtgataatatatttgaagattcattaaagccttatacagaacgctttgaacagcaggggaaaggagcaaaagtgcttctgaaagaagttgatgacccggaacgtttcgggattgctgagattgatgagaaaaacaagcggattcgttccatcatcgaaaagcccgaacagccaccgaccaacctttgtgttaccggcatttatatgtatgatgcagaggtgttttcatatattgaacaaatatcaccatcaaagcgcggcgagctggaaatcaccgatgtgaataatctatacatcgaaaacagccagcttacgtatgatgtgttatcaggctggtgggtagatgccggaactcacgaatcgctttatctcgcttcccagcttgtacaccaggctttacggaaaggacaggacgaaaagtgatggcaaaatcatatttaattacaggcggggccggcttcatcgggctcacgtttacaaagctcatgctgagggaaacggatgcgcgcattaccgttttagataaactgacgtacgccagccacccggaggaaatggaaaaattaaagcaaaacagccgttttcgctttgtaaaaggggacatcagcgttcaggaggatatcgaccgcgcttttgacgagacctacgatggcgtcattcacttcgcagcagaatcgcatgtggacagaagcatttcccaagcggagccgtttatcaccacaaatgtcatggggacataccgattggcggaagcggtcttgaaaggaaaagccaagaagctgattcatatttcaacagatgaggtatacggggatttaaaagcggatgatcccgcgtttacagaaacgacgccgctttctcctaataacccatactcagccagcaaagcaagctctgatttgctcgtgttgtcttatgtgaaaacccacaagcttccggccatcattacacgatgcagcaacaattacggaccttatcagcacagcgaaaaaatgattccgacgattatccgtcatgcgaagcagggcctgcctgttccgctgtatggcgatggactccagatccgagactggctgtttgcggaggatcattgccgcgcgatcaagctgattttagaaaaagggaccgacggcgaggtgtataacatcggcggcggaaatgaacgcacgaataaagagctggcgagtgtcattttgaagcatctgggctgtgaggaattgttcgcccacgtggaagaccgaaaagggcatgaccggcgctatgcgatcaatgcatcaaagctgaaaaacgaactgggctggcggcaggaagtgacgtttgaagaaggcattgcgcgtacgattcagtggtatacagacaatgaccgatgagaaggtgatctgattgacaaaggtattggtgactggggcgggaggacagcttggcttggaactatgccgccagctgaagcaagccggatatgaggtcattgcgttaacaaagaagatgatgaacattgctgaccagcgctcagtacggcattcgtttggccattatcagccggatatcgtggtcaatagcgccgcgtttacgtcggttgatcaatgcgagaaagagcttgataaagcgtacttgattaacggaatcggcgcttattatacagcgcttgagtcaacccgcatcggagctcaatatgttcatatcagcacggactatgtattcaatgggaaaggaacccagccatatagggaagacgatcccctcgatccgaaaaccatttatggcaaaagcaaaaggctcggagaagaactgatacgattaacgacaaaagacagcacgatcatcaggacatcgtgggtgtacggacatggcggcagtaatttcgttgaaaccatgctgaaacttgctgaaacgaaacaagagcttcgggttgtcagcgatcaaattggttcgccgacttatacgaaggatttagcagaagcggtcatcaagctgttcagccatccgccgggcatctatcatgtcagcaattcaggcatatgcagctggtatgagtttgcgacggcaattatggaagaaagcgggctggaaacagccattttgtctgtaacgacagaggaatacgggaacaaaacgccccgtccggcatactctgtgctgagccatcgggctattgaagaagccggcatccgcccccgccactggcgggaagcgttacgagagtatttgcaggaaaggagcagtgcgtgtgattgatggagtcaaggtgaaaaaattgatgaagcatagcgatgacagaggcttttttgctgagctggtccgggacgatgagaatctccttgagcattttgggcaggcctcttggtcgaaaagctatccgggtgtgattaaggcatttcattatcatgagaagcaggatgatctctggttcttcccaaccggccacgctcaggttgtcctatacgatcttcgagaggattcaaagacaaaaggagaaacggacgtctattatatgggcgaagacaacccgatgctgttattaatcccaaaaggggtggctcacggatatagagtgctgggagagacgccgctgacaattatctattttaccaccatgtcgtataacccggatcagcctgatgaaaaaagaattccgtgggatgatgagacgatcggttttaactggaacactgaattcagataaaaataggaacgtgatcaatcgaagagcagaggcatcttcgactttttttgcccttttttaaaataggataaaagatataaaatgtcaggcagatgttactagaaaaagagagggaaatcgtccatttgaaccttgtataaacaggaaggaattctcattgaattccaagtgttaatattccttaaaaaacatttacttccatggaaaatgatgatagattaatttttaagaaaaagaactggtaattcgcgaattatgaaaaagcgctttttctgcagaggacgctctggccaaatttcaacaatcaattagggggaaatgtcatgctaaaaagaacttcattcgtatcttcattattcatcagttcagctgttttactatcaatcttacttccttcgggccaagctcatgcacagtctgcatcaatcgaggcaaaaacagttaacagcacgaaagagtggaccatttctgatattgaagtgacatataaaccaaatgcggtgctttctcttggagcggtagaatttcaatttcctgacgggtttcatgctacgacaagagattcagtgaatggaagaacactgaaagaaacacagattttaaacgatggaaaaacagtcagactcccgcttacgcttgatttgttaggcgcatccgaatttgaccttgtcatggtgcgtaaaactcttcctcgcgcaggcacttacacgattaaaggcgatgtagtaaacggtttgggaatcggcagtttttatgctgaaacgcagctggtgattgatccccgttaatcgatagatttgtagtcagagactgagatgttttcagtctctttttttgtggattcaaaagctggtacggatcttgcatgatgataagggtgaatccaatgaagaaaggaattggcgggctgattttttaaagcgcttacattacagccggccaaaaaaacaatgaggtgaaaaagatgtcagcaaagcaagtctcgaaagatgaagaaaaagaagctcttaacttatttctgtctacccaaacaatcattaaggaagcccttcggaagctgggttatccgggagatatgtatgaactcatgaaagagccgcagagaatgctcactgtccgcattccggtcaaaatggacaatgggagcgtcaaagtgttcacaggctaccggtcacagcacaatgatgctgtcggtccgacaaaggggggcgttcgcttccatccagaagttaatgaagaggaagtaaaggcattatccatttggatgacgctcaaatgcgggattgccaatcttccttacggcggcgggaagggcggtattatttgtgatccgcggacaatgtcatttggagaactggaaaggctgagcagggggtatgtccgtgccatcagccagatcgtcggtccgacaaaggatattccagctcccgatgtgtacaccaattcgcagattatggcgtggatgatggatgagtacagccggctgcgggaattcgattctccgggctttattacaggtaaaccgcttgttttgggaggatcgcaaggacgggaaacagcgacggcacagggcgtcacgatttgtattgaagaggcggtgaagaaaaaagggatcaagctgcaaaacgcgcgcatcatcatacagggctttggaaacgcgggtagcttcctggccaaattcatgcacgatgcgggcgcgaaggtgatcgggatttctgatgccaatggcgggctctacaacccagacggccttgatatcccttatttgctcgataaacgggacagctttggtatggtcaccaatttatttactgacgtcatcacaaatgaggagctgcttgaaaaggattgcgatattttagtgcctgccgcgatctccaatcaaatcacagccaaaaacgcacataacattcaggcgtcaatcgtcgttgaagcggcgaacggcccgacaaccattgatgccactaagatcctgaatgaaagaggcgtgctgcttgtgccggatatcctagcgagtgccggcggcgtcacggtttcttattttgaatgggtgcaaaacaaccaaggatattattggtcggaagaagaggttgcagaaaaactgagaagcgtcatggtcagctcgttcgaaacaatttatcaaacagcggcaacacataaagtggatatgcgtttggcggcttacatgacgggcatcagaaaatcggcagaagcatcgcgtttccgcggatgggtctaatttgagaagcctccgcaaaataattttgcatttgttttttgcgtaaagagcaaaaaaacgcaaaataaatttgcgttcaagatcggaaaaagagaaaggtgatcacctgttagacaaatttctgttcgattcaacaagttttttcagcaaaagacaagaaaatggcatgattcttgcatttttattcatatgcgaagatatatttcataacacgagggggactacatatgacagtcacatacgcgcacgaaccatttaccgattttacggaagcaaagaataaaactgcatttggggagtcattggcctttgtaaacactcagctcggcaagcattatccgcttgtcataaatggagaaaaaattgaaacggaccgcaaaatcatttctattaacccggcaaataaagaagagatcattgggtacgcgtctacagcggatcaagagcttgctgaaaaagcgatgcaagccgcattgcaggcatttgattcctggaaaaaacaaagaccggagcaccgcgcaaatattctctttaaggcagcggctattttgcgcagaagaaagcatgaattttcaagctatcttgtgaaggaagcaggaaaaccgtggaaggaagcagatgcggacacggctgaagcgatagactttttagagttctacgcgcgccaaatgttaaagctcaaggaaggggctccggtgaagagccgtgctggcgaggtcaatcaatatcattacgaagcgcttggcgtcggcatcgtcatttctccatttaacttcccgctcgcgattatggcgggaacagcggtggcagcgattgtgacaggaaatacgattctcttaaaaccggctgacgcagccccggtagtggcagcaaaatttgtcgaggtcatggaggaagcgggtctgccaaacggcgttctgaattacattccgggagatggtgcggagatcggtgatttcttagttgagcatccgaagacacggtttgtctcatttacaggttcccgtgcagtcggctgccggatttatgagcgagctgccaaagtgcagccgggccaaaaatggctcaaacgggtaattgcagaaatgggcggaaaagacacagtgcttgtcgacaaggacgctgatcttgaccttgctgcatcctctatcgtgtattcagcatttggatattcaggacagaagtgttctgcgggctcccgcgcggtcattcatcaggatgtgtatgatgaagtggtggaaaaagctgtggcgctgaccaaaacgctgactgtcggcaatccagaagatcctgatacgtatatgggtcccgtgattcatgaagcatcctacaacaaagtgatgaaatacattgaaatcggcaaatctgaaggcaagctattggccggcggagaaggcgatgattcaaaaggctactttattcagccgacgatctttgcagatgttgatgaaaacgcccgcttgatgcaggaagaaattttcggcccggttgttgcgatttgcaaagcgcgtgatttcgatcatatgctggagattgccaataacacggaatacggattaacaggtgcgcttctgacgaaaaaccgtgcgcacattgaacgggcgcgcgaggatttccatgtcggaaacctatattttaacagaggatgtaccggagcaattgtcggctatcagccgttcggcggttttaatatgtcaggaacagactcaaaagcaggcggtcccgattacttaattcttcatatgcaagccaaaacaacgtccgaagctttttgatttgagagaaataaaatcgtgcgattctttagcggatcgcacgatttcaactttttgatcaggaggacaatttatgcagtatacaaaaatcagtcacatgaatccggctgaaagagtggaggcgctgacagcatctctggtcagcctcagcagcgtgaacggcaccgttggagaagggacaaaagcagatttcatcaaagaagtgatcacgagctatccttattttcaggaaaaccccagtcatgtgtgggaacaggccattcccaatgacccatacaaacgcaaaaatatttttgcgtttattaaaggacatggagaaagccgaaatacagtcatttaccatgcccatctggatacagttggaattgaagatttcggccctttaaaggatatcgcttttgattgtgagaaattggccgagtatttcagccgctatgagttcgatcaggatgttcagcgggatgccaaatcaggcgagtggatgttcggaagaggatctgtcgatatgcaaagcggcatcgccgtgcatttagccaatctcctgcatttttcggagaaccttgagacgttgccgggaaatgtattgtttatggccaatcccgatgaggagagccagcattcgggcattctcgccagcatttcagagctgaaccggctaaaaaaagaaaaacagcttcactatttggctgctattaatacggattttattaccccgctttacgatggtgatcagacaagatatatctataccggagccgcgggaaaactgttgccttgcttttacatttacgggcgtgaagtccatgttggcgatacactggcagggattgacccaaatttcatttcatctgaaatcacaagccgtctccacaataacatccatctggcagaaaaggttgaaggggagttggttctgcccccatcctgtttgtatcagcgtgataacaaggaatcctataatgtgcaaacggctgtcagcaccagcttgtatttcaattgttttatttatgaaagaacagcaaaagaaatgatggatttgcttattgaagtcactgaggaagcatgccgggagacagaacaaaaattatcagattattacgaagaatatgtaaaaagagccaacctgccaaagaaacatttatcatggggcattcaagtgtatagcctggagcaatacttagaaaagctgagaaaccggggaatagatcccgagcagtgtatcgagcagacattcaaagccaacgagcaccttgaacttcgcatgagatgctttcaggcaatcgaagagcttcaaaagcttgaccccgatcaaggcgcaaaagtcattctattttacgcacctccttacctgccgcataactatttgaaagaagatagcgcaagagatcagcttttgcagcatgtgattaaagaagcggctgacaaaaccgctgaatcgacaggcgaaacatttgtcttcaaaaagtttttcccctacttggcagacggcagttttttatcactgcacgaaaccgatggcgaaattgattcttttatcaggaacttccctgggtggaatatgattgggaccattccgttcaaagacatacgcaagctgaatattccatccattaatatgggcgtgtacggaaaagacggccataaatggacagaacgagtctataaaccgtacacatttcatgtattgcctctcctcatacagcaaaccaccgttcatcttttgcaaagctaccggatgaccatcacggcaaaagaaccaaagggggaaggatgatgcagaatcataaaaatgaattgcagcgcagcatgaaaagcaggcatttgtttatgattgctttgggaggggtgattggcactgggctgtttctaggctctggctttaccattagccaggcgggaccgctcggcgccattgccgcgtatatcatcggcggatttttaatgtatctcgtcatgctttgtttaggagaattggctgttgccatgccggtggccggatcgtttcaggcctacgccactaaatttctgggacagtcgacaggctttatgattggctggctgtattggttcagctgggccaatacagtagggttagagctgacgtcagcaggcattttgatgcaaaggtggctgccctccgttccgatctggatatggtgcctcgtgttcggcatcgtcatctttttgattaatgcgctctctgtcagaagctttgcggaaatggaattttggttttcaagcatcaaagtggcggcgatcatattatttattgtgattggcggagccgctgtgtttggcttgattgactttaaaggcggacaggagacaccctttttgtctaactttatgactgatagagggcttttccctaatggggtgctggccgttatgtttacgctggtcatggtaaacttctcgttccagggaacggagcttgtcggcattgcggcaggggaaagtgaaagcccggaaaaaacactgccaaagtccattcgaaatgttatttggcgcacgctgtttttctttgtgctcgctatgttcgtcttggttgccatccttccgtacaaaacggcgggggtgattgaaagcccgtttgtagcagtactcgatcaaatcggcatcccattttcggcagatatcatgaactttgtcatcttaacggccattttatctgttgctaattcgggattgtatgcggcgtcgcgtatgatgtggtcactttcatcaaatcaaatgggtccctcctttctcaccagactgacaaaaaaaggcgtgccgatgaatgccctgctgattacgctaggcatttcaggctgttcgctgctgacaagtgtcatggctgcagaaacagtgtatttatggtgtatctcaatctcgggcatggtgacagttgtcgcgtggatgtccatttgtgcgtcgcaatttttctttcgcaggcgtttcctggcagaaggcggaaatgtgaatgatctggagttcagaacgccgctttatccgctagtcccgattctcggattttgtttatatggctgcgtgttgatcagccttattttcattccggatcaaagaattggcttatactgcggtgtgccgatcattattttctgttatgcatactatcatctaagcatcaaaaagcgtataaatcatgaaacgattgaaaaaaagcagacagaggcgcaatagaaaaagctctccgggaggccggagagctttttttacgtgttacatcctcatgtatttttagaatgaaatatagaaatatataatgggatttaaatgaaaataataaaacttataaatatttcgttcgaattgtaaatagagaaaaaacaatgctaaactataatacaactttatgataagaagattatggaagaggtgtttgagaaagaatgaacagcaatcaaaacaatgacatcaaaacaaaacatcattttccgttattgttggcactggctttaacgatgggggtatttgcagccggatctgaagagcttgtgatctcaccgctgctgccggatttagcaaaagccttcagctcagatgtcagcgtccttgcgttatctatcagtatttacggcgttatgatttttatcggtgcgccgcttttggttccattaggcgataaatactccagagaactgagcttattggccgggcttatgatttttatcataggaacggtgatatgcgctttagctcaaaatatttttttcttctttttaggccgggcgctttcgggattggctgcgggagcgtttgttccgaccgcttacgcagttgtcggtgatcgtgttccttatacataccggggcaaggtgatgggactgatcgtttcaagctggtcgctggcgctgattttcggagtgccgctcggatcatttatcggcggcgtcctgcattggagatggacgttttggattttcgccctgatgggtgttttagttgttctgctgattctccttgaaatgcgccgccatgcccaacataaaaacagcggcaaggaagaaatagaagagcccgcaggaacattccgggatgcgctgaaagtccctcgtgtacctgtttatatcacaataaccttttgtaatatgattggtttttacggtatgtattcctttttaggcacctatcttcaggacgtttttaccggaggaaacacggctgcgggcttatttatcatgatttatggaatcgggttttccatgagtgtgattacaggaaagatagccgaccgcatcggaaaaatgcgctcccttttgattgcgctgggggtcatcagcgttctgctggcgtgtttaccatatgcgccggcgtctatgtttctgttaatcgccagcctatttatttggggattaatgcaaagtttgacggtgacgctgctcagcaccattttgagtgactgctcagagcgtcatcgaggaaaagtcatggtgttttacagtctcgcctcgaatctggccgtgacattaggttctgctttaatgggacccgtatatgtggcatacggctatgcagctgtcggattgatttgcgccgccatcacagtcctcggatttgtgctcagtgtattcgcatataaaaagtacggcaaacttgagcagaaggccgatcagtccttatctcaataaacaaagtttctaaattcctataattaaaaaccctttttaaagggttttttgtttgtatgggaataattatcaatattttcaaaaaacattgacagttcaatttccactggataaaatttacttaaaattttaaaagattggttggtgctcatgattatattggataatagcattcagacaaaaaaagaactgattcactatccaaactcattacagtcaacacgctcggccctgaggggacaagcagtgagtacgcagcaaagcatttcatttccaattttactcttctacaagggctgaacagtaaattgtccttgcatgatacttttgaatcgtgcatcgaaaggacgctccaaagcccgctggaatataccatcgtcccacatgcttacgatggcattaagcatttctacatgaggccggatttgcagctattgcagatcttcaggtgcgatacaccgatgtacggcctggctgttcgtcctgattttgaattcagagacgatatgcttgatacatctgttattgtttcacatccttcacctattaatttaataaaatattttacccgcaaagatgttcgtttcaaactagtcaattcaaccagtcaagccgcaagaaaagtaaaagaaggtttgtatgacattgccttaaccaatgagcttgcacggcaaaagtacgggctaacctttgtaaaaacattcaaaagcattccaatgagctggtcattatttggaaaaggagacgttgatgatgaaaactaaagaagatatgcaggagctttatttcccgacaccgaaattaattgaatgggaaaacggagtgaggcagtattcaaccgtacgaggggatactgaagtattaatgtcttacgtcccgccgcataccaatgttgaaccccatcagcataaggaggtccaaatcggcatggtcgtttctggcgagctgatgatgactgtcggagatgtgacaagaaaaatgacagccttggaatctgcctatatcgcgccgccgcatgtgcctcacggggcaagaaacgacacagaccaagaagtgattgctattgatatcaagcggctgaaagctgatgaaacatatacaagtcctgaggactactttttggatattttcaaaacaagagacctgctgccgggcatggaagtcacgttctttgttgaggattgggtagaaattatgcttgccaaaatccctggaaatggcggagaaatgcctttccataaacatcggaatgaacaaataggcatctgcatcggcggcggctatgacatgacggtcgaaggctgcacagtcgagatgaaattcggcacagcctatttctgtgagcctcgcgaagatcatggtgccatcaaccgttcagaaaaagaatcaaaatcgattaatatcttcttcccgccgcgctataacagggcaaaagcaaaaaaaatgaaggcggatgaatgatcatgaacctcaccgataaaaccgtcctcatcacaggaggcgcatcaggcattggttatgctgcggttcaggcttttttgggccagcaggccaatgtggttgtggcggatattgatgaagcgcaaggagaagcaatggtacgaaaagaaaataatgacaggctgcactttgtgcaaacggacatcacagacgaagctgcctgccagcacgcagttgaatcggcggttcatacatttggcgggctcgatgtcttgattaataatgcaggcatcgaaatcgtggcgcctattcacgagatggagctcagcgattggaacaaggtgctgcaagtcaatttgaccggcatgtttttaatgagcaaacatgcactcaagcatatgctggccgccggcaagggcaacatcattaatacgtgctctgtcggcggactcgtggcatggcctgatattcctgcttataacgccagcaaaggcggggttttgcagctgactaaatcaatggccgttgattatgcgaaacatcaaattcgggtgaactgcgtatgcccggggatcatcgacacaccgctgaatgaaaaatcattccttgaaaataatgaaggcacacttgaagagattaaaaaagaaaaagcgaaggtaaatccgctgctgaggcttgggaaacctgaagaaatcgcaaatgtgatgctgtttttagcctcggatttatcaagctatatgaccggaagcgccatcaccgcagacggaggatacaccgcacaatagagaaggagtgttttacatatggagagaaaaacagtattggtcatcgctgatcttggaggctgcccgccgcacatgttttataaaagcgctgctgaaaaatataacctggtcagctttattccaagaccttttgcaattacagcctcccatgcagcattgattgaaaaatactcggtcgcggtcataaaagataaagactattttaagagtttagctgattttgaacaccctgattccatttattgggcgcatgaagatcataacaagcctgaggaagaggtcgtcgagcaaatcgtcaaggttgccgaaatgtttggggcggatgccatcacaacaaacaatgaattattcattgctccgatggcgaaagcctgtgaacgtctgggcttgagaggtgccggcgtgcaggcagccgaaaatgccagagataaaaataaaatgagggacgcttttaataaggccggagtcaaatcgatcaaaaacaaacgagtcacaactcttgaagatttccgtgctgctcttgaagagatcggcacacctcttatcttaaagcctacatacttagcgagttctatcggtgtaacgctgattacggacactgagacggcagaagatgaatttaacagagtcaatgactatctgaaatcaattaacgtgccaaaggcggttacgtttgaagcgccgtttatcgctgaagaatttttacagggtgagtacggagactggtatcaaacagaagggtactccgactatatcagtatagaaggcatcatggctgacggtgagtatttcccgatcgccattcatgataaaacgccgcaaatcgggtttacagagacatcccacattacgccgtccattctggatgaagaggcaaaaaagaaaattgtcgaagctgccaaaaaggcaaatgaagggcttggactgcaaaattgcgcaacacatacagagatcaagctaatgaaaaacagagaaccgggtttaatagagtcggcagccagatttgccggctggaatatgatccccaatattaaaaaggtctttggccttgatatggcgcaattattattagatgtcctctgtttcggaaaagacgccgatctgccggacggattattggatcaagagccttattatgttgccgactgccatttgtacccgcagcatttcaaacaaaatggccaaattcctgaaactgctgaggatttggtcattgaagcgatcgatattccggacgggcttttaaaaggggatactgaaatcgtttctttttcggccgcagcaccaggcacttcagttgatttgacattgtttgaagctttcaattccattgctgcatttgaactgaaaggcagtaattcacaggatgtggctgaatcaatcagacaaattcagcagcatgcgaagctgacggcaaagtatgtgctgccagtatgaaacagctgaaacccaactctaaatacttgctttacgggcaggcgctatcgttcatgggagactattgtgttctccctgccctgctcattttgtctacatattatcacgattattgggtgacgtccggggtcatcgtggtcagaagcattccgatggtgtttcagccgtttttgggtgttctggtcgaccggttagacagaattaagatcatgctgtggacggatatcatcagaggcatcatctttttggggctcacatttcttccaaaaggcgagtatccgctgatttttctggccctgctgtttattacttatggaagcggcgtgttttttaatcccgcccgtctcgctgtcatgtcgtccttggaatcagatattaaaagcatcaacacgttatttgcaaaagcgacaaccatctccattatcgtcggggcggctgccggagggctctttctgttaggcggatctgtagagctggctgttgcctttaacggtgtgacatacttggtttcggcattttttatcagccgcatcaagctgcaatttgtgccgattcaatctgaaaacattaaagaggcctttcagtcttttaaggaaggactcaaggaaatcaaaaccaattcattcgtattaaacgccatgtttacgatgattacaatggctttgctgtggggagttgtgtacagctattttccgattgtcagccgctttctgggtgacggggaaatcggcaactttattctcacgttctgcatcggcttcggcggctttatcggagcggcgcttgtcagcaaatggggctttaacaacaatagaggcctgacgtactttaccgttttatccattgtctcgctggcgctgtttttattcacaccgatattcgctgtttctgtcatcgcggcgatcctctttttcatcgcgatggaatacggggaagtgcttgcaaaagtgaaggttcaggaaaatgcggcaaaccagattcaagggcgcattttttcagtggccgaagcgtctatcggattatgcatttctattggttcaatgttcattaacatcctaagcgctccggtcattatggggctgattgtcgtgatcgtatgcggtttgtttttgcatacgaagctcgtcaacaaatcgtttttggaacgggataacaaaacggagcaaaaaggagtcttttagatggaaataacaccgtccgatgtcatcaagacacttccaaggcaggagttttctctcgtttttcaaaaggtaaaggaaatggaaaaaacgggagcccatatcattaatctcggacaggggaaccctgaccttcccactccgccgcatattgtcgaggctttgcgggaggcttctctgaatccttcgtttcatggatacggccctttcaggggctatccttttttaaaggaagcgatcgccgctttctataaaagggaatacggagtgacaatcaatcctgaaacggaagtcgcgcttttcggaggcgggaaagccggattgtatgtgctgacacaatgcctgctcaatccgggagacatcgctttagtcccgaatccaggctatcctgaatatttatcagggattacgatggcgcgagctgagctttacgaaatgccgctgtatgaagaaaatggctatctgccggattttgaaaagattgatccagccgtgctggaaaaagcgaagcttatgtttttaaactatccgaacaaccccactggagctgtggctgatgcggctttttatgcaaaagctgctgcttttgcgaaagagcataacatccatttgattcatgattttgcatacggggcgtttgaattcgatcaaaaaccggccagctttcttgaggcagaggatgccaaaactgtcggagcagagctttattcattttcaaaaacatttaacatggccggctggagaatggcgtttgcggttgggaacgaaaaaatcattcaggccgtcaatgaatttcaggatcatgtatttgtcggcatgttcggcgggctgcagcaggcagcgagtgcggcgctttctggagatccggagcatacggaatcgttgaaacgaatttataaggaacgaattgacttttttacggcgctttgtgaaaaggaactgggctggaagatggaaaagccaaaaggaaccttttacgtatgggctgaaattccgaatacgtttgagacatctcaccaattttccgattacttgctggagcatgcccatgtcgtagtcacaccgggcgaaattttttggaagcaacggaaaaaggcatgtcagaatctcaatggtgtcgaagcaggaggatctgcgggaatttgtcacgcggattcaaaagctgaacctgccgttcgggtcattacaagaaacatcccgctaaaaagcgggatgtttttatatgcttttcatgctgccgccgtcagcggaaatttgctgtcccgtgatgtaggaggcttcctcagaggcaagaaatgcggcgagcgctgcggtttcttcggctgatccgacccgtttcatcggaatcccggaagcaatctgttcttctgctttctgtttggatatgctgttctttttcatcacattttccacaaattgatgataacggtctgtagcgataaaaccaggattcagacagttgacagtaatgttgtgaggagcaagctggatggaaatatttttactggcgttaattaaagcggcattcatcatactgtttgtgaacatgttggcgccgggttctttccacagatttccgacaatgttgatgattctgccaaactcgttttgtttcatcagtgaggaagcacgcttgattgcgtcaatataggcaacggtcttttgagtgaacgtggccgtcatatcctctatattgcagttatcaaatgtgtcaggcgcgccgcccgggatattattaatcagaacatcaagccgtccgcattgagattcgattttctgaaaaatgcccgctctcgtatgctggtcagacatatcgcccgcaaggacaatgacgctcgcctcaggatgcttggccaaaatgtcttctttgacagattcaatattatccaaatttcgcgaattaatgacgagggaaaagtgctggtctgctaatttcagagcgattgctttcccgatcccttgactggctcccataacaaatgcggttcgttttgacaaataactgcacccctttgaaaaaaatggattattatctacatcgtaagaaaaaacgaagaaaatagcaaattttatttaaattctgataaaggagaattgaaaaactcccgccggatagggcgggaggggatattatacatataagaattgaggaagtgtatcaagcgaaaggtgattgccgacaaagaatgaaccaaattcgccatagcgagcgctgacttcgtcaaaacgcatttcgtacactagcttcttgaattgaaggacatcatcgctaaataatgtaacgccccactcgtaatcgtcaaagccgacagagccggtgatgatctgtttgactttgcccgcatagctgcggccgattaaaccgtggcttctcatcaagtttctgcgttcttccattgaaagcatataccagttgtcgttgccagatcttcttttatccattggatagaagcatacatatttagattccggcagttcagggtaaaggcgagcgcgcacatgcggattttcataaggatcgccgtcaccgcttgccaagtagttgctcagctctaccactgatacgtaggagtatgccggaatggtgaactcagcaagtcttgatttgttgaattcaagctcaatttgatttaattcttccattgtaggacgaaggatcatcagcataaaatcagctttttggccgacgatgctgtaaagagtttgcgatccttttccttctttttgggctacgccccatttttcaagcaacccggtgaattcatgtatgatagattggcgctcatcactggacagaagcttccaggaagcccaatccattgtgcggaaatcatgaagcgcataccagccgtcaagcgtttttgccgcttcattcgtcatttgctgttcactcatttatcttcactcccattatcttttcatgattgccttcactataccatagtttatccgattctactgtggagaaaccttgaacatcccttccgtataactccatcaaaatagaagaacctataagggaagattgagtcacttaaattagttagaaaaataagatttttttatgaaagcgctataatgaaagttggctgtttgaatttgattggaagaagagtatgctagtaaaagaaagcgtttttgtaactttttgaggaggttttattgtggcagatttattttcaacagtgcaagaaaaagtagctggaaaagacgttaaaattgtatttcctgaaggcttagacgagcgtattttagaagcggtcagcaagcttgcaggaaacaaagtgctgaatccgattgtgatcggcaatgaaaatgagatccaagcaaaagcaaaagaattgaaccttacgctgggcggcgttaagatttatgatcctcatacatatgaaggcatggaagaccttgtacaagcattcgtagaacgccgcaaaggcaaagcgactgaagaacaggctcgtaaagcattattagacgagaactacttcggtacaatgctggtgtataaaggacttgcagacggacttgtaagcggagctgctcactcaactgctgacactgtccgcccggctcttcaaatcatcaaaacaaaagaaggcgtgaaaaagacttcaggcgtgttcatcatggctcgcggagaagagcaatacgtattcgcagattgcgcgatcaacattgcacctgacagccaagatcttgccgagattgcgatcgaaagtgccaatacggcaaaaatgttcgacattgagcctcgcgtggcaatgctcagcttctctacaaaaggctcagcaaaatctgatgaaacagaaaaagtagcggatgcagtgaaaatcgcgaaagaaaaagcgcctgaactgacacttgacggcgaattccaatttgatgctgcatttgttccatctgtagctgagaaaaaagcgccggattccgagatcaaaggggacgctaacgtattcgtattcccaagtcttgaagcaggaaacatcggctataaaatcgctcagcgtttgggcaactttgaagcggtaggaccaatcctgcaaggtttaaatatgcctgtaaacgacctttcaagaggatgtaacgctgaagatgtttacaatctcgcattaattacagcggcgcaagcactgtaataaaattgaagacaatggcagctctcgaccgagggctgccttttttgcgcttctgtatagcccttctttaccaagacggatgatatgagtacaataaagaaaactaatcataaccatatatttcattaatgacaggggtggggtttttgtattacgacgtgctgaaaacgtttatagcggtggtagaagaaaaaaacttcacaaaagcggcggaaaagctgatgatctcccagcccagcgtcagtctgcatatcaaaaatcttgagaaagaatttcaaacggctcttctgaacaggtcgccaaaacactttacgacaacgccgacaggagacattttatatcaaagagcaaagcaaatggtgtttctctacgaacaagccaaggctgaaatctatgcgcatcatcactatgtgaagggtgaattgaaaatagctgcaagctttacaatcggtgagtatattcttccgccgctattggcccagctgcaaaagctgtatccagagctgaatctagatgtcatgattggcaatacagaggaggtcagcgagcgtgtgcggatgcttcaggctgatatcgggctgattgaaggacatacaaacgagaatgagctggaaattgaaccgttcatggaggatgaaatgtgcattgccgctccaaatcagcatccgctcgccgggcggaaagagatttcgatcagcgatttgcagaacgaagcgtgggtgacaagagagaaaggctccgggacgagagaatatctcgatcatgtactcagttcaaatggacttcggccgaaatcaatgtttaccatcagcagcaatcaaggtgtaaaggaagcggtgattaacggcatgggactttcggttctatccagaagcgtgctgcgtaaggatttgatccaccgcgaaatttcaattctgcatattaataatttctcgttaaagcgcaagctgtcttacattcattctcctctcatggagaatacaaaaaataaagaaatttttattacgatgctgaaaagcaattatcaatcacagctgctgaaatgatataatagttttcgttcaataagcctaacatgaaagggttttacatagatggcaaaccaaccgattgatttactgatgcagccgaaatggagagtcattgaccaatccagtctcggccctttatttgatgcgaagcaatccttcgcaatggatgatacgctatgcatgtccgtcggaaaaggcgtgtcgccggcgacagcgcgctcatgggtgcaccacgatacaattgtccttggaatacaggatacacgcctcccgtttttgcaggatggtatctccttgctggagagcgaaggataccgtgtgatcgtacgcaattccggcggtcttgccgtcgtattggatgacggtgttttaaatatctctctcatattcgaggacgaaaagaaaggcatcgatatagacaaaggatatgaagcgatggtcgagctgatgagacgaatgctgagaccgtacaacgcaaagatcgaagcctatgaaattgaagggtcttattgtcccggcagctatgacctcagtataaatggcaaaaagttcgccggcatctctcagagacgcgttcgcggcggagtcgctgttcaaatttatctctgtgcagataaaagcggcagtgaaagggccgacttgatcagacgattctatcaagcggcgctgaaagacaaacaaaacgataaaaaaggcgtctatccggaaatacgtccggaaacgatggcgtccttaagtgagcttcttcaaaaagacatctccgtacaagacttaatgttcgctttattgacggaattaaaagcgttaagcacccatctttattcagctggactgtccattgatgaggaaatggaatttgagaaaaacctcgtccggatggctgagcggaatgcaaaggtatttgggtgaacgttcttcgcatgccggctgtatatgccggcatgcattttttatctcaagcggcattttacctcaataatcttattttcagataagtccttcttacatacagataaccacgacaaaaagaaaaacgataaaatgacatcagcatccatattaaaggggagaggcagatgaaggggaatatttacagcctttttgtattgattgcggcttttttctgggggaccacgggaaccgttcaggcattggctccagaaagcgccacaccgctggcatttggagcgttcaggttattaataggaggaagcgccatgctgcttgcggtttggatcagccgggagcttcacgtgaaaaattgggcatggccgctcgtatttttagccgctgtttgtatggcgtgttaccagccgctgtttttcacagcggttaaagaaacgggaattgcagtgggaactgtgattgccatcggcagtgcgcctatcattgccgggaccctcgaatgggctgtattgaagaaacgcccgcgaaactcctggtggattgcgactgtgctggctttagcgggttgctggcttctgttttccgacagttccaatgttcggattgatgtggctggtgttcttatggcgcttggagcgggtgcttcttttgcaggctatacgctcatcagtaaagcgatgatgaaaacccagcctccgcgagcgacctccgccgttgtattcatgatcagcgccatcttgctgacgccgctattatggcagttagatatctcgtggatattgacccctagaggactgggaacaagcctttacatcgggttaattgcaacatgtgccgcatactttttgtttgcgaaagggcttaccggggttccggcctcggcggcggtcacgctgtctttagctgaaccgctgacggcttcattgcttggcgtgtttttcataggggaaatgctttcgccttcctcgtggctgggcattgcgcttatgatgctggggcttttggtcatttctgctgcgcctcggaaacaaaaaacggccgaggcagctcacatgtcttaatagattcacataagcttggcctcattttacaagaatagctgatccggctgcaaaatgaggaaattctcttttctcaatagaaaaggggattttgcacatggcgaaaatcccaaaacagctgcccgttttgggatttttctatgtcattccgctaatttttctaaattgccgttccggtccattttgaaggacggagaggcatgttcatcttcttcaaataaaactagctttctggctctgttcataattttcaccaaggtttcataatcttcttggatcgttttttggtctttttcaagcttttgaacttctgcctctagctgctctgttttgttttgcaattcctgattttctttctttaaacgctcgttttccatttttaatgctgatgattgctcgtgattgccttcgtaattctgcaggaagcggatcacatcattcatcgtcatctcaggcgcagctgcaggcgtttgaggagacaataagtgtgatagactagctaactcttccttaaagctttcatcaacaaaaggcatgtgttcgccagacattaaaggttgctcattttcgacagatggtgtttccgttttaaccggctcttctgcagcggtttcttgaatgatttcaggatcaacggcaggaggctgatataataatctttttttcgcgggctgcccgtttccgagcgctctcatccgctgttttcgttgtttcttcgcaagctgaagcgctttttcatattgatggcggaccactgcgttccatctgaatccgcaggctgcggatgtccggtttaatttatcgccgacttcttcaaaggcgttcagctgagtgctgccctccctcacatgccgaagcactgtttcggctaaaagcagatcgttttcctctgaccaagcgtcttgtcgctgttttgtcatttatctcaactcccatttttcttttcatggtattagaatgtccaggttggaaaatatttatacaaattggctgaaagaataggagatacgaaggatggagcggcttgcaggaacagtcgaatccttgtaaaatgaagtgtgatgtgattttttttgaaacgtgattttaggttattcacatagatgaacatagaaatgaagggaagcgtacgtcatggctaatgaatttcgagtgtgtgatgattgccaagccactaatatcaaaacattgctgccgcgtttgaaagaagtggacccggacgcaaaggttgaggtaggatgccaatcttattgcgggcccggacggaaaaaatcatttgcttttgtgaacaatcgcccgctgtcagctccgacagaggatgagctgattgacaaagtaaaaaagaaaataaaaagtaaaaacatattttttcttagcctcggccctcaggtcaggcttttttgcttcacaagatgtgtttttcatgaagatggaacaaatcgccgggcaaattcaaggatgttttcaaagaatagagtcgatataatagaaacacggctaaaaaaaagagggaatgacgatggcgtatccaaatggaaaattatcagaagaaaaagtgtttaaagatccggtgcaccgctatgttcatgttcgggacaagctgatatgggatttgatcggaacccgtgaatttcagcgtctccgcagaattaagcagctcggaacgacctatttgacgttccatggggctgagcacagccggttcaaccattctctcggtgtctatgaaattgtcagaagaatggttgatgacgtctttaaaggccgccctgaatgggatgacagtgagcgcgaactctgtttggccgcggcgctgcttcatgacctcgggcacgggccgttctcgcattcatttgaaaaggtctttcaccttgaccacgaggattttacaagaggtatcattttgggagacacggaggttaatcaggtgctcagaaaggtgagcccgggtttccctcaggatgttgctgaagtcattgccaaaacatataaaaacaagcaagtggtcagcctgatttcgagtcagattgacgcagaccgcatggattacctccagcgcgacgcatattatacgggcgtcagctacggccattttgatatggagcggattcttcgggtgatgcggccgcgcgaggatcagatcgtcattaaagaaagcggaatgcacgctgtcgaagactatatcatgagccgttaccaaatgtactggcaggtctacttccatcctgtgactagaagtgcagaggtcattttaacgaagattcttcacagggcgaagcagctgcacgatgaaggctatgtcttcactcacgctccggttcatttctattctatttttgaaggaaaattgacactggaggattatgtaaagctggatgaatctattattttgtattacttccaggcctgggaggatgaagaagacgcgattttatccgacttgtgccgcagattcattaaccgccagcttttccaatacgttgaattcaatccgaatgaagaaatgtcggcttattttgagctgacttcattgttcaaagaggcggggatcgatccgagctattatttggtcgttgattcttcatcagatctgccatacgatttttaccgaccaggagaggaagaggagcgtctgccgatccatctcttgacgcaaaacggccaaattaaagagctgtccagacagtcggctattgtggaatccatctcaggtaaacggcggacggaccacaagctgtactatccaaaggacttgatttgtgacggcactaaacatccggaagcgaaaatgaaaatccggcagctgctgggactgacatagaaattggaaagaaggaaaaaggagatgtcgggaatttgttgaaagaacatgcaaaactgatgaaggtgttctcggattctggagaaatcatcgggcgaaagaagctgcagaaaatgatttatatcgccaagaaaatgcagtttcctttctatgagaaatatgattttcacttttacggaccatattcagaggaactgacgctccagattgaagagctgtgcaaccttggatttctgcatgaggtgaaggaaaaaaagggcggctactttcaataccggtattcgctgactgagacaggctccgcatttttagaccatgctgatctggacatgccggatatgaaaggctatatcgacagtgtaaacagccgttcatcacggtttttagagctggtttccacgatcctttactttgacgggcttgaggatgaggaaaagaaagaaaaagtctttaccatcaaaagcaagcaaaaatatacaaatgaagaatatgacgaagcgcttcaatacatagaggaactgaagcagatttgttaaccataccaagcaaaagaaatgatccgtttcttttgctttttttattgacaaaagctgctaagagattcattatggataatagttatccataatgaatcaggagtgaataggatgaaaatgaaatcaggaatggagcaggcggtttctgtgctgctgttactgtcacggctgccggtacaggcttctttgacgtcagaggctataagccagcgattgcgcgtgtctccgtcttacttgaagaagctgatgagaacattggttcaagccggtttggcagaatccttaccagggacgaagggcggttttaccctgacgaagcctttggctgacattacgctttatgatgtttatcaagcggtcgaaggcagaggttcgatgtatcaggggaaaggcttgctgcaatctgtatttgagggtgaaagtcactgtgtgctggagacagtcatggcggaaatcgaggataaatggtccaatcttatgagagaagaatccttgcagcatgttatggacagagtcggggaattgtatgatcttgaaaaaatagatgattgggtaatcaagcaagtgaaagggcaattgtaatgaaaaatagcgggtctatacaagaatcaacatcatcaacaggcatatccgtgctgatcgtgctcgcacttggtttcctcatggcaactcttgatgtgaccgttgtgaatgtggcgatggctgatatgaaaaacactctttcaatgtcactttcaggtgtaacgtgggttgtggacgggtacattcttacttttgcgtcgcttctgctggcgggcggagccttggctgaccgtttcggctcgaagacgatctatatcttgggtctagccgtttttgttatggcctcctgtctatgcgctgcatctataaatgggcagatgctgattgccggacgtctcatacagggaattggggcagctttgtttatgccaagctcactcagccttttggctgcctcttaccttgatgagcgggcgcgggcgagaatgtttggactgtgggccgcgcttgtttccgccgcttcagcccttgggccttttatcgggggcgtgctggtacagttggcgggctggcagagtatttttctgatcaatgtgccaataggggctgctgcgctcatttcagcttaccgaatcctcagccgcgttcctgggaaaagcagccgcgtgaacatcatcgggcatctgcttggcatgatggctctcgggtttctttcctatgctttgatacaggggccttcagcgggctggcgctcgccagtgattcttgtagcatttactgcagcggttttggcatttgtgctgtttttgctgcgggaaatttctgcaaaaacacccatcctgccggcgtccttatacaaaaacggccgcttctcagctgcccaatttatcgggtttttgctgaatttcgccctttttggcggcatgtttatgctcagcctttttttgcaggaagcaggaggggcaagttcctttatggctggagtggagctgctgccgatgatggcggtcttcgtgatcggcaatctgctgtttgcccgtctggcgaatcggtttgaagccggtcagcttatgtttgtatcaatggcggtcagctgtatcattgcattgctgttgtttgtgctgatttctccggattttccttattggcagctggcggtgttgatgtctgttatgaacctctgtaccggtattacagttcctgccatgacaactgtgatcatgcaggctgccgggcaaagacatacgaatatcgccggtgcggcgttaaatgcaaaccggcaaatcggagccttggtcggcgtagcgataaccggggtgatcattcatctgtccgccacttggtatgctggtgccgggtttgcgtttttgatgatgggagcggcatacagcctcgctgcattgcttgtatggctgtttctggctgcccataacgggactgccgcgtcagaaaaaatgtaaatcactgattgcgctttgtgggaatatatagtaagatataaaaaattattgaaacaacaggcactgataaggacacgagatgctttttacggtttccagagagggaaggacagctgagatcttcctaacgcagggaaagcagcttaccgcctttgagccgtatcagggaaaacaagtatctgataccgtcatgctgcgttacagcatctttaagccgatcatcatgtgtaattgatcgggaatttgggtggaaccacggatgatcaacacattcgtcccttttagagggatgggtgtgtttttttatttgaattgaatacatgcgaagaaaaggacatgaatgatagttacggttttcagagagggaaggaaaggtgagagcttcccagcttaggaatatcatttaccgccttggagcagcattggggaactgaagtaaccaatgccgtctatgctgcgttacagcaccgagccgacaacatagtatttgtcgggaacttgggtggaaccacgggttaatcacacactcgtccctatctgcgggacgggtgtgtttttttatatacaacaatgaataaggagtgttctaaaatgagcaaacatgtacacattcagcttccggacggacagatccaggaatatccgaaaggcatcacaatcaaagaagcggctggttcgatcagttccagtctgcaaaagaaggcggccgcaggtcaggtcaacggcaagcttgttgatctcagtttcaagctggaggaggatgctgagctttcgattgtcacactcgattcacaagaaggcttgcaggtgcttcgccacacaacagcgcacgtgctggcccaagcagtaaaacggctgtacggcgaagtgtcattgggggtagggcctgtgattttagacggcttctactatgacatgaagctggggaaaagcttggcatcaggagacttagaggccatcgaaaaagaaatgaaaaacataataaatgagaaccttgaaatcaaacgtatagaggtttcttacgaagaagctgaagagctgtttgcacaaaaagacgagcggctcaagcttgagattttaaaggatattccgcgcggggaggatatcacactgtaccagcaaggggaattcgttgacctgtgccgagggccgcatcttccttctacagggatgatcaaggcgttcaaactgacaagagtatcaggcgcttattggcgcggagacagcaaaaatgaagtcctgcagcgggtgtacggggttgcgtttcaaaagaaaaaagatttggatgcgcacctgcatatgctagaagaagcggcaaaacgagaccatcgcaagctcggcaaacagttagggctgtttatgttttctgaagaagcgccggggatgccgttttatttgccgaaagggcagattgtccgcaatgagctggagcgcttctcgcgtgagctgcaaacaaatgccggctacgatgaggtgcgtacgccgtttatgatgaatcagcggttatgggagcagtcaggccattgggaccattatcgcgacaatatgtacttttcagaagtggatgatacaagattcgcaatgaagccgatgaattgccccggccacatgctcatctttaaaaacagcctgtattcttatcgggatctgccgattcgcatggcggaattcggacaggtgcaccgccatgaatacagcggcgctttaaacggaatgcttcgcgttcggacgttctgtcaggatgacgcccatattttcgttcgggaggatcagattgagagtgagatcaaagaagcgattcggctgattgatgaggtatatcggacatttggtttcgagtattctgttgagctttcgactcgcccggaggattcattaggcgatgacagcctttgggaagcgtcggaacgtgccttagcacgcgtccttgaggagcttggcctctcttatgagatcaatgaaggcgatggggcgttttacgggccgaaaattgatttccatataaaagatgccctgaaacggagccaccaatgcgcgacaattcagcttgattttcaaatgccggaaaaatttgatttaacatatatcaacgaactcaatgagaaggttcgtcccgttgtcatccacagagcggttttcggctcaatcgaccgtttcttcggcattttgatcgagcattacggtggggcttttccagtctggctcgcaccgatccaggttcaaatcataccggtttcgcacgttcacttagactattgcagaaaagtgcaggcggagctgaagcaggcggggataagagccggcattgatgagcgcaatgagaagctcggctataaaatcagagaatcgcaggtgcaaaaaattccgtacgtgctggtgcttggagatcatgaggagcaggagaatgcggtaaacgtccgccgattcggacatcagcagaatgaacacgttcctttccaaacttttaaagataaacttgtgaaacaggtggaaaatcgaggcatgtaggataaaagctgtgaattcacattttgcttttttgactttccctattcggaatcagtaaaataataagtaaatcatatcgttcgtatgttatgaatgcatctcgaaatggggaaattgacatggaccatgacaaactggaagcaaatttgctggatcacgcacttacaaagtatttgaaaagcacgaagcaattagatgaagccaccgttccgaaacacgtgaataatgtaagagggtttattctgcggatcatatacagacatgggagctgcaccataaaggatattttgaaggaggtcacactgtctccctctgccacgaccacagctctgaatcatttagagcaggaagggtttattgagagatccagaaataacaatgaccgccgcactgtatggattactctttctgaatcgggccggggagcggctgaacaaatgatcgaaaaccgccagcagctgattgatggcatgtttgaacgtttaacagccgaagagaaaaagacgttcttggcgattattgcgaagctggctcaatagggataataaaagccggtgcgcgaagcgccggctttatagagattattccatatcgctcaggcgtttgcctgcgacggcataatggtcttttctcatttcttctataaagacaacaattttttcttcagaagcaccggttgtttcctttacggcttctgttactttctcgacaagattgcgtttttgctcgtctgtacggccttcgagcattttgacagttacgtatggcatgggtgctgaatcctcctttatctcgtttcctctctttagaaaaagaggcttcttatagtatactgaataaagtaaattcttgcattttgagaaagagggatatctcacttggaccgttttttatattatccgttatctttaatgccatacctcgtcatcacgctaattgtgtcgtttacgatgcacgagcttgcccacgcttatgtcgcatacaaattcggtgacgatacggcgaaaaaacaaggaagactgacgctgaatcccattaaacaccttgatccgttcggaaccattttgattctggtggccggattcgggtgggcgcgccccattcccgtgaatcgccgtttctttaagaaaccccggcttgctggtgtgctcgtatctatagccgggcccgtcagtaacctgattcttgcgtttattggtttctttttgttagtgttgatgcatgcgtacggaatggaaatgcttgcggcgttcagcacggggctggatcagtttttttctatttggatacagctgaatcttgtcttgtttttatttaatctgctgccgcttcctccgctcgatggctatcgaattatagaagatctcgttccgccgggcgtgcgtgccaaaatgacgcaggcggagagctacggctttatcgtatttttggtgctgtttgtgacaccgctaggatcttacgtgctgtggccgatgctcaatgcaggaagagattcgatttttaaagctgttttcagcgatatttcaaccgcttttgtaggaggtagaacttcatggaagaaaaaagaaaaaatcaatcgggtttaatattatcaaaagtgatccgacagacggacacggcggttttggcgtaggggcactcagccttgataacatttctcccgtattcgttgatgtagaggaaaaagaagcgttcgtagacatcggcgctatgcatgcccgcagcaccgttgaaaaaggaattaaatttctcccgaataaagaagaagtgccgaacggaaaaccatactggcttgtgtgggtaacgattgacagaaaagaagaggggccttattacgctggtgtgacagcctgtgaaatgacggtcgacagaagcatcagaagaggctacaagtcactgcctgagcatgtgaatctgatggataaatccatgaaacggaaaatcatcgttgataaaatggacgacagctcgaagcgtgtactaggcgaatttctgaaaaagcatgatcagggcctatgggaccgttcctcagatgagttaaaaacgagcctgcttccagaaaacaattaatttatgaattttttgtgaacttttaaagtatttgagatatttttcgtaaacattgagtaaactggtgatacagaaataggacatggaaaatcccgagccgaaacaagactcggggtttttcatttttagggggatatgagtcggcgactgggagatgaaagccagcgccgaagaaatgagaaattcaccactttatcccaaaactgattgttcagctcgattgtctaacattcttccatcgattatgaaggaaccatacgaataacccggcctccgaggagccgggttattttcaatgatgtcgccccagccatttgtcccaccactttttctcggaagcgggcttttctttggatggaagccggtcttttgtttgttttgcgggttctgccccgtagcacacgtttgcgggttctgtccctttcacaaaatatgtgtaatgcttagcggcgcagccgggacctgatgagtagcctgtttccggatcaatgtacacaccggttacgccttttggcggcttgaacgcggtttccggttcgcctttgagcgcgtcctccatgaagtccgcccaaatggttttagcatagcttttttcttcgaccgagtcgatggtgctgtttttgtcatagccggtccaaacaccggcggccagcttcggattgaagccgatcatccagctgtctgcgctggtggttcctgattttccggcatacgttcttgtcaggcggttggctatcgttcgccccgtaaccgacgtatatccatttaaatcgatatcaaacatgcctgtcatcatactcgctgtgacaaaagcggctttttcatcaagcacctgtttatgctgattcgggttttcgtacagcacgtggccggctgcgtccgttactcttgaaataaaagtcggttcgattttctttccgccatttgcgagcatggcataggcgttgaccatctcaatcggacgtacgggttcggtgccgagtgccagggacggcagtgcttgaagatgggcggtaatgccgaattcctttgccgtctttacaagtttgttcgtgccgagaaaaagatgcgttttcacagcgtaaatattgtcggaaagcgccagcgcctgcagaagcgtaatcggcttgttggcatagtatccgttatagttgcttggagaataggtttctccctttgcatcaatttgaaactcggtttcttcgcttttcatcaaagtgactggcgtaaatccgctctgaatcgctttatagtacagcaacggcttgatcgtcgaagcaggctggcgcttcgcctgtgtcgtccggtcaaacgggcttttttgataatccctgccgccgacaagggcgagaacgtttccggtgcggggatcaatggctgaaaacccgacttgaatgtcagagcccgcgttaaccgtttcggtaatggtctcctcggcgatgcgctgcatccgtttatctaccgttgtatagacgtttaacccgctcgtttcaatttgctcccgtgtcatgccgagctttttttccagctctctcatcgcattgtcgtagaaataaggagcctttctcttggaaacttgtttattcaaaggctgataggaaagaggttccttgatcaattcatccgctttcttttggctgatcatctgctgcttttccatcatccgcacaatcgttttctggcgttccttggccttcgtctcattgacatacggtgaatagccggaagggcctttcgggattcctgccaaaagcgccgcctccgcatccgtcaggtttttggcatgcttgccgaaatacaggcgggaagctgcttcaatgccgtaggcgccgtggccgtagtaaatcgtatttaaatagccttctaatatctcgtccttagaatagttttgttccagacggatcgtgtagaacgcctcattccatttccgtttccacgttttgtcgtgttcaaggtataagtttctcgcatattgctgggtgatggtgcttgcaccctgaaccttggcaaatgctttcaggtcagcaagcgccgcgccggccatgcgtttataatcaaagccgtgatgatcgtagaaattctggtcttcaatcgccactgtcgcttttacgatcgtcggattcatgtcctttaaggggacccaatagcgcttttcgccgtagttcgtttccccgagctttgagccgtcactcgcgtacaaaatcgtggattgcggcacttgcaccgagggagcgccctggtatttggctatcaaaatgacagtcataaacacagcagctgccgccaaggccgcaaaagcccctaaaaagataaaggcgcgaacggttttcagcgtcagtctcagccgtttatttgtcattgcatccacaacgggttccccctttttttatgtttctactattatgagaaaaaaagatcgtttttaaacatcgcagaacaggacgcatctttactttttccccgccatcctctatactttttccttaggtgaaaatgagatttcaaccgagaataaaagctgataagacgcttacaataaatgaatacagcctcgaaagggagatgacaattgagcgaactttggtacacagagaagcagacgaaaaactttggcattacgatgaaggttaacaagacgttacatacagaacaaacggagtttcagcatttagaaatggtggaaacagaagagttcggcaacatgctttttttggacggcatggtgatgacatctgaaaaagacgaattcgtttatcacgaaatggtggcgcatgtcccattattcacgcacccaaatccggagcacgttctcgtagtcggcggcggtgacggcggcgttatcagagaaatcctgaagcacccaagcgtgaaaaaagcgacacttgtagatattgacggcaaggttatcgaatactctaaaaagttccttccttctatcgcaggcaaactggatgatccgcgcgttgacgtgcaggtagatgacggatttatgcacattgcaaaatctgaaaatcaatatgacgtcatcatggtagattcgactgaaccagtcggaccggctgtaaacctgtttacaaaaggattctacgcaggaatcgcaaaagcgctgaaagaagacggtattttcgttgcgcagacggacaacccatggtttacaccggaattaatcacaaatgtacagcgcgacgtgaaggaaatcttcccgattacgaagctgtatacggcgaacattccgacatatccgagcggtttgtggacatttacaattggctcgaaaaaatatgatccgcttgcagtggaagacagccgtttcttcgatattgagacgaaatattacacaaaagatattcataaagcggcgtttgttctgccgaaatttgtgagtgacctgattaaataatgaaggtatggcgcaggagcgaatcttgcgcttttttacaggaaagcgagggtattatagatgagatttgatgaagcttattcaggaaaagtatttatcgcgagccgtcccgagtgggaagaggcggacgccattctttacggcatgccgatggactggacagtcagctatcgcccgggctcacgctttggtccaagcagaatccgtgaggtgtcaatcggccttgaggaatacagcccatatttagaccgcgatctggctgacttgaacttctttgacgccggcgacattccgctgccgttcggaaatccgcagcgaagcctggatatgattgaagagtacgtggacagcattttagaaaaagggaagttcccaatgggtatgggcggggagcacctcgtgtcatggcctgtcattaaagcgatgtacaagaaatacccagaccttgcgatcatccattttgacgcacatacagatcttcgtgttgattatgagggagaaccgctttctcactccacgccgatccgtaaggcggcagaattgatcggaccgcacaatgtgtattcattcggaatccgttccggcatgaaagaagagtttgaatgggcgaaggaaaacggcatgcacatctcaaaatttgaagtgcttgaaccgctgaaagaggtgcttccgaagctggcgggccgtccggtttatgtcacaattgacattgacgtattagaccctgcacacgcaccgggtacaggaacggttgacgccggcggcatcacgtctaaagaactgcttgcatccgtccatgaaatcgcgcgttcagaggtaaacgtaaagggcgctgatttagtggaagtcgcaccggtgtatgaccactcagagcaaacggcaaacacagccagcaaaatcatccgtgaaatgctgcttgggtttgtgaaataagtaaacatccagacgatgtctggatgtttttttattcccagtctttacaaacatcaatccacacttttgagaaagaaaattcggataattctttcggtgttaattcaatagcggagtttctgctgccgcatgcggggaaaacagtctgaaaccgtttcagcgatacatcaagataaacctcaggatcatgagccaatccaaatgggcaaactcctccaatttcatggcctgtctgctccagcacctcattaggagagagcattcttgctttaaagccaaatgtttgcctggactttttgttgtcgatcttggcatcgccggctgccacaatcagaatcacctgatctccttcccctctgaaggacagggacttggcgattctagacaggcttacgccgattgtctcagctgcctgttcaactgtcgcactcgacgtttcgaactccgtcacatcattttctcgattccattgagtaaagtgggttctcacactttttagagacatgctgcatttccactctcttcaagattattgaaaagatcatagcatggattgggagactttggtaaagaggggacgaaaaaaccgccgatggacggcggttaaatcattcctcgttgtgcaacttcaatttggtgtgtaggtgcatttgcaatagttgttgccacgaacacagtgcttagagccagacaagagagtaatagtttagacttcaatttcatacaaactcactcctccttgaataagttgccttacttgttccaccttcaaaaaataagcagaagctttttgaaaatttttacgttcatgataatattttgccacatcaatagcgaaatcttcaagatcagcatacaacattttactttcgagaaaatcaaaaaatccttgaattgcttcttcatccgggcctgataagtataaagatttcaaaaattcaaactctgataaatatattacatctccggccttttgtgaataagccattcccttactatgatattcatgagctttatctatttttcctaatttataatggatctgtgtaattaaaaaatacgcttgaggtaaggaaggaagaatatttgattcttcaaaaacagctattgctcttttgaaataaggtatggcatcctcatattggctttggctgtttttacaaagcccgatattgtacaaagttctccccattaattggggctgcttttcagcttctgccatagaataagctttttgaaaatgtgagatggcatcctcatactgttttaaatctaaaaaattggtggcaaataaagaatgacactgcagcaatcttatattataagcttcatgttctttgtatatttcatatgcttgccgtgcatagtccattgaaaaatacgtttgtttcatatagtaataagattcagacatcttaaagaaaaactcagctttctctatccgatccttaacgaatatcagcttgctttcggcctttttgaaaaatttaatagccgacagatattcccgctggtccagctcgtacatgcctctgaagaagttaaaatagtactcaagcagaccagttaaacgagcctgttttttatcaatctcaagcagcagatcagacagtctcggctgttcctcaatcctcattttttctaacggttcaaggtactcaagcattaggttgtgccgaaactccatcagtgaatagtacaaatgaaggtcttgatcttcttccatttgatccagctcttgcttgatttctcgtcgcaaatattctgcatcgggtatgctgaatcggcgtatgtacatataccattcgttaatcttttctccgatggaagaagaagatatgacacctgtcacgtttgcaaatccctcccttcataattctatatatgtcatattttatcatcaacattcttgtgagaagcgcaaaaaaaccgcaattttttctttcgttacaccgcatgtttggagatatattttcaaaaagaagcgtttaccctcagcaatttgtacaagcaaacacgttacccttccatattctgttatatctgcgtgagcagtgtatgtctgaaaaggaagtgaaggaatgagaaaaaacaagctttcctttaaagaaaaagcaggagcagaacaagaagagtgcttatgtttttgtgagggagaagcaagccgagaagccatgtttcaagcaccgattgaattacctgaagggtttgtcgttgatccggctgaagctgttgcaaacgtgacgtggaatgcagacagcctttcttgtgtcagtgaccgttgcttaattcaaacggggcctgagcctgatgaggtcggtgttcaatttgcagtgcgcctgcagggaaccgttacgctactcgtcagtgtctcacctgtccgaaatcaatatggacaaggggacggggctgtttccgtcattcacaatgcagaaatcgatcaagtcgtctattattccgatgaatcggatgattgcccggatatcagtgacatcacgattgagaaccttgttgttgttccgccgttttacggcagtcctttatcggtgacggggacaattgtgcttgtaccggagccggaacccgtctacgcgtttacagcgaatccaaatgatcaatcagtttctgtgattgatacaaacaccgatactgttgtgacaacgattgctcttccgtacaatccggcaggtattgaaattacgccagataaaagcgctgtgtttgtcttacatcccaacaataatgtgatttctgtcatcgattatgacacattaacagtgacagcaactatattgctggatcagccgcctcgattgattagatttatccctaatcatgagtttgcttatgttttcaccggtactgcggtttatgtgattggaattgatacgttaactgtggataggtcgattcctgtggaaggatatgatgttgcaatcgatcccaatgggttattcgcctatgttctgaattttggaatagtgcaaaaagtggacctaactaccggtgaagtcacaggaacaattgaacgagagcttatcgtatcaaccatagaaacaaattggccggagcggtatgcctatgtattagaacaagaattcttttttaattatttgacggttattgatttaaatacgtttaccatcagcagcacccaagagctggagtatgaaggggaatatcgaatgtttacgagtggagcagaggtgtatttatatgacggcttcactggcaatttatattctgtcagtccaaatggagcaggcgttataggaaatgttccgcaatcagcaacagactatgcgtttaccccgaatggcgattttctgtatgcaactcgttttatagagcagagcatcattgtttacaacacagatgattattctgaggaaactgtgatatctcttggggtttcaccgggtgccattacgatttaaccgctgcatgttgtgcatttctaaaaggacgtgaaatcatgaaaaagaatgatctttctgctttacaggaaaattgtttctgtttttgtgatgaggaaattagccgggaagcgccgtttcaagtgccgatagatttccctgagggcttcaaggttgatacggccgaagcgtcagcggctgttacatggagtacagacaatttgtcctgtatcagtgagccttgcttaatccagactgggccggaaccagaagatatcggtgttcgatatgctgtgagagtacaagggaccattacgcttcttgtcagtgtgtcgcctgtacgaaatcaatatggacaaggagacggggctgtttctgtgattcatactgaagagattgatcaagttgtttattatgcagcacagtctggccgctgtcctgatttcagtcaaataacagtggaagatctgctcattgtaccgcctttctacggcagtccgcttacggtggccgggacacttgttttaccgccatcaccagaccctcaatcgtatgtgtttactgccaatactggagacagcacggtttcggttattgatgcagatttaaacactgttgtaaaaacaatccctttttctgacgtgccaactaatctaggcgttactttcgataaagcattcacgtatgtcctccatggaaataccaaccttgtctcagtgattgataataaaacattaaccatcataaataccattactgttggaggagggccgagaaaaatcgaatttgatccaacagatgagttcgcatacgtgatggccgccggatctatatatgtgattaacacggcctctcaatcggtcattgatgtcattccgatacccggcgctttagactttgctcttgatccgaatggacagtatgtctataccgctaatggaagcagttggtcggttgataaatatgatgtaaatactgggcagttggtagaaagtatcatagatacatttgaatttcccagtttaattacaactccttacgctggaaattttgcgtacgtattgaatggtgagctgtggccgaaaggtgtaacggagattagtttgtcaccattaagcaggggaggggacttcagccgtttatttgaaacgctgaggacgattgtattttctctcgatagtactagagcttattttctagagccatatagtgaaccgtttctcattaataacttatacgtagttaatacggccagacagaggatcattgcaaacgtgtctctccccggcgcctttgacctcgccgtaacgccggacaaacagtatatttatgcggcacagcccaacgacaatgctgtgaccgtgtaccgcacaagtgattatacagccgtgacggtgattccggttggcgcgggtccgtctgcgattgcgatgtagctattttatagatcaagagaagcggtgctgtgataagagaatcgtttataaataaatgatccgatttgctgaatggcagccaggataatcagaaacagcagttcacttatagagaaactgagcatccaccaaatcccggctgctgccagtgctcccgcaaacacttttctgaacaggctgccgtgccggaaaagctgccgcaaatacgttcgcatgcaaaacaataaatacaggatcagtagcatcgcaagtcccattgaaaaggcagggggcgtatgaaggcggaaagggacggctttaacgatttcgaacatgcagccgaatatgatgacttggcacaacacggcagccatcacgtatgtttggcggacgtttttatagctgtcacgcagcgatttgacgtcttctgcatatcggctgcacaagttgtgttgctgaaagtcacagcagctttgatgagactgtgtgagtttctgaaaagctgctgtcatgtttttcacggattgggtgacatagtgaagatagagaaaagcaggcagcatcaggagggcagcggtacaagccagcagtccgagccgcacagcatcattgttgatcatctgtacatattgggcggcggcttcggcaacggcctgaacccagccgaaggaataagccgccatacctataagcagcaataaaagggtaaagacagtgctttgtttcattgtctgatcgcctctttctgagaaacgtgaatgatcgctttgttagaagatgccattgcatcaatgagagacaagaaaacctgcgcatccatatcttgaatgatgtggtacatgtcaagaaacgagcaatcgcacctgtcacactcggctgcccactcgaagcatttacgcacataatcgctgtcataaatgatcgcgtctgtcaaagagtccttgccgtattgaagccaggcggcaacctgttctttcttctgtgtgacatagtatgaagccacatcgatataagctgaagaatgggtcccttgactgtgaaggatcaagaaaccgccatcctcatatatataagtctcggctgacaagcgatcgatttccaggcggtacgtttgctgaatctcttgaaaaaacggtgaatctaattgaaatagaatacgagccgcgatatcccaataaagctttatcgacaacagatcgttttgcccgggaagtgcgccgatctgtaatccggtccaggtatcttccatccgctcctcatcacccagcatcattttttgtgagaggactggagggcatgccgggatgatttttctttcagcatgataatccggacgcttttccagctggaggtgaggaggcaaaagcgtttctgtattttctgagcccccaatcaaaaacagcgtcatccgatgggcttggtaggcagccttataggctttttgtaaatcactgatgtccagcgcctcaatatcttcgattctgcctgcggggaaaacggcagctggtgaggagggagaaagcatgctgatcagctgataatgatatgagagctgatggttaaggtgtgctgtttgaatttcgcttgtaatcacagctttttcctgagcgacaatcttcttgtcaaatgagtggttccataaagcatcaagcaggatgggaatcgtttgtctgagccgatccggtaatgaggtaaacatgaaattggtatcggtgtaggtagtgaatgcgtttaaaagcgcgccatgcgcaaaaaaatcactgtacagattgcggccgttatgccagaagagaagatgctctaaaaaatgtgctgtgccatacggaagcagtgtatcaccggattctgcccgtatacatacatcccggcttccaaaatcgatttttacattgcacagccgcaggtgggcgcgggggaatttcaatctgaatatttttagtccgctgtctgtgtatctgatatcggttcgttcatccagctgttgaaaaaaggctttcttttccatctcttcatccccttactacatgagctccgatataattgatggtcgctatgaattgcaatacatcacggcatgtaaccgctgagatgccatccagcaaggcttctttcgtgcaggagaagcggcgcaggacccccatataggccaatagaccttcgggagaatcgaattgcagcagcaattcattgcgtaaaaactgctttgcctgttctagttcccgctcatctgtatgaaaagctgagacagcttccaaaacgcgcgggggaatgtctttctcatgaagctgatctgtacatattgaaacaagcagcaaattgttcatgacatcgtaacgggtgataacgtgatagactgccagatccttctctctgaagtgcttgaataaagcggaatggccgtactttcccagtaatccgtctattagctgtattttgatataatcgctggcatctttcatctctccgcagtcaaatccgagtgtcaagacggaaggacctgcagcgctgcgtgtctctgtttcaaaaacatgccggtttacgggtattcttccggacgttacagcggacgtttgcggggcatgtccccgaacatcacatgcttgtacttgtcccaatatgttcagctgtttttgctgggacactaaatcaacgataaagtccgttgcgtcgagaaaccgtttaggatgaatcgcctttatcctgtctctccggccaaacatgcctgtgccgtacatcgggtttccgaagacctcctcagccaagcgagccgccgagtaggagaagggatcagtgaatttcttttcgattttcagcagcagctcattcctggccttttcaaatgcttcgaatgaaagagaagaagggaaagacaagtctgcaaaagttttcatcagggcgtcaacatgaagattcccgttatataatgggtgaatcaaacgggtcccgcaggttttcagctgctgatcaaaaaagagattcgctgagtacatgaaacggctgccggcagcataaccaaaagcgtcaatgatttgctccttcaggtatgcggcggcgccgtaaaaataaatcgtttcttcctcaggttccgccgcgctttcgatcggtttcagaaagctcgcggcgattgaaatagttgaaaattgatgagtcttcagcaggttaacttccaagccgttctcttttgcttgtatcaaagaaaccaccatcctgtttttgcaggtaatagactatgaccagaccggctatcggaatgaccgccaaggatacagcggtgccggctaatatggctaagaataggggaagacaaaacagataagaccgatattttgagaaaccgctccatagctgctgctccgtctgccagctgaaggagggccttttttcatccgcagttaacctgatatacgctcccgccagcagcaactcaatgcactgcaaaaaagtgagaactgaaatcgaacggccgctgatgaaacccacaatcatcacgacaaggagaaatccgcctgccaataggcctgaataaaagcgatatttcgcccaaaacatcgtttttcgcttgatcggaagcgtgatgagcagcatccggtcatttttttcaatcgaatacaaaagggcgatcggcgagcagatgagcaaaagcgcggaaatcacgatataaatcacttgctgattgaagatgccggtgttcatcatctggaacgaaaagaagccgctgaataccgccattaccgcgtaatttaacagcatcgctttagaagagataaatcggttccattctcttttgtaaaacgaaaattcagatcgccgcataaatgaatgcatcttgccctgctgcggaggcgcctgcagaaagacaggaaagtcaatgaccaccgcccacaggatatgaaccgcgcaaagcggaatcgtggcggccggcatcaaagcggcgctgatacatacacaggcgaatatcgccgcatgcagcagaaacatcaagttcttctttttgacgaagtggttgcttagcacaactccgaaaataatggagtaaacggtaaaaaacgaaaacctgccgagccaaaacaatgtttgcgcccctgacagcgttccgtttccaaataagaacagcggtaaaataaaaaagaataaagttcttctcaaacaggtatcgacaaacaaaacgacactctgggcgagccaaaagctccgtgaagaaatcggcagcaggcagctcagcttcatataagattccttccattgtgatgtcacggaaagaaacaccatatatgtgttcatcaaaagaagcgcgagtatgatatacgttttgcgcaacaccgattcatcaatgccggcctggcggatcagcccgatttcaaacacggccagaatgacaaggcctgcggcaatgcggatggcgtcctttttcccttgccggctgtaaagctgtttgaacagcaaagacatgatagggattatgttattcatggccgatcacctcgaaaaattcccgccgcagatcggtctcctctccaatcggaatgaccttttggatctgtttgttgtgaagaatagccgcataatcacaaaatctttgcacgacatcgagcagatgagaagaaaacaaaatggttccgcctgcttcacagtactcacgcattttctgataaaagacctctatcgattccacatccaaaccgacgagcggctcatccaaaataaacaggggagcgcgcagcaataagcctgtcatcaatacaaccttttgcctgttccccaaggacagctccgaaattctcctattgatgtatttcgaaaaatgaaaggcctcggccaaactggcaaactgctgctctgaaaaatccttttgataaagcgaatggacgaaagacacatagtccttcgccgtaatttctgtaaatagcagcggataatcggcggcgaagtaacggtgagtcttcagctgatctgatgttttctgcggcatgccggcctccgcttcaattccgcacagtgtaaaacgcccgctgaaattgcggttcacgcctgtcagcgtattaatcagtgtcgtttttccggcgccgtttaccccaagtaacccgtaaacggcgcctttttctaaatgtaaatccacttgttctaagatgacgttgtcccgttcataccaaacggatacatcgtgtatatccaaaatgctcatcgcgagtcagccttccgcgcgcgcatcccgaacagaatggcaatggcaatgaaaatcagcgtaaacagataatcgcttttgacaaaatagacgactgcgccgatgacaaagataaatgaaaggatatacagtaaaattcttctttgtgctggtgacaaatcgtttccctcctaaataagctggaccacgtcttctaattgttcatttttcgcccaagagcaaatgtttttccggtgatatttgttagagttcagcccttttaagtaacagcctccgcaatagccgctgaacgggcatttgtctttcatgcaatgttcgctgaaccgcggcgcttgcgcttgccacagtttatggacgagaggggagttaaagatgctttcataggaatcatgaaaaatatttcccaatgaaaattcctttggaaagagggcgcaaggacgtacttcgccgaacggactgatcacaatggacttccagccagcgccgcaatttgccgcgcgttttctctcatagggaataatcggaatcagatctttaaactcatcaatcacatgttgctcgtattccataaacttgcggtgctgctcggcgtctttcgttggatggacaatatccctgcctcttccgaaatcgtcaacccaattgtaagaaaacgccttcgccccgagatcccgaaccttttgggccatatcgtggatttcccacatgtttttttcgaagacagacatagcgactctgacaaatataccgtggtcactcaacaattttatcgttttacaagtttgggcaaaagagccttttctccctctaaaggagtcatggacctcggaattgacactatctagagaaatgccgacgatgattttttgcttgtaagtcttcaaaagctccaggctctcttttcgcatgagtgttccgtttgttaagacagcgacttttttgaactttttacacacatagtcaagaatctcattggcgtttggatggacaaaaatttctccacctgtgatttcgcatgtcaatacaccgttatcaaacagcatatcagccgtttttttgaattgctcaatcgacacggtgccgagcgcttcaggtgagctttccaaataacagtgggcgcatttcaaattacagcggtgcgtcagttcaaaggtggcgtgcaggggcatcggaaattcattgcttccgctcgtggtgattgtatggcggctggcccggtttccaagctgaataacctgcttgttctggagcatgttgagcatgtcgtaataccaatctttatggtcttccggtgattcatcatacactgcacattgctcagctaaaatctgctcagctgttttttggccatccatgcgcatgcagagctcgtaagccgttttgttgagatccaaatactcaaagtcagaaatggagacattatcgcgcaagtagtcgatttctaacacgccgccctcaggaagctggtgaactcttacactttcattaataaatggaaacatctgctctataaacaaaataccatcccctatacatatgattcaaatgaaaaacggttgtgtatgtatatccaagaggtagattttagttaaaaattgtaatttacttaaaaagggcatagtagaatgactatgcccttttgggagatccttacccccatagaccgaatagacctgttgcaccggcaatttcaaaatcagggataggaccgtccactagacaagcggctccgatcgagcatgttgcacaacctttgttttctacaatgacagcttttttcataattgaatcctccctttttttgtttttctagcagatctatgttgtacttttatcttaaaactatcaaattactaattcaatacatatattttgaaaaaaatgtgaaaaggaaatgatagatttcggaaaaatgtaacatttcctaaaggtaattagtgatatgattttctcttctatataaggaaatgctttttatgaggtttatcttcaaatctgatgagcaatgatggtaagatagaagcagttgaagtttacaaaccgaatgattatactattcaagtcaaagtggaatgatgaaaaggacgtgtcagaatgaagcaagagacaccgataacactccatgtgaagtctgtgatcgaggatgacggaaaccaagaagtcatcgaattccgcaccaccggattttactatgtaaaacaaaataaagtgtatctatcttattatgaagaacacgacttaggcaaagtcaaaacgattgtgaaagtaagcgaaggcgaagtcctggtcatgaggtcaggcgctgtcaaaatgaatcagcgtttcgtaacgggagcttccacaattgctaaatataaaatgtcatttggtgagcttgagctgaaaacaagcacaaaatcgattcaatctgatctcgatgaagaaaaaggccgtatcagcatcgcatatgacatgcatgtcggagacgagcaggagcatttacataatatgacgatcacgtatgagggaggaactcacgcatgaacattgcggaacaaatgaaggacgtgctgaaagaagaaatcaaagcggccgttctgaaagcgggactggctgaagaaagccagattcccaatgttgttttagaaacaccgaaagataaaacacacggcgactactcaacgaatatggcgatgcagttggcaagagtggcaaaaaaagcgccgcgtcaaatcgctgaagagattgtcgcccattttgataaagggaaggcttcgattgaaaaactggatatcgccggcccgggttttatcaatttctatatgaacaatcaatatttaacaaagctgattccgtctgtactggaagcaggggaagcatacggggaaacgaacatcggaaacggtgaacgagttcaggtagaattcgtatcagcgaatccgacgggagaccttcacctcgggcatgcgcgcggggcggctgtcggcgattccttgtgcaacgtgctttcaaaagcgggttacgatgtaagccgcgaatactacattaacgatgcgggaaaccaaatcaacaatctggcgctttctgttgaagtccgttactttgaagcactcggattggaaaaaccgatgccggaggatggctaccgcggtgaggatatcattgcgatcggaaagcgtctcgctgaggaatacggtgatcgtttcgttaacgaagaggaaagtgaacgcctcgcgtttttccgtgaatacggcctgaaatacgagctggaaaagcttcgcaaggacttggaaaacttccgtgtgccgtttgatgtgtggtattcagaaacttcactgtaccaaaatggaaaaatcgacaaggcgcttgaagcgctccgcgaaaaaggccacgtctatgaagaagacggcgcgacttggttccgttccacgactttcggcgatgataaagaccgcgtattgatcaagaaggacggcacgtacacgtaccttcttcctgatatcgcgtatcataaggacaagcttgaccgcggctttgataagctgatcaacgtttggggcgccgatcaccacggctacatcccgcgtatgaaagcggcaatcgaagcgctgggctatgaaaaaggaacgcttgaagtagaaatcattcagctcgttcacctttacaaaaacggcgagaaaatgaaaatgagcaaacggaccggtaaagccgtaacgatgcgtgacctgattgaagaagtcggcttggatgccgtgcgttacttctttgcaatgcgaagtgcagacacccatatggattttgacttagatcttgctgtatcaacatctaacgaaaaccctgtgtattatgcacaatacgcgcatgcccgtatttgcagcatgcttcgccaaggggaagagcaggggcttaaaccggcggcagatcttgatttcagccatattcaatcagaaaaagaatacgatctgctgaaaacgatcggcggcttcccagaggcagtggcggaagcagcggaaaaacgaattccgcaccgtgtcactaactatatttatgatctggcttctgctctgcacagcttctacaacgcagagaaagtcatcgaccctgaaaatgaagagaaaagccgcgcgcgcctggctttaatgaaggcaacgcaaattacgctgaacaatgcgcttcagctgatcggcgtatcggctccggaaaaaatgtaatcacgatcaaaaggacaaagtcttcgggctttgtcctttttttatgagaaaaacgtgtgatgtaattcacaatcctgtttggctagtttttgtatgataagactgattattgaatcattgaaaggggcaagccaaatgatcaaccgtcaacacattcaattatcgttacagtcattaagcttggtggcagggtttatggtttgggtgctgatttcatcactcatttcccaaatcacattagatattcatttaagcaagggtgagatttctttagtgaccgcgattcctgtgatcctcgggtcgcttctccgcattcctttagggtatttaacgaacaggtttggcgcgcggctcatgtttatggtcagcttcatcctgcttttatttcctgtattttggatcagtatcgcggattctctgtttgatttaatcgcaggcggctttttcttagggatcgggggagcggtgttttccattggggtgacctccctcccgaaatattatccgaaagaaaagcacggtgtcgtcaatgggatttacggtgcaggaaatatcgggacagccgttacgacatttgcagcgccggttatcgctcaagccgtcgggtggaaatcaaccgtgcaaatgtatctgattttgctggctgtctttgccttactgcacgtattgtttggcgacaggcatgagaagaaggtcaaagtttctgttaagactcaaatcaaagctgtttaccgaaatcatgtgctatggtttctgagcctgttttattttattacgttcggtgcctttgtcgccttcactatctatctgccgaactttctggtggagcattttgggctgaatcctgcagatgccggcttgcggacggctggctttattgcggtttctacgctgctcaggcctgcgggcggattcctggctgataaaatgagcccgctccgcatcttgatgtttgtttttgccgggcttacattatcaggcattatcctatcgttctcgccgacaatcggcctttatacgtttggatcattaaccgtggccgtctgctcaggcataggaaacggaactgtttttaaactggtgcctttctatttttcgaagcaagcggggattgccaatgggattgtgtctgccatgggcggtttaggcggcttttttcctccgctcatattggcgagtgtatttcaggcaacaggccagtacgcgatcgggtttatggcgctttcagaggtggcgttagccagttttgtccttgtcatatggatgtattggcaggaaagaatgaaaacacacacggagagaaacagccagagcatcaactaacactggggcattcacaagattgttagttttttctcgatgggtacaaatcaattcacgttacaataaacacacaacgtgactttcttcgaggtgagctcatgaattttctctctgttcgaccatctgatagtgatcttatatccagcgatctgtatgaattgctggaatcgatcagcacgaaaagaaaaatggaaaaacacacgtatttgtttcgggaaggaatggatgcagaagagctttatctgattcaatcaggactcattgaaatcggcaagctgacatctgacggaaaagacctgacgcttagaatctgccaaaagcatgatatcgtcggagaattaacacttttcactgaagaaccaaggtatatgctcagtgcaaaagtactagaggatggcgaggtgctcgtcattaataaaaataagctggaaaaagaattaatccaaaacggcgctttgacatttgagttcatgaaatggatgagcacgcacctccggaagattcagtccaaaatcagggatctgcttcttcatggcaaaaagggggcgctctattctacccttatccgcttatcaaacagctacggagtggagcgaagcgacggcattctgattaacattgtcctgacaaatcaggatttggcaaagttttgcgcggctgcacgggaaagcgtcaatcgtatgctcggagatctccgcaaaaaaggggttatttcgatagacgaatccggaaaaattattttgcacaagcgggactatttacgatgtgagattgagtgtgaaaattgcccgctggagatttgcaatattgactgaaaaaaacaaggacagcggtgtccttgttttttaccttgtgataaacaggcacatgacggcaagaaagaagcaggcattcacgatttcaagaatgccaatcgtttttacgggccaatcccttccatgaaaaaaccatgcccgcaagctgctcgggataaaagcgagaaacgcccatcctgctccgaaaagagcggataaaaaggggagcagcaggtgatatccccatgaccagtatgcaaatgccctgttttttctctcgcggatcaccgatttcacataaaaggaactcccgataaaaaataaagcagactgcaagaaaataaaccaagcccagccgtcaagggttcccatccccagccagcagctcgcaaacccgcccgaacaaaagaacaagacacctgcaacatcattcaataaggctcgttcgttttttctgcgggcaaaatacatatgtatgagaaacagcggcagtaaagaaacgcccacccagatgagaggcggcttatgaaagaccgagatcatcaaaaagcagcaggcgggaaaaccgtaataacacatccacttttgatatggtttgctttgtttcttttttaaggcaagcgtaacgggataaaccgctaagtataggaaaagccaaccaaggaagagcggaatatgccaaataacggggcctcccttgaccatgccgagtaaaaatgggatcagcagcatcgcccacgccccgtgctgcttcggaatcagcgccttcatcgaaatcctccttttttctttcattataaatgcattcaccctcctgataagtgacattcatcatacaggctgtgaaatacatcactgctgtacaggctcagtcgagctacactaaagctatccttagcacaggaggttttcctatgaatcagtgtgactatttattatttctgaaacaacttcctatgtttaatgaagtgcctctatccattgtcgaaaccttgctgaaaaacggcacgtttatccgcggttcatgtgatcagtctccatcttttcttcattctcaatctgtttatattgtattaaaaggcagtgtccgttttatggacacaaggctccctgaagggtcgaaaaccgttgcgctgtgggaaaaaggcgatgtgtttccgattgatgaaaaaggcgggctttatttatcgccctttatctcagtcaatgccacttcagacattctgattctcaacatcccatattacatatttaagaaaatgatgtcttatcatccgcagctgcaaatgaactttttggctatgcttcagcaaaatgttttttgttcctatcaattatttttgcggtatctgcatacatcacaggatgaaaacgccgagcccggttcttaaatagagccggttttttttgatctttgaatgaaaggcagctaatgacccaagcgtcctgcctgaactcagccttccttctcctttgtgtgaacattttgtgaaaaaagcagagtgtgtgacatagttcacaaggaaacacgctgtctctgtttatagtgaaattagcatcacctgactcggaaggagtgaactctcatgaagaaaaagaaaaggagtccgttgtttaggagattgaattatttctctcctatcgaacaccattcaaataaacatagccaaaccacccgcgaagatcgcgattgggagaatgtatacagaaacagatggcagtacgacaaagtcgttcgctccacccacggcgttaactgtacagggtcttgcagctggaatatttatgtgaaaaacggaattgtcacgtgggaagggcaaaatttgaattatccatcaacaggcccggatatgcctgattttgaaccgagaggctgcccgcggggggccagtttttcatggtatatctacagcccgctgcgtgtgaaatatccatacgtgcgcggtgtactgattaatttatggcgggaggcactgcaagaacatcaaaatccattggaagcctggaaatcgatcgtcgaaaatcctgaaaaagcgaagtcctataaacaggcgagagggaaaggcggctttgtccgcgcggaatggccggaagtgctgaagctgatttcagcctctctgctgtatacagtgatgaaatacgggcctgaccggaatgtcggtttttctccgatcccggcgatgtccatgatcagccacgcgtcaggttcgcgattcatgtctttaatcggcggcccaatgctcagtttttatgactggtatgcggatctcccgccggcgtccccgcaaatttggggcgaccagacggacgttccggaaagcagtgattggtacaattcaggctatatcatcacatggggctccaacgttccgctaacgagaacgcctgatgcgcattttttggcggaggcccgctataaaggcgccaaggtgatttcaatcagtcccgattttgcggagtcctcaaagttcgcggatgactggctcagtatccgccaagggactgacggtgcgcttgcgatggcaatgggtcacgtcattctgcaggaattttacgtgaatcaagagacggaacgtttcatggaatacgcgaagcaatacacggattttccattcctcgtcaccttatcaaaagaaaatggcgtatacacagcgggccggtttctgcatgcgaaggacatcgggcggcagacaaagcatgatcagtggaagcccgcggtctggaatgaacagacaggcgcatttgccataccgcaggggacaatgggttcccgctgggacgggaagcagaaatggaacctgcatatgattgatgaagaaacaggagaagcgattgaaccccgtctttctgtgctcggaatagaggatgaaatcggcacggtgcgcatcccgtatttttcaaatgacggaaacaaagtgctcgagcgggatcttcctattaaaaaaatgaacctgaacagtgaagaaacgtacatcacgaccgtgtttgacttgatactggctaactacggcgtgaaccggggtatcggcgaacgatcggctgtctcctatgatgatcctgagccgtttacgcctgcctggcaggaacaaatgacaggaatcaaaaaagaagctgtcgttaagattgccagagagtttgcccaaaatgcgatcgatacagacggccggtccatgattatcgtaggggccggcattaaccactggttcaactccgacacgatctaccgagcggtgttaaatcttgttttacttgtaggcgcccaaggcgtaaacggcggaggctgggcccattacgtggggcaggaaaagctccgacctgctgaagggtggcagacgattgcaactgcaaaggactgggagggcgtgcctaagctgcaaaacggcacctcatttttctactttgcgacagatcagtggcgttatgaggaccagccgatcagtgatttggcatcaccgattgctgcgtcatcccgctacaagcaccacgctgattacaatgtgctggccgcgcggctggggtggcttccgtcttacccgactttcaatcaaaatggcatcgatctgtataaagaagctgaaaaagcaggggcagcaacacctgaagacgttggtgcgtacgtggcctcacagctccaagagaaaaaactgaaattcgcgattgaagatcctgataatgaagtgaattttccaagaaatctcttcgtatggcgggcaaatctgatctcaagctcaggaaaagggcatgaatattttctcaagcatttgctggggacgacgaacggtttaatgaatgacgatagcgacagcatccgccctgaagaaatcaaatggcgggagcaggcgccggaaggaaagctcgacttgttaatcaatcttgacttccgaatggccggtacggcgctgtattccgatatcgtgctgccggcggcgacatggtatgaaaaacacgatctcagcagcacagatatgcacccgttcattcatccatttgctccggcgatctcggctccgtgggaatcgaagtcagactgggatattttcaaggcgctgtcaaaagccgtttccgatctggcagaagaagtcgatatggagcccgtgaaagaagtggttgcgacaccgctcctccacgacaccatgcaggaattggcccagccattcggcaaaatcaatgactggagcaaaggcgaatgtgaagccattccgggaaaaacgatgccgaacatccaagtcgttgaacgggattacaaacacatttttcataaaatgactgcacttggtccgaacgttgctttaaagccgagcggaacaaaagggatgagctggtcaatagccgatgaatatgaatcactcaaacagagattgggagaaatcacctcggacagtgtcgcaaagggatgtccgaatataagtgaagcaaagcaggcagcagaagcgattttaaccctatcatccacttcgaatggaaaggtcgccgtcaaagcatgggaatcacttgaaaacatcacgaacctgaagctgaaagacctggcggaagaacgcgaggaagaatgctttacgttcgaacaaattacagcccagccgaaaacggtgatcacgtctccggcgttttccggctctgaaaaaggagggcgcaggtattcgccgtttacaacaaatgttgaaaaattaattccgtggcggacgctgacaggcagacaatcctattatgtcgatcatgaactgatgatggaattcggtgaaacgatggcgacattcaaaccgatcctccagcatcgcccgtttctgagcaagcggcctgatcaagagggaaaagaaatcgtcctcaattatttgacgccgcataataaatggtctgtccacagcatgtattttgattctctgccgatgctgacgctgttccgcggcgggccgaccgtgtggatgaataaagatgatgcagaggacacggatatcaaagacaacgattggattgaatgctttaaccgaaacggtgttgtcgtcgcgagagccgttttgtctcatcggattcctaaaggaatggcgtttatgcaccatgcccaggaccgccacatcaacgtgccaggcacaaagctaacgaataaccgcggaggcacccataacagcccgacaaggattcacgtcaagccgacccagatgatcgggggctatgcccagctcagctacggctttaattattacggtccaacggggaatcagcgcgacctgaacgtcgtcatccgcaagctgaaggaggtcgattggcttgaagattaaagcgcaaatcggtatggtcatgaacttggataaatgcatcggctgccacacgtgcagcgtcacctgcaaaaacacgtggacaaaccgttccggtgcggaatatatgtacttcaataatgtagaaacaaagccgggcatcggctacccgaagcaatgggaggaccaggataaatataaaggcggctggacattgaaaaaaggaaagctcgagctgaaatcgggctcgaaaaccaatcggcttgcaggccttttctataatccgaatcagccgtcgattgatgattactatgagccctggaactatgattatgaaacattaacgaacagcccgcagaaaaaacaccagccagtagcacgcccgaaatcgtccttgacgggggatttcatgaatatcgaatggggtccgaactgggaggatgatctcgcgggcggccacataacgggacttgaagatcccaatgtacaaaagatggaggaatcgatcaaaacagaattcgatgaggtttttatgatgtatttgccccgtatttgcgagcactgcatcaacccggcgtgcgtctcctcctgtccatccggcgccatgtacaaacgcgaggaggacggcattgtgcttgtggatcaaaatgcatgccgttcatggagatattgcgtctcatcctgtccttataaaaaagtctattttaactggcaaacgaacaaagcagagtgtgcacactccgctttgttcgtttggaggcgggactgccaaccatctgctctgagacgtgtgttggcagaatccgctacctcggcgtcatgctgtatgacgcggacaaagtggaggaagcggcatctgttgaaaatgaaaaggatctctaccattcacaattggacatttttcttgatccaaatgatcctgaggttgccaagctggcaaaagaacaaggcattccggctgaatggatagaggctgcgcagcaatcgccgatctataaaatgatcattgactggaagattgcgctgccgcttcatccagagtaccgcacgctgccaatggtgtggtacattccaccgctcagtccgattatgaatctctttgaaggaaaaggcagccggcaatccgcagaagatatttttccggctatcgaccaaatgagaatcccgatagattatttggcgcagctgttaacagccggtgatacggatcatattcggtcaacgttaaagaaaatgtctgtcatgcgccagtatatgagagcgatccagacgaataaatcaatcgacccggaactaatctccagtgtcggcttaacagaacagcaaattgaagatatgtatcggctgcttgcgattgccaaatatgatgaccgctttgtgataccgagcagtcatcgagaagaagtttcagatttatatgctgaacaagggagctgcggcttatcattttcaggcggccccggctcctgtttctaacttttgataaatgaggtgtaacaagatgaacaccacagaccggcaaattacgttctccgctctttccactcttctctcttatccggatgaagagtggagagccgagattcccgattggaaggctcttatccatgaaatcagcaaccggcaaatccgggagaagctgctgcactttttcgaggcgtcagccagcttttcaccggaagctctgattgaacactatgtctatacattcgactttgggaaaaaaacaaatatgtatgtcacctactttaactcgggcgagcaaagggaacgcggcgttgaattgctgcatttaaaaaacacatacgagcaatccggtttcctgccgacagagaaagagctgcctgattatctgccgctgatgctggaatttgctgcggctgcagaaattgaagcagcgagaagcgtgtttgagaaatatctgtccaatgtgagggagctggcatcccgtctcgaaaaaaatgacagtatatacgctgaactgctgcacgtgctgctggccgcgcttgaaaacatcggcgtaggtgaaagcgttgaaggggctgttcaggcatgagcgggcagatcctctggggtattatgccatacattgtattgacaatctttatcggcggccatatttaccgctaccagcatgaccaatttggctggacggcgaaatcaagcgagctgttagaaaagaaaaaacttgcggctggcagcacactttttcactggggactgctgtgcgttgtcggcgggcatgtcatggggattctgatcccagaaggcgtgtatgcttcccttggcatttcagagcatatgtatcacaaaatggcgattggcgctggcttgccggcgggcattgcggcatgtaccggacttgtcatcctgacgtacagaaggctgtttgacaaaagaatccgcaaaacgagctcgccatccgatatccttacgctcctcctgctgctgttcatgatgctgtcaggcgttgcggccacgtttctcaacattgattcgaaaggatttgattaccggaccacagtcgggccctggttcagggaaatcgttttgttcaggcctgacgcctctttgatggagagtgtcccgctatggtttaagtttcatattgtgataggatacgtcgtttttatcctgtggccgtttacgagattggttcatgtgttcagtctgccgctcaagtatctgacccgcagctacgttgtatatcggaaacgctcgtgaaaatcccccttgcaagagggggttttttctgccaaggtaatggctgggctgccgggaatcctgttatgtttgtatatggaaataacatcaaggattttactcattttaaaccggcggaacagccagattatgattcagcctgactaactccttatatctttctgatcaatttcccgttttatatattttctctcatcagaatgggtatcaaatttactctatccaccgtatttgcagtcacagcgccgccttcttttcggcgcttgccggagtgctgagcgggttcagcttgccgctcatgttgtcactcggcgttgccaatagtcttgctttatttctgcagaaacgatgcggatgaattccgtgacagttagttttctctaaacctctcctcctttggcggagaggttttttacttacaaggtttatcgattagaaaaaagaggtaatacagaggtaattgaatcagattggagagaatcaggatgctgaaaaggagactggaatttttctttttatatatgatgctcatcggggcatatgtcatttggttttttccggtttccagacttgagttttacggaggattgctttgctatataagcattattttgttcagcatctattcattaattcttgaaaaccgcacctcgcagcacacgctgctatggatccatattcttgtcttttttccaatcgtcggctacgtgttttatctgttttcgggacagctttatgtaaagggaaagctgtttaagacaaaacgaatgtacaacagggaaaagctcaggaagctgtttgacaaggaggaaacgcccgaagtgacagggctgaaggacaatcaagagaggttctttacatattccatcagggctgcccatatgaatatcaatacgaaaagcaacatcaaagtgctgaaaaacggcgaagaaaccttcccggacattttcaaagcaatgagaaaagcggaatcttacatacatattgaatactacatgtttaaatcagacatgctcggacgcggcatgatggatattatgatggagaaagcgcgccagggtgtcgaggtgaggtttttatacgatgcggcaggaagcatgaagctggcaagaagagatattatgagaatgaaacaagcgggggtggacatcgtcccgttttctccgctgaaatacgggtttttcaaccagaagctgaatttcagaaatcaccggaaaatcgtgatcatcgatgggaaaaccggttttgtgggtggattaaatgtcgggaaggaatatatcagcagagatccgtacatcggattttggagagatacacacctgcggcttgagggggaaattgtgcaaacgctccacgctatctttatgctggattgggaatatgtctccaatgaagtgctaattgatcaagaggagtacaataccccggttcccgtggaaggaggaggcatttatcaaattgtcgcgacaggccctgacatgaaggaaagcatgagcgacctttattatgaaatgatttcttcagcgcagaaatcaatatggatcgccacgccctattttgtccccaatgaatccattcgcacggcgctaaaagcagcggcgacaaagggggtagaggtaagggttatggtgccggagaagaacgacagctttttgacccaatacgcgtcgaggtcctatttcccggagctgctccttgagggcattgaagtgtactcctaccaaaaaggcttcatgcatcaaaaagtcatgatcattgatggcgatctcgcctccgtcggtaccgcgaatatggacatgcgcagctttcagctcaactttgaagtgaatgtgttcttcacggatgccgaagcgatccgaacccttgaggcccattttgaagaggatatgcaggaaagtgaaaagctcagccctgtcggcttttataaaagaggtgtggctgaccggacaaaagagtcgtttgcccgcctgttttcaggtgttctgtaagaaaaaagaaatctgatctttcaaaacagcccgtgtatagtataattgagaaatattatcagttatttatacattgggggaagatagggtgctgcggcaatttttttcatattataaaccatataaaacgttgttctttctcgactttttctcagcgatcgcgggaggtttaatggagctgagttttcctttgatcgtcaattattttattgataccttgctgccgggcagggactggggactgatcatcgcgacctcaatcgggttatttgcggtgtacgcgctcagctcggctcttcagtatatcgtgacctactggggacacatgcttggtatcaatattgagactgatatgagaaagtcgctttttgaccatttgcaaaagctctcgttcaaattttacgacaacaacaagacgggaacgctgatgtcgaagctcacgaacgatttaatgtatatcggtgaagtcgcccatcacggaccggaagacttattcattgcggtcatgaccattctcggggcgttcggagtgatgctgtttattaactggcagcttgctttattaacgtttatcattatgccgatcgtcatttggctagcgctttatttcaacaaaaaaatgaccaaagcatttaccacgctgaacaaggatatcggagacttcagcgcgcgtgtagaaaataacatcggcggcatccggcttgtgcaggcgttcggaaatgaagcatttgaaaaagaacgcttcgccgtcaacaaccagcgttttcgtgtcacaaagctttcttcctacaaaatcatggcgaaaaacggttcaatcagctatatgctgacccggtttgtcacgctgtttgtccttttgtgcgggacgtggtttgtcattcgcggctccttatcgtacggggaatttgtggcgtttgtactcttgacgaatgtgctgttcaggcctattgacaaaattaatgccattatcgaaatgtatccgagggggatcgcgggtttcaaaagctatatggagctcatggagacagagccggatattcaggactcacctgattcgaaagatgtttccggcctgaagggcaatatccgctataaacatgtttcgtttggctatgatgaccatcacaatgtcctcaatgacatcaacctatccattcaagcgggggaaacggtggcgttcgtcggtccgtcaggtgctgggaaatcaacgctttgcagtctgcttccgcgtttttatgaagcatcggagggcgacattacgattgacggcatcagtataaaagacatgacgctttcttcgttgcgcgggcagattggcgtcgtgcagcaggacgttttcttattctcgggcacgcttagagaaaatatcgcctacggccgactaggcgcatcagaagaagacatttggcaagctgtgaagcaggcgcatctggaagagctcgtccataacatgcccgatgggttggatactatgattggcgaacgcggcgtgaagctttccggcgggcaaaaacagcgtctgtcaattgcaaggatgttcttgaaaaatccgtcgatcttgattctcgacgaagccacctcagcccttgatacagagacggaagcggcgatccaaaaggcgcttcaagagttgtctgaggggcgcacgacgcttgtcatcgcccacaggctggcaacaatcaaagacgcggacagaattgtagtcgtcacaaacaacggtattgaagaacaaggccgtcatcaagacctgatcgaagccggaggcctatacagcaggctgcatcaagcgcaattcgggcaaatggtgcatcgataggaggagaacatggaaagaaaaactgtgctgtacattgctgtttcattggacgggatgatcgcaaaagaagatggaagcatcgattggctggatgaatttgaaggtgaaggtgacaacggctacagtgatttttatcagactgttgatacagtcattttagggcggagcacatatgagcacgttaaagtgctaacaccggttttcccgtatcaggataaaacctgctatgtttttacaggatcgcccgacagttatcaagatgaacatgtgacgtttatcaatgagggagccagagccttcactgcccgtttgaaacaggaaaaaggctcaaacatctggatagctggcggggcagagcttgtgaatgactttatgaaagaagatgccatcgacgaattcatcatcactgttattcccgtcgttttaggaagcggcatcccgctgtttcacgaactaacaaatgaaacaaaactgcggttaaaagggacaaaacaatttggacaagcggttcagctccattatgtaagagcataagaaaaaggatagacagatgtctatccttttttgtatgtaagttagagcgcttctctctcagcaggctcgatgagattttggaatttttcaatgagctgtgatgcttttgttccttcaactacgatcagatattccttttcattatgagccatgcggaacgtttcaagctcaattaagcttttgattttgcacatcgttttctttgaataaatataaacctcgtggcttccggaatggcacattttataaagatgaatcaaatttcttaaagtaaaggcctgtgcggctactttcagagacttgatatttttcatgatctttctcctccatcgattgttgtcttatatagcctaagttcccaaagctgacaagtcgtaaacctatttttgcacatttatgacttccattgcagcgcaccgcccccgatgcgtttgacaccgcggatggagcttaattcatccatcaagcggagaagcgccttgtctttctgctttgcttcaatcatgaaatcaatattagttccccattgcctaaagcgttccaacagtggcagcaaaaagttggcgtcaacataatcggcgtggctgcgtatcgcttgctccgattttggggaagacaagtgaacctttggctgaaggccgatccgctcccacgttttgatcatgcggggcagtgctacattcaggtcggcgtgatcgtctggattggcgtaaaaatgatgaaagtcaaagacaaacggaacatcctcctgctcacagacctgaagcgtttcttccgttgtatatgttttatcatcattttcaagtgtcatccgctctttgatctcctgcggcagctgttttatattttgatgaaattgtgcagtggcggtgtctttatttccgtaagcgccgccaatatgaatgttgataacggagcgatcagcaatgcccatggcctcaagcatgcggtagtgatacgccatatctgttaccgcattttttgtgacggattccttcgggctcgtaaacagagtgaattgatttggatgaaagcttgttcgcagttgatgggttttaacaagctctccaatctcccgaaactctttttgaaacggtgttacaaaatcccacatcacgtcgggatgcgtagccagcggcacaatcgaactggaaaaacggtacaaaggaatgccgtggccgatgatatagtgaagggttctcatcgtattgcgcaaattggcttttgtcacagtcagaagcgcttcttttctttcagtctttgaaagctttgaataacgcgcgaatgtcaatgttttagcgggagacgcatcccaaaggctcatcgcatttgaaacgaacccgaatctgaaaatcataggaactctcctttataagaaataagataatgccctgccgagccattccgccgggcgctgcctgaatgtgcgcttgctgaaatcctccatcgtcagcagctccgactttttcatatcctcctcaattgtggcatagacttcacttgtaaacgcttcgtcatcaatttcaacattcacctcttcatttaagaacaggctccgtttatcgaagttggctgttccgataatgctgagatggtcgtctatgatgagggcttttacatgataaaacccttgataataacgataaataagacagccggcatccaagagctccgaataatacgtaaaagccgcttctcgtaccagcggatggtctgatttcatcggtacaatgattctcacggatacgccgttttttcttgcgttaataagggcctcttgaagcggttttgatggaatgtaataaggcgtgcaaaccgtaaggcgattcttcgcttgggcaatgttggccaagtatatgttttcaagggaataaccgtcggtcgcatagatcttgtgagaaatagtcccttgctgaagctttggccaaacatccgaacccagttcgattccggtatttcgttttagatcagaagcaaaaagcgtttgaagatcatgtacgccttctccgatcatgcgcagatgataatcctcccaattgccgaacttcgccttctttccaagatattcttcggcgatattaaacccgccgatataaccgatttttccgtctatcaccgtaatcttccggtgattccgtttttgcatgtgaaaaaagaaaaaggaaaacggggacgattcatcacatggacatggacgccggcatttttcatcgtctgaagcgccgtttttttaattgcccggcagcccgcccaatccagaagcaaataaacggatacgccagcttgggcttttgttttcagcaaggtatacatattgtggctgacctcatcatttttcataataaaaaacatcatgtgaacagaagaggcggcctggcgaatatcattcatcatccgctcaacgagatcagcgccgcagtggatcaattcgatgtcactcttcttttttgaaaaaacaggctcgtacgccttttttctgtatccggcacggcccatgaagatatcaagcagaatcaaggcaaagaaaataacgacaatgatcataatcacgataaataccttcataccggcactcctttccgtagtaaaggtagtgtgcccgaacagcaggaatttaattattgactgaacactcattcattatttatcataaagataatcttatacagattcgggggtaggggatcgcggtctttatcagtaaaaagggggaattggaatgagcggctttctcatcgcaaatgcattattatttctgattgtaaccgcttacgctgtctatttgtttgtttacttggtcaaaacgagactggcctacatcaagctcggccagaaagaacaatttgatcaacggttcaaggaacggcttcacgccatatgggtgaatgtattcggacagaaaaaactgctcaaggacaagaaaagcggaatcattcacgtcatgtttttctacggatttatattggttcagttcggagcaattgactttatcatcaaaggactggctcccggccggaatctgtcgcttggcccggtctatcccgccttcaccttttttcaggaaattgttacgtttctcattttaattgctgttgggtgggcattctacagacgttatatcgaaaagctcgtgaggctgaaacgcggtttcaaagccggactcgttctcatttttatcggaggattaatgctgaccgttctgcttgggaacgggatgaatctgatttggcatgagcatgggctttcttggagcgagccaattgcctcaggtattgcgtttatgcttagcggtgtcgggaaaacaggcgcggcggtgattttctatatcgcatggtggatccatctcctattcttgcttagctttttagtgtacgtgcctcagtcaaagcatgcccatttaatcgccggcccggcaaacgtctttttcaatcgaatggaatctgccggaaaacttgaaaaaattgattttaccgacgaaacgaaagaaagctacggagcgggaaaaattgaggatttcagacagtctcagctgcttgatctatacgcgtgtgtcgagtgcggccgctgtaccaatatgtgtcctgcaacaggcaccggaaaaatgctttctccgatggacttgattttgcgtctcagagaccatctcacggaaaaaggcgctgccgtcacctcgcgctccccatgggtgcccgcagcagcgtttcggcatacgagaggcaatcagctggctgcggcgtcagcgggcagcggatcgcaggaagccgcagcggcgcttgattacaatccaagcttgatcggcgacgtcatcacagaggaagaaatttgggcatgcaccacttgccggaactgtgaggatcaatgcccggtcatgaatgagcacgtggataaaatcatcgacctccgccgctacctcgtactgacagaaggaaaaatggacagtgacgcccagcgcgcaatgacaagtattgagcggcaagggaatccgtggggactcaaccgcaaggaacgtgaaaattggcgtgacgaggcgccggatgctgagattccgactgtaaaagaaatgaaaaaagaaggaaaagaatttgagtaccttttctgggtaggctccatggggtcttacgacaacagaagccagaaaatcgcaatttcctttgccaagctgctcaatcacgcgggcgtgtccttcgcgattctcggcaataaagaaaaaaattcaggagacacgccgcgccgcctcggaaatgaatttttgttccaagagctggctgagaagaatatttctgaatttgaaaaaaatgatgtcaaaaaaatcgttacgatcgatccccatgcatacaatttatttaaaaacgaatatccggatttcggatttgaaggcgaggtttatcatcatacagaagtgctggccgagcttgtgaaaaacggaaaattaagaccgcagcacccgcttcatgagacgattaccttccatgattcgtgctatttgggccggtacaatgaagtctatgatccgccgagagagattttgaaagccattccgggcgtgcagcttgttgaaatggagagaagccgggaaaccggcatgtgctgcggagccggcgggggattaatgtggatggaggaagaaacaggcaacaggattaacgtcgccaggacagagcaagcgctcgcagtcaacccatcggtgatcagttctggctgtccgtattgtctcacgatgcttggggacggcacaaaggcgaaggaagccgaagaccaagtcaaaacgtacgacgtcgtcgagcttctggctcaatccgttttaggcgctgatctgaaaatgggggagaagcaatgaatttttcattatcagaagaacatgagatgatacgaaaattggtgcgcgattttgcgaagcatgaggtggccccgacagcggctgaacgggacgaacaagaacgcttcgatcgcgagctgtttcgggaaatggcaaatctgggcctgacgggaattccatggcctgaagattacggcggaattggaagtgactatttagcctacgtcatcgcggtggaagagctgtcaaaagtgtgcgcctccaccggtgtgacgctttccgcccatatctctctttgcagctggccgctgtttgcctttgggacagaggaacagaagacagagtacttaacacagctggctctcggagagaaaatcggcgcattcgctttgaccgaagcagggtctggctctgacgccggcagcatgaaaacaactgctgaacgaatcggcgatgactatgtgttaaatggttccaaagtgtttatcacaaacggcggcgttgctgatatttacattgtttttgccgtcaccgatcccgagaaaaagaaaaaaggcgttaccgcttttatagtagaaaaggattttgaaggattttttacaggcaagaaagaaaagaagctgggcatccgttcttcaccgacaacggaaatcatgttcgaagattgtgtagtgcccgcatcaaagcgtctcggagaagaaggagaaggcttcaaaatcgcgatgaagacgcttgacggaggcagaaacggcatagctgcacaagctgtaggcatcgcccaaggagcgcttgatgcggcgcttcaatatgcaaaagagcgaaagcaattcggaaaatcgatcgccgagcagcagggcatcgcttttaaactcgcggatatggcgacaatgatagaagcttcaaggctactgacctatcaggctgcatggttagaatcatcgggccttccatatggaaaagcttccgccatgtccaaactgatggctggggatacggcgatgaaggtaacgaccgaagccgtgcagattttcggcggctacggctatacaaaagattatccggtagaacgctatatgcgtgatgcaaaaatcacgcaaatctatgaaggcactcaagaaattcaaagactggtcatctccagaatgctcgcggattaacggaaaacatctctcagtcggatcactcttgtaaaattatttaaattaacgctgttaagggtagcatattctgttttattttgtttataatgagaggtatggtttgtataagaacgatacaaaatcgctttcattattgataaaacagatacatataagtaatagaaagggagtgtccgaccttgggtatcaaacaatattcacaggaagagctaaaggaaatggctttagttgaaatcgctcacgaattatttgaagaacataaaaaaccagttccttttcaggagcttttaaatgaaatcgcatctttgctcggcgtgaaaaaagaagagcttggagaccgcattgctcaattttatacagatttaaacattgacggccgcttcctggcgctttctgaccagacgtgggggcttcgcagctggtatccttatgatcagcttgatgaagaaactcagccgacagtcaaggcgaaaaagaaaaaagcgaagaaagcagtcgaagaagatcttgatcttgacgagtttgaagagatcgacgaagacgaccttgatttggatgaagttgaggaagaactcgatcttgaagccgacgattttgacgaagaagatcttgatgaagacgacgatgatcttgagatcgaagaagatattattgatgaagatgatgaagactatgatgatgaagaagaggaaattaaatagtatcagatttcatcttcaaaacgatcttgactttcatagtcgaactatgtagtatgtattttgggctcttcaaaaacgaagagagaacatagtacgttatgctccctttcaagaaattgaaagggagctttcttattttcacccctcatttttcttataaatcatttaaaaggctaaatgattttttataaaatagtacattttaaaaatgtagctaagagcgaagagaggagcaaacgaaatgacgaaatatatttttgtaaccgggggagttgtatcctcacttggaaagggtattgtagcagcttcattagggcgtttgctgaaaaaccgcggactgaacgtgacgattcaaaaattcgatccatacatcaacgttgacccgggaacaatgagcccgtaccagcacggtgaagtattcgtaacggatgacggcgctgaaacagacttggaccttggtcactatgagcgttttatcgacattaacctgaataaattcagcaacgtgacaacaggtaaaatctattcaacagttcttaaaaaagaacgccgcggagattaccttggaggaaccgtacaggtcattccgcacatcacaaacgaattgaaagaccgtgtttaccgcgcagggaaagagacaaacgcagatgttgtcattacagaaatcggcggtactgtcggagacatcgaatcactgccattccttgaagcgatccgccaaatgaagagcgacatcggccgtgaaaacgtaatgtacatccactgtacgctcgtgccttacattaaagctgctggcgaattaaaaacaaaaccgacacagcacagcgtaaaagaattgcgcagcttgggcattcagccaaacatcatcgtcgttcgtacagaaatgccgatttctcaagatatgaaagataaaatcgcgcttttctgcgacatcgatacaaaagcggttattgaatgtgaagatgcggacaacctttactccattccgctggagcttcaaaaacaagggcttgataagcttgtttgcgagcacatgaaattggcatgcaaagaagcggaaatgtccgagtggaaagagcttgttaacaaagtcagcaacctgtctcaaacgattacaatcggccttgtcggcaaatacgttgagcttcctgacgcatacatttctgttgtcgagtctctccgccatgcgggctatgcgtttgacacagatgtaaaagtgaagtggatcaacgcggaagaagtgacagaaaacaatatcgcagaactcacaagcggaacagacggcatcattgtgccgggcggattcggagaccgcggtgttgaagggaaaatcgtcgcgacaaaatacgcgcgcgaaaacaacattccgttcttgggcatttgcttgggcatgcaggtggcgtctattgaatacgcacgaaacgtattgggcttaaaaggcgctcactcagcggaaattgatccgtcaactcaatacccgatcattgatcttcttcctgaacaaaaggatgttgaggatcttgggggaacgcttcgtctcggcctttacccttgtaagcttgaagaaggcacgaaagcctttgaagtgtatcaggatgaagtggtgtacgagcgccaccgccaccgctatgagtttaacaatgaattcagacagcaaatggaagagcaaggcttcgtattctcaggcacaagccctgatggacgccttgttgaaatcatcgagctgaaagaccacccttggttcgtggcttctcagttccacccagagttcaagtcaagaccgacaagacctcagcctctattcaaaggctttatcggagcgtctgtcgaagctgcaaatcagaagtaataaaaaagacttgccgtttgtcaaaagcgggcaagtcttttttatttgtttccggcaagttccagcatgtacaataagatattatgcatactcttgcagaatttcttttagtgtaaacgataaagcgtgatagacatacagtgctgtcattaaagagggaaacccgtaacgggtgccgtcttcatcgggaacaagcggcatttttaatttagaatcaatatgcacatcacaatactgttctattcccgcactgtctttggctgcgggcgatacgcatacgactcccgcacctttttcataaagctcttttgcgagctcctgttcttcggctgtgcccgtccctgagcaaaacatcagcaccctgtcgctttctgtcacttcctcagcgttttctggaaaggctttgacagatgggaagggttctttgctttcggtggcctcataaaagacgccctgaagctcattcgctccgtataaataaatggaatgcccgctgatcaccgcttgagcaagcagccgcgccccatcttcaatcgcgtcagattccttatcctgaatgcgggaaaaaatacctgttaactgcgtcgtgaatattttcaacataagtgaatcctcctttataacgtacaatatcagtatacaacaaaagagaaaatgctcagaaaatgtcgtaaagtagactattataattaaaggaaataggaaaatcaaacagaatacatacaatactgcttacttttgacgaaaatcataatattggggtgtaaaatgatgaatgaaaaaattttaatcgttgatgatcaatacggcattcgtattttgctaaatgaagtgttcaataaagaaggctaccagacgtttcaggctgcgaacggcctgcaggcgcttgacattgtgacaaaagaacggcccgaccttgtgctgttggacatgaaaattcccggcatggacggaatcgaaatcttaaaacggatgaaggtcattgacgaaaacatccgggtcattatcatgacggcatacggagagctcgacatgatccaggaatcgaaggaattgggcgctctgacgcactttgccaagccgtttgacatcgacgaaatcagagacgccgtcaaaaaatatctgcccctgaagtctaactgacaaaaagaagaaacaaatgaatcatgtcattatgttgccgatttgtcgaaaagttggtatcctagttatggagaaaaagcgatctgagtatttacatatgacagcaatatatgggtcatgctagggtggaaagcttttttcgctagaagacaatcaggctacataaggaggacattcgacatgcctttagtttctatgacggaaatgttgaatacagctaaagaaaaagggtacgctgtaggacaatttaacttaaacaaccttgagtttactcaagcgattttacaagcagctgaagaagaaaaatctccagtgatccttggtgtttccgaaggtgcgggacgctacatgggcggcttcaaaacagtcgttgctatggtaaaagcacttatggaagagtacaaagtgacagttcctgttgcgattcacttagaccacggttcaagctttgaatcttgtgcgaaagcgattcatgcaggtttcacatctgtaatgatcgacgcttctcaccatccatttgaagaaaacgtagcaacaactgctaaagttgttgagcttgctcatttccacggagtatctgtagaagctgagcttggaacagtaggcggacaagaagatgacgttatcgctgaaggcgtaatctacgctgatcctaaagagtgccaagagcttgttgagcgcactggcatcgactgccttgcacctgcattaggttctgttcacggcccttacaaaggtgagccaaaccttggcttcaaagaaatggaagagatcggaaaatcaactggccttccgctagttcttcacggcggtactggaattccgactgctgacatcaaaaaatcaatttcacttggtacagctaaaatcaacgtgaatactgaaaaccaaatttcttctgcaaaagctgttcgcgaaacattggcagctaagcctgacgagtacgatccacgtaaataccttggaccagctcgtgaagcgatcaaagaaacagttatcggtaaaatgcgtgaatttggttcttcaaaccaagcttaattcaattggaactttttatagccgcctgacagcttgacaggcggttttccgtctatctttagaaagcgcaatcatattcgcagttcagaaaatttcttaatcagggaggctttttgaaaatgttattctttgttgatacagccaatatcgatgaaattagagaagcgaatgaattaggaattctcgccggtgtaacgacgaatcctagtttagtagcaaaggaagctaacgtatcattccacgaccgtcttcgcgagatcacagacgtcgtgaaagggtctgtaagcgcagaggttatttctttgaaagctgaggaaatgatcgaggaaggaaaagaactggcgaagatcgctccgaacattacggtgaaaatcccaatgacgtctgacggtttaaaagcggtaagagcacttactgacttaggcatcaaaacaaacgttacattgatcttcaatgccaaccaggcgcttcttgctgccagagcgggggcaacatatgtatctccattcctgggacgtttagatgacatcggccacaacgggcttgacctgatttcagaagttaaacagatttttgacattcacggccttgacacgcaaatcattgcagcgtcaatccgccatccgcagcacgtgacagaagctgctcttagaggggctcatatcggcacaatgccgctgaaagtcattcatgcgctcactaaacacccgttaacagacaaaggaatcgaacaattcctggcagactggaacaaataatgaaaggggcggcaaacagctttatgcctgtttgccgcggcctttgtatttcaccgacctgatacagcggatcttcagatgctgacgccgctttacagagaaggaatcattgggctgcagaagctgatatcggaatgaagggtatgcgtactgcttttgccggatgacgacgatgtctctcgagccggcgggtctctgtgcatcttttgaaacctgtaccccccaaagcttcgctattttcttcctgatattttacaatgtgttgtattctttctcttcgaattggctagattttggacatgagctttatttgcagagacagaataaaatgacattttatttagctccgcagctatcttcttatggaaggagactatcatggaaaagttgaatattgccggcggtgactcgttaaacggtacagtacatatcagcggcgctaaaaacagcgctgttgcgttaatacctgcaaccattttggcaaattccgaggtgacaattgaagggcttccagagatttcagatattgaaacgctgcgtgacctgttaaaggaaatcggcggcaacgtgcattttgagaatggggaaatggttgttgaccctacgtcgatgatcagcatgccgcttcctaacgggaaagtaaaaaagcttcgcgcgtcatattatttaatgggggcgatgctcggccgcttcaagcaggcggtcattggattgcctggcggctgtcacttagggccccgtccgattgatcagcatatcaaaggctttgaagcactcggagctgaagtaaccaatgaacaaggcgccatttatttgcgagctgaaaggctgagaggcgcacggatttatttagatgtcgtaagcgttggggcaacgattaacattatgctcgccgctgttttggcagaagggaaaacgatcatcgaaaacgctgccaaggagcctgagatcattgacgtcgcgacattgcttaccagcatgggcgccaaaatcaaaggtgcgggcaccaatgtgattcgaatcgacggcgtgaaggaactgcacggctgcaagcatacgatcattccggacagaattgaagccgggacatttatgattgcaggggctgcaatgggcaaggaagtcattatcgataacgtcatccctactcatcttgagtcgttaacggcaaagctgagagaaatgggctatcatatcgaaacaagcgacgaccagctcctcattgtcggcgggcagaagaacttaaagccggttgacgtcaaaaccctcgtatacccggggtttccgactgatttacagcagccgatgacggcgctcctgacaagggcgaaagggacgagtgtcgtcacagacaccatctactcggcaagattcaagcacattgatgagctgagacgaatgggtgccaatatgaaagtagaaggcagatctgccatcatcacaggtcctgtcgagcttcaaggcgcaaaagtgaaggcgagtgatctgcgtgccggagcctgcttggtggtagccggactgatggctgatggcgtcacggaaattacgggactggagcatattgaccgaggatacagcagccttgagaagaagcttgaggggcttggagcgacaatttggcgtgaaagaatgactgacgaagaaatagaacagcttcaaaattcataatggtttcttgtgagaggagatcgtgttgaaatggaaagaagtttatcaatggaattggtacgtgtgacagaagctgcggcattggcatcagcaagatggatgggccggggaaaaaaagatgaggctgatgaagcggcaacaagtgcaatgagagacgtttttgatacagtgccgatgaaagggaccgttgtaatcggtgaaggggaaatggacgaagcgccaatgctgtatatcggggaaaaactcggaaacgggtacggccctcgcgttgatgtcgcagttgaccctcttgaaggcacaaacatcttagcaagcggcggctggaacgcgctgacggttatcgcggtcgcagaccatggcacgcttctgaatgctcctgacatgtatatgcaaaaaatcgcagtcggtccggaagcggtgggctgcattgacatcgaagcacctgtcattgacaaccttaaagcggtggcaaaagcgaaaaacaaggacgttgaggacgtcgttgccacaattttaaaccgtgaaagacacgcaaaaatcatttccgagcttcgtgaggccggcgccagaatcaaattgatcaatgacggcgatgtcgcaggcgccatcaacacggctttcgaccacacgggcgttgatatcctgttcggatcaggcggcgctcctgagggtgtgctttccgctgttgcgctaaaagcactcggcggagaaatcattggtaaacttcttccgcaaagcgaagaagaaatcactcgctgtcacaaaatgggccttgatttaagcaaagtgcttcgcatggaagaccttgtgaagggtgatgacgcgatttttgcagctacaggggttactgacggcgagctgttaaaaggagttcaattcaaaggctctgtcggtacaactgaaagcttagttatccgtgcaaaatcgggcactgttcgtttcgttgacggcagacacagcttgaaaaagaaaccaaatcttgtaatccgtccataacaaacagaaaaagcgggtgtgagcccgctttaacttttgcagaaaagcgtcaactctatcaattccgtgtcaaaaccttatttcagttgaataattttttgaaataaggtaaaaataaagagtgctgcgaattttactgcgtaataccttcttttaagcactaggaaagtttcaatttctaccgcatacagacgatataagtattgatcttctcatgtttttgtcctcgcttccttcaaaactcattaagacaatccttttaacaaaagcgccgatcatgggtggaagtgttaccgatagaagttcctttatgttaaaaaaagaatgtgctttggcggatgttgtgcaaaagcagcagatgacatgttcagagtaagatattgactatgaaaagcgtggtgtttttatgaaagacgtatctatttcctctttggaaaatatgaaattgaaagagctttatgaacttgcaagacattataaaatctcctattacagcaaactgacaaaaaaagaactcattttcgccattctgaaagcgaatgcagaacaggaagatctgctgtttatggaaggcgttctcgagatcatccagtctgaaggtttcggattcctgagaccgatcaactactctccaagctcagaagacatttacatctcagcttcacaaatccgccgtttcgatttgcggaacggagacaaagtatctggcaaggttcgcccgccaaaagaaaatgagcgttactatggacttttgcacgttgaagcagtaaatggggatgatcccgaatctgcaaaagagcgtgtgcatttcccggctcttacgccactttatccggatcgtcaaatggtgcttgaaacaaagccgaacttcttgtctacaagaattatggacatgatggcgccggttggatttgggcagcgcggattgattgttgcgccgccgaaagccggaaaaacgatgttgctgaaggaaattgccaacagcattacagcgaaccagcctgaagcagagctgatcgtgcttttaattgacgaaagacctgaggaagtaaccgatatcgagcgctctgtagctggggatgtcgtcagctcaacgtttgatgaagtgccggaaaaccatatcaaagtggccgagcttgtgcttgaacgtgcgatgcgtctcgtggaacacaaaaaagacgtcattatcctgatggacagcatcacacgtcttgcccgcgcctacaacttagtgattccgccaagtggaagaacgctttccggggggattgacccagcggcgttccaccgtccgaaacgcttctttggggctgcgagaaatatcgaagagggcggcagcttaaccatccttgctacggctctggtcgatacaggttcacgtatggatgatgtcatttatgaagaattcaagggaacaggcaacatggagctccatcttgaccgctctcttgccgagcgccgcatcttccctgccatcgatatccgccgttcaggaacgcgcaaagaagagctgcttgtgcctaaagagcatcttgatcgtttatggtctatccgcaaaacgatgtctgattcacctgatttcgcagaaaagttcatgagaaaaatgaaaaaaaccaaaacaaaccaggaatttttcgatattctcaatcaagaatggaaacaggcaaatctatcatctgcaagaaggtaaattgtatttgcaaaagaagtaaatcactgatataattttctcatatgcgtttcggacaatgctccgaaataataactctgtttccacacgggattcagggcggaaggagatggatacaatgaaagcaggaattcatcctaatttcaaaaaagcaacagttaaatgcgcttgcggaaatgaatttgaaacaggctcagtaaaagaagaggtacgcgttgagatttgctctgaatgccacccattctacactggccgtcaaaaattcgcttctgctgatggtcgtgttgatcgctttaacaaaaaatacggtcttaagtaataatagatttctcaacaggcaagcagcagtcttgcctgttttttatattgtctaaaacacagctggcagagagaggggagcgaagcctatgtacataatgaaacaaagcgggtggcttgagctgatttgcggcagcatgttctcggggaaatctgaagagctgatcagaagagtgaagagagcaacttatgccaagcaggaagtcagggtatttaagcctgtaattgataaccgatacagcgaagctgctgttgtctcccataatggaacatcgatgacgagctatgccatttcgtctgctgcggacatttgggatcacatcagtgaaagtacagatgtggttgcggttgatgaagtgcagttttttgatcaggaaattgttgaggttttatcatctcttgccgataaaggctaccgtgtgatagcagcaggccttgatatggattttaggggagagccgttcggtgtcgtcccgaatatcatggcgattgcggaaagtgtgacaaagctgcaagccgtctgttctgtttgcggatcaccggcgagcagaacacagcgcctcattgacggcaaacctgcttcttacgatgatccggtcattttggttggtgcagctgaatcatatgaagcaagatgcagacatcatcacgaagtcccaggtaaatctaaaaaatagtccaaaacatgggtataaagatagaatgcaccggctaaaaacaccggtgtttttttatattctgataatattcaattaaaaatttaaataagtatattaaaaaattaagtaattttcttctcttgaattttgattttgacaggcatacaatagcttacgtaatgtaaatagttttgagacattgttcgaataattgtcacaaagtcgcataaagatcatgatcggtcatattttagatgggttattacttaacttggttaactatttcaagaaagaaggagatttgcttgaataacataaaaaaaacgaaagaaggccacttagaaacaactcttagaggaaaagaagttttatctattcctactttaaataaaggcgttgctttttcactagaagaaagacaagaactcggcttagaagggcttctgccgccaactgtactttctcttgatcaacaagcacaacgcgcgtacgagcaattccaagcgcagcctgaccgccttcgtcaaaatgtttacttaagtgatcttgcaaaccgtaacgaagttcttttctataaattgctgaaaaaccatcttcgcgaaatgcttcctgttgtgtacacgccaacagttggtgaagcgattcaggaatacagccatgaatatagaagacctcaaggaatctacttgtcaatcgataacattgacggtattgaaaaagcgtttgaaaaccttcatgcgacagcaggcgatattgatcttatcgttgctactgactccgaaagcattctcggtatcggtgactggggtgtaggcggtattaatattgcaatcggtaaattggctgtctacactgctgcagctggtattgaccctagccgtgttatcccggttgtgcttgatgtcggtacgaacaacgaaaaacttctaaacgatcctttatatattggtaacaagcatgaacgtgttcaaggtgaacgctacgaagctttcattgacgcttatgtaaaagctgcattgaaattcttccctaaagcgcttcttcactgggaagaccttggcaacaaaaatgcacgcaacatcatgaaaaaatacaatcatgaaatcctgacatttaatgatgatattcaaggtactggcgcgattacacttgcaggtgtgcttgccgctatgaagaaaaccggcgcttctattaaagatcagcgtgttgttatcttcggtgctggttctgctggtatcggtattgctgaccaaatccgtgacacaatggtgctagccggattatctgaagaagaagctaacaaacgtttctacacacttgattacagaggcttgctgactgaagacatcgaaggcatccttgatttccaaaaaccttaccttcgcaatgcggatgaagtgaaagactggaagcgcgatgaaaaaggtcaaattccattcgatgaagttgttcgtcaagcgaaaccaacaatcttgattggtacttcaggggtttcaggtgcattcacagaggaaattgtaaaagaaatggcatctcacgtagaccgtccggttatcatgccgatgtctaacccgactcaccttgctgaagctgttcctgaagatctgttcaaatggactgacggaaaagtgcttattgcaacaggaagcccatttgacaatgtagaatacaacggtgtttcttatgaaatcggacaatctaacaacgcattcgcgttccctggtcttggacttggttcaattgtagctgaagcgcgtatcattacacctgctatgtttgctgcaactgctgatgcgattgctgaaatggttgatcttgaaacacctggagcaggattgcttccaagcattgataagcttcaagaggtttctatccaagttgcgattgccgttgctgaagcagcaattaaagacggcgtggcaaatcgtcagcctgaagatgtgaaacaagcggtacttgatgcaatgtggacacctgaatacaaaaaagtcatcgcgaaataattagcgagtaaatttttctgtccgagggaaagctttttgtaaagctaaagtatacggacataggatttggaggagaatattttgagcatcttagatatcttaatcctcctggcgccgatcttctttgttatcgtgctgggttggtttgcaggacattttggaagttatgatgccaagtcggcaaaaggggtaagtacgttagtaacgaaatacgcacttccagctcactttatcgctggtattttgacaacttccagaagtgaatttttatcacaagtacctttaatgatttctttaattattgggattgttggtttctatatcatcattcttttggtttgcagatttatattcaagtatgatttaacgaactcatctgtattttctttgaactctgcacagccgacattcgcatttatgggtatcccggtattgggaagcttattcggagcgaatgaagttgcgattccgatcgcggtcacaggtatcgtggttaacgcgattcttgatccgctcgcgatcattatcgctactgttggtgagtcttctaagaaaaacgaagagagtggcgacagcttctggaagatgacaggaaaatcaatcctgcatggtctttgtgagccgcttgcagctgctccgttaatcagtatgatcttggtgctggttttcaatttcactcttcctgagctgggtgttaaaatgcttgatcagcttggaagcacaacatctggtgttgctctcttcgctgttggtgttaccgttggtattcgtaaaattaaactcagtatgccggctatcggtattgcgttactaaaagttgcggttcagcctgcgttaatgttcctgattgctcttgctatcggacttccagctgaccaaacaacaaaagcaatccttcttgttgcattccctggttctgccgttgcagccatgattgcgactcgtttcgagaaacaagaagaagaaactgcaactgcgtttgtggtcagtgcgattctgtcattgatttcacttccaatcattatcgcgcttactgcgtaacaaaaaaagctccctttaagggagctttttgctttaggtttgaaatttgaacagtgacagcagcggtttttttcttgttttggttttttcagaagcagcagcagtctcggggatcgaatgagcggtgaattctttcatttgtgaggtcagtgattgcagatctgcaagaatatcatcgatttctctgcggtgctgaagcagctggtaagatacaccttcatcggctttttgtttcagctggcgttccagttccgacatccttgccatcaattcgctttcgtcctgcctttgctgtaaaagggtgtccagcttttgttcaagctgctcgattcttcgttctgtgtcgctacttgttttttggacaaggaagcctgtgcgctttttagcgcttttcggcagatgaatatcctgaatcgccgtgccttcagagatttgtttttgaacggattttagaaccttcacgtcttctgccgtgaacgaatagtgtccgagctcattgcgttcggccggaagattcagctgcttcacccaccgctgcaccgtctttgcggagacgccgagttcacttgctaccatatttgtattcatgatcccatacctccttttaagctaggtattcgaccatagaatgcggttcccttcccgttagacaaaacaagaaaagattcggcaaagaaagtgggtatctcctttttttcttcaaaaactgttattgttcatacagttctaatggaagctggtcaggatcaaaaaagaaggtgaaacgcttgccggtcagcggatctgttctgattggctctgtttcgattcctttttcatgaagctcttgaacagctttatccaagctgccgactgtaaaggcgaggtggcgcaggcctgcggcttcaggccgggtttgtcgttcgggcggatcgggaaacgagaacagctcaatgacatacgagccgttaagcgacaaatcaagcttataggagccgcgctcttcgcggtacgtttcttgaatcacctgaaaaccaagcttatgtacgtagaaagctttcgacttttcgtaatctgaacatatgattgcaatatgatgtatggatttcagcaacatcatccctcctcgaattccagtatagcagagggagcttttccagctgggattgaaatgcttttgactggggttaatcactatactataatgagaatgttacgcacaggaaaacagaggtgaagaccgtgttagaccgtttaaaatcaattgaagaacgatacgagaaattaaatgagcttttgagcgatccagaagtagtcaacgatccgaaaaagctaagagaatattcaaaagagcaatctgatatacaagaaacagttgacgtatatagacaatacagagatgcgtcagaacagctggctgatgcaaaagcgatgcttgaagagaagctggatgctgagatgcgcgacatggtgaaggaagagatttctgaacttcagaaggaaacggaaacactgtcagaacggctgaaggtgctcctgatcccgaaagatcctaatgacgacaaaaacgttatcatggagatccgcggggctgcgggaggcgaggaagccgctttattcgcgggcaatctgtacagaatgtattcccgttatgctgagcttcagggctggaaaacagaggtcatggaagcgaatgtaaccggaacgggcggctacaaagagatcatctttatgattacaggaagcggcgcgtattctaaactcaaatatgaaaacggcgcccaccgcgtacagcgtgttccggaaacagaatcaggcggacgcatccatacatccactgcaacagtggcatgtcttcctgaggcagaagaggtagaggtcgacatccatgagaaggatatccgtgtcgatacatttgcttcaagcggaccgggcggacaaagcgttaacacaacaatgtctgcggttcgtctgactcacttgccgacaggtgttgttgtatcatgccaggatgaaaaatctcaaattaagaacaaagaaaaagcaatgaaggttctccgtgccagaatctatgataaatttcagcaggaagcccaggctgaatatgatcaaacacggaaatcagcagtcggatctggtgaccgctctgaacgtatccgcacatacaacttcccgcaaaaccgtgtgacggatcacagaatcggtttgacgattcaaaagcttgatcagattcttgaaggaaaacttgacgaagtggttgaagcgctgattgttgaagatcaggcaagcaagcttcagcagtcggaaggttaagatgaagacgatattcgaagccctgaaatgggcttcttcttatttaaccgaagcgggaagagaagaaaatgcggccgagctcctattgctttatgataccggaatggagagaagcaagctgctcgcaagcttacaggaaccgattggtgaagacgaactgtatcgctttaagcgtcacgttgagatgcataaagagggcgtgccggttcaatacattataggaaaagagtttttttatggacgggaatttatggtgaatgatgatgtgctgatcccgcggccggaaactgaagaagttgtctttcatttgcttgaaaaatatcggagtgttttttctgaagacggcaagctcgaagttgttgacgttggtacagggagcggcgcaatagccgtcacgcttgcgcttgaaaaccaaagcttttctgtgtcggcggtcgatatttcgaaagaggcgctgcaagtcgcctctgccaatgcagaaaaactcggagcgaatgtgcgcttttatcagggcgatctgcttgagccttttattaaggcgggaaaaaaagcggatatcattgtctcaaacccgccatatatttcagaggaagaaatggctgatttatcggaaattgtccgttttcatgagccgctgcacgcactcaccgatggcggagacgggctgaaattttataagcggtttatggaagacattccgcttgttatgaaggataaagtatttgtcgtttttgaaatcggctggaaacagggagcgtcggtcaaagacctgatcctcaaggcgtttaagggggcggaagtggaagtgctgaaagatattaatggaaaagacagaaccatatgcgctctgattcataaaaataaataagcagcttgctggcgagtgaatggatcaagctgtttaacaccagcaaaggggatgtaaacatgaaaaaggccctgacagcaggaatcctgctcattgcgattgagagcatgattggcaccatttttccgcaggctctttcatatgaagcgatttttggcgttgcgtctctcgttttagtggggctcgcgatcattacatcgggtttggctgtaagcggaagcgatcagcgggcaaactaccattcagaaaccaaagaaggccgtacatctcgcatgaaaatggcggccgctttctttgttgcggcgataccttccattctatgttatttactgacgattttgttttaataaaaaaggaagcctcttaggcttcctttttttgcagtaaaacagaatcccatatccaatagataagagctgttaatacagcgaaaagataaaaggctgtattttgaaacagagattgtcccgaaggctgaagcatgccgaaaatgatcgcgttggcaataaaagcagcggcaaggtaatacagcagatacaaagggctgaaacgtttcggctttttattcatcatgatttgaagcggcagtgcgaagatcaaataaggaaacagaaaataaaatgccattgtgatgagagcggcaatgataaatgaatgaatataaattactgaataaagaacggacatcgtgaatgctgataacagcactgtataattgtatttcatcttaaacctcctaaaacactatcgtaccataaataagattaacagcttgctagatttttttcaccctgcacgtttatcccaggctctccttgtccataatagggctagaaacaaagcacggagaggaacggtggggaccgatgaaaaaaacagtaatcatttgtatatatatctttcttttattatccggagcgctcgtagggctggcaaaagaagagacggcacaaaaatcggaaaatcagccggtggtcatacctgatcaggcgattcgtttgagaatactggcaaacagcgatagtgatcaagaccagcaattaaaacgtcatataagagacgcggtgaataaagaaatcacaacttgggtaaaggatattacttctattgaagaagcgcgtcgcgtgattcgttcaaagctgcctgaaatcaaagcaattgcaaaggaaacaatggagaaagaaggagcgaatcagtcgatatccgttgattttgacaaaatctcgtttccgacaaagctttacggcaacatggtatatcccgctggtgagtatgaagcgattttgattacgcttggaaacggagacggcgccaactggtggtgtgtgctgttcccgcccctctgctttcttgatttttctaacggggaagccgtcaaagaacaagaagataaagaagcctcaaaaaagcagactgaaaaagtgcttgaggacgtaaccgctaaagcggaaaaagccaaaaaagaagagaacgaagaaaaagaagacggcacagaagtgaaattctttttagtcgaatggatttccgaccttttttcctaatcatctggtctaaaaatagatttgcctcatagattggaagaaagaacgcaaaaacggggtgaacggatgttttatcaactgcgggtggcaagggaaaaagacggagatgtgctcgaggcatttttaaaacaggcaaaaaccagctatgaaggcgtgaaagaaggcttcactcaatttcttatgctggaggacagtgagaaaaacattgccggatgcctcggtattgaaaaaataagctgtgaccaggggctgctgcgatcacttgtcatatcggacaagcttcaccaaggccacatcgtcacgctttttcaaagcatggaggtgctgtgcgaaaagcatcagatcaaaaccgtgtacctagtagcaaatcagcattcctctgcggactttctgacggccatgggttttgaaagagctgagagtgtaccggaggagctgttttcttctgatcacttctgtgaatcgcggcaaacagaaggagccgttttgatgaaaaaagcgtctggataagtgcagtttatacacatacttatccacttctttattagcgttgtccacaatttgtggataacgcttgttttattacaggacatcttttatactttcaaaaggattacacgcgtaaaacaatcgttttattgttgtgaataaggagtttggtcagaaatgaaaacgaaaagatggtttgtggatgtaactgacgagttatccacaaatgatccacaaattgcacaagcagccgctttgctccgagaaaatgaggtcgttgcctttccgacagaaacagtatatggcctaggcgcaaacgcaaaaaatacggatgccgtcaaaaaaatatatgaggcgaaagggcggccgagcgataatcccctgattgtccacattgcggatatcagccagcttgaggatttaacgggcccggcgccggaaaaggcgaaaacattgatgaaacggttttggccgggagcacttacgctcattctgccttgcaaacctgatgcgctttcacctcgtgtaacggcaggtcttgaaacggttgccattagaatgccggatcatccgcttgcccttgcattgattcgcgaatcgggactgccgattgcagcaccgagcgccaatctatcaggcaagccaagtcccacaaaagcggagcatgtggctcacgacttggatggccgcatagccggtattgtggatggaggccctaccggaatcggggtcgaatcaactgtgctttcatgtgcggacgacatccctgttctcttgcgtcctggcggcattacgaaggaacaaattgaagcggtgatcgggccgatccatgtggataaagggctcagcgaccaaaacgagaagccgatttctccagggatgaaatatacacattatgcgccgacagcgcctcttgccatttgcgaaggcagcccagagcgcattcagcacctcattcaagaatatcaacagggtggaagacgggtcggtgtcctgacgacagaagaaaaagcgggcgtttattccgctgattatgtgaagagctgcggaagacgggctcagcttgagactgttgcggcagggctgtatgatgctttgcgcagctttgatgagaataaggtggatttcattatagcggaatcctttccggatacaggtgtcggtcttgctattatgaacaggctgatgaaagccgccggaggaagagtgattcgctgaaagcagtcagatgttctaaccctttttggacacgcataggctaaaaaagcggggcgtgtccaagggggttatttatgtatgtcggatttgtttataggcgaactgattacattaagcatcatggcgtttgctttagggatggatgctttttctgtcggccttggaatgggcatggtcaaacttagaaagaagcagatattctatattggtttcatcatcggcctctttcacgtcatcatgcctctcgcagggatggcggccggtaacatgctgtcagggctcctcggcgtgttagcggtttatatcggtggggcgctgctttttgttcttggggttcaaatgcttatggcctcttttaaacagtcagaagaacgattcatgtcaccggcagggccgggcttattgctgtttgccatcggcgtcagccttgacagcttttccgtcggcttgagcttggggatatacggctcgcatccgctcctcacaattaccctgttcgggctgttcagcatgatgttgacatggctgggcctgctggtcggaaaacaagtgcagtcatggcttggcacatacagcgaagcgctcgggggcatcatattaatcgtgtttggattaaagctgcttttgccaatttaatataccaataaaagaaacgaagtcgccgtttcttttttcttcatatataatagagaaaaataaggggtgactgacatggatattatttttgtctgtactggaaatacgtgccgcagcccaatggctgaggcgctttttaaatcaattgcagaaagggaagggctgaatgtcaatgtccgctcggcaggcgtgtttgcttcacctaatgggaaagcgacgcctcatgcagtcgaagcgctgtttgaaaaacacattgcccttaatcatgtgtcttctccattaactgaagaacttatggaatcggctgatttggttctggctatgacccatcagcacaaacagatcattgccagccaatttggacgttatcgtgataaagtgtttacgttaaaagaatatgtcacaggcagccatggtgatgtcctcgatccgttcggcggctcaattgacatctataaacaaacgcgagatgagcttgaagagcttcttcggcagctggcaaaacagctgaaaaaagaccgtagataagttgtcagaaaatctgcaaacaggtcatttgcaaatcctgcgtgaaggagtagaatatagtgaaaagcacatcatatggtgtgaatcaaagagcggacaggctgcgcggtcaataaagcgggcgggccgcatcacacacgctgggaggaaaagcagatgaaagtagccattgcatcggatcatggcggcgttcacattcgaaatgaaatcaaagagttaatggacgaattgcaaattgaatatattgatatgggctgtgactgcggcagcggctctgtcgattatccggattatgcttttccggtggccgaaaaagtggttagcggcgaagttgacagaggcattttaatttgcgggacaggcatcggcatgagcatttccgctaataaagtaaaagggattcgctgcgcgctggcgcacgataccttcagcgcgaaggcgacgagggagcataatgacacaaacatccttgcgatgggtgaacgggtgatcggacctggtttggctcgggaaatcgcaaaaatctggctgactactgagtttaccgggggaagacaccaaacgcgtattggaaaaatctccgattatgaagagaaaaacctgtaggggtgctgtttaatgaatgagttgaaacaaacgtggaagacgatgctgtctgagtttcaggaccaagcggaattgaaacaagatcagctcttcgtccttggatgcagcacgagcgaagtggccggcagccggatcggcacatcgggcagtgtagatatcgctgaaagcatctacagcggacttgctgagctccgggaaaaaacgggaatccatctggcgtttcaatgctgcgagcatttaaacagagcgcttgtcgtcgaagcagaaacagccaagctgttcaggcttccaaccgtttctgccgtgcccgttccaaaagcgggcggagcgatggcgtcttatgcgtttaagcagatgaagtctcctgttcttgttgaaaccattcaggctgacgccggaattgatataggcgatacgtttatcggcatgcatctgaaaccggtggctgtccctgtgcgtgtctctcaaaacagcctcggttcagctcatgtgacattggcgcgtacacggccgaaactaatcggcggagtgcgggcggtttatgagtgcgaatgaaaggactgcatagccagtcttttcttttattttaagatagtgaaataaattccgaactttaaattaaatttaagttattaatattcgtttttaccaataaaaatttagattttttaaaaataatcttttacatcggccttaaaaaccatgtacaatagtgatggtaaaaacaaagaacaggatacggataggagaggatctcgctgatgaaacatttacctgcgcaagacgaacaagtgtttaacgccattaaaaatgagcgtgaacgccaacagactaagatcgaattgattgcttctgagaactttgtaagtgaagcggttatggaagcacaaggatctgttttgacaaataagtacgcagaaggatatccgggcaaacgctactacggcggatgcgagcacgtcgatgtcgttgaagatatcgcccgtgaccgcgcgaaggaaatctttggagcggagcatgtaaacgttcagcctcattcaggcgcacaagcaaacatggcagtgtacttcacgattttggagcaaggcgatactgtacttgggatgaacctctcccacggcggccatttaacacacggaagcccagtcaacttcagcggtgttcaatataactttgttgagtacggcgtagataaagaaactcaatatattgattacgatgacgtgcgtgaaaaagccctcgctcataaaccgaagcttatcgtagcaggagcaagtgcgtatcctcgtacaatcgactttaagaaattccgtgaaattgctgatgaagtcggcgcttacttcatggtggatatggcacatatcgcaggacttgttgcggcaggccttcatccaaacccggttccttacgctgatttcgttacaacaacaacacataaaacacttcgcggtcctcgcggcggtatgatcctttgccgtgaagagtttggcaagaaaattgataaatcgatcttccctggaattcaaggcggccctctgatgcacgttattgccgcaaaagctgtttcattcggtgaagtattgcaggacgatttcaaaacatatgcacaaaacgtcatttcaaacgcgaaacgtctggctgaagccttaacgaaagagggcatccagctcgtttcaggcggaacagacaaccaccttatccttgttgaccttcgttcgctcggactgactggtaaggttgcggagcatgtacttgatgaaattggtattacgtctaacaaaaacgcgattccatatgatcctgaaaaacctttcgtaacaagcggcatccgtcttggtacagctgctgtaaccagccgcggttttgacggagacgcattagaagaagtcggtgctatcattgcgcttgcattgaaaaaccacgaagatgaaggaaaacttgaagaagcaagacagcgtgtagctgctctgactgataaatttcctttatataaagaattagattattaagatcctaaaacccgcttgggcttatgcccggcgggttttttgacgatgttcttgaaactcaatgtctttttttgtagaatcaatagaagtgtgtaattgttgatgggacaataaaaaaggagctgaaacacagtatgggaaaggtttatgtatttgatcatcctttaattcagcacaagctgacatatatacggaatgaaaatacaggtacgaaggattttagagagttagtagatgaagtggctacactcatggcatttgaaattacccgcgatcttcctctggaagaagtggatatcaatacaccggttcaggctgcgaaatcgaaagtcatctcagggaaaaaactcggagtggttcctatcctcagagcaggattgggaatggttgacggcattttaaagctgattcctgcggcaaaagtgggacatgtcggcctttaccgtgatccagaaaccttaaaacccgtggaatactatgtcaagcttccttctgatgtggaagagcgtgaattcatcgtggttgacccgatgctcgctacaggcggttccgcagttgaagccattcacagccttaaaaaacgcggtgcgaaaaatatccgtttcatgtgtcttgtagcagcgccggagggtgtggaagaattgcagaagcatcattcggacgttgatatttacattgcggcgctagatgaaaaattaaatgaaaaaggatatattgttccaggtctcggagatgcgggtgaccgcatgtttggaacaaaataaaaaatgaaatccccaaaagggggtttcatttttttatccagttttttgctattcggtgaatctgtatacaattataggtgaaaatgtgaacattctgtggagacgtaaagtataaaaagttttttaactttaaacagattgacacatgttaggggctattgtatgctaaacgagggtattatgagaaggttttcatagctttcattatagtcctcatcctcaatgtaaatcctctcagcaaacccgtattatgaggatttatttaagcgaatgaaacagcatccctgcaaggcttgcggatgaatgattttttcgaacaggcccgttttgccggtcaaaaaaggtcttctactaagggttaaccgctgatttttgccgtatccaagctatacattattttttcatcaggagacagataattgatggacgatcccaagcttacatttagcagacaacgcaaatatttattgttcattttggcagtgtatgtactgggttatggtttaacagcgtataaaaccgtttttttaggccttattctgggaactgttttcagtttgtttaattttttactgctcgtcagaagaatgaatgcttttgacagagctgtagagaaaggaaagtccatacgatctctcgggagcgcagcgcggtggtgcaatgcgattcttgctgtggctgttgcctataaaaatcccgaatactttcatatggcaagtacagttattggattaatgacaatataccctgtcattatgatagattcctttatccagcttaaacgttcatcaatggaagagaggtgaaaaccctttgaatcatggttacagaactatagaatttctaggtcttacttttaatctgacaaacattctgatgattactgtggcgagtgtgattgttttattgattgctatattgacgacaagaacgctttcgatccgtcccggaaaagcccagaactttatggaatggattgttgatttcgtccgcaatattattggcagtacaatggatttaaaaacaggggctaacttcttggcacttggtgtcacattgctgatgtacatatttgtgtcgaatatgctggggctgccgttctctattacaatcggacatgagctctggtggaagtctccgacagccgatcctgccattacattaacgctagccgtgatggttgttgctttaacccactactatggtgtgaagatgaaagggctcaaggaatattccaaagactatttaagacctgttccattcatgctcccgatgaaaatcatcgaagagtttgcgaatacgctgactctaggtttgcggctgtatggtaacatcttcgccggtgagattcttctcggcctgcttgcgggattagcaacaagccattattcgcaaagcgtggctctcggtcttgtcggtacaatcggtgccattctgccgatgctggcatggcaagcattcagtttatttattggtgctatccaggcatttatctttacaatgctgacgatggtgtacatgtctcataaaatcagtcatgatcattaaaacattatatccaaacggataacattttaaaggaggaactttttcatgaatttaatagcagctgcgattgcaattggtttaggcgcacttggtgcaggtattggtaacggtttgattgtttcacgtacggtagaggggattgcccgtcagccggaagcaggtaaagaactgagaactcttatgttcatgggtatcgcattagttgaagcccttcctattatcgctgtcgttatcgcattcttagcgttctttggctaagcataaaagccttatatgaactaaaaatggcgaagatcattccaagagaaccttcgccattgctttatgtctgataagcatcccgccttgccggctgaaaagagacaagtgcggctgctggatcagcaaagaaaaacctgcagaagggagttgccgtagtagatgtctcaattaccacttgaactaggattgtcgtttaacggcggagatatcctgttccaactgttagctatgttaatcttattagcgcttctgaagaaatacgctttagggccgctattaaacataatgaaacagcgtgaagaccacatcgctggagaaattacgtctgctgaagaaaaaaataaagaagcgcagcagctgattgaagagcagcgcgttcttttaaaagaagcaagacaggaatcccaaactcttatcgaaaacgcaaagaaactgggagagaagcaaaaagaagagattattcaggctgcacgtgcagaatctgaacgtctgaaagaagcagcaagaactgaaatcgtgaaggaaaaggaacaggcggtttctgctctccgtgagcaagtagcgtctctttctgtcatgattgcgtcgaaagtgatcgaaaaagaactggatgaacaagcgcaagagaaattgatccaggactatcttaaagaggtaggagaaagccgatgagtggatcagctgtctctaaacgatatgcatcagctctttttgatatagccaatgagtccgctcagctgaatcaagtagaagaagagctaattgttgtaaaacaagtatttcaaaatgaaaaagcgcttaatgatgtgttgaaccatccgaaggtgccggctgcgaagaaaaaagagctgattcaaaatgcatttggctctttgtcacagtccgtactcaatacgatttttcttttgattgaccgccatcgtgccgcgattgtccctgagctcacagatgagtttatcaaactcgcaaatgtggcccgtcaaacagaagacgcaatcgtatattcagtgaaaccgctgacggatgcagaaatgttaccattatcacaagtgtttgcaaaaaaagccggagtcgcttcactgagaatcagaaatgaagtgcagacggatttaataggcggtattaaagtccgcattggaaaccggatttatgacggcagcgtaagcgggaagcttcagcgcattgaacgtcaattagccggggaaaatcgatagaaggggtgaaacctaagtgagcatcaaagctgaagagattagcacgctgataaaacagcaaatacaaaattatcaatctgatattgaagttcaagacgtaggtacagtcatccaagtcggtgacggtattgcacgtgtgcacggccttgacaactgtatggccggtgaacttgtcgaattttcaaacggtgttttgggtatggctcaaaaccttgaggaatcaaacgtaggtatcgtcatcttaggacctttcagtgagatccgtgagggagacgaagtaaaaagaacaggccgcatcatggaggttcctgttggtgaagagttaatcggccgtattgtaaacccgctaggccagccggttgacggactaggcccgattctgacaagcaaaactcgtccgatcgaaagccctgcaccaggcgttatggaccgtaaatccgttcatgaaccgcttcaaaccggtatcaaagcgatcgatgcactgattccaatcggccgcggccagcgtgagctgatcatcggtgaccgtcaaacaggtaaaacatctgttgcgatcgatgcgatcctgaaccaaaaagaccaagacatgatctgtgtatatgttgcgatcggccaaaaagaatcaacagtccgcggcgtagtagaaacattgcgtaaacacggcgcgcttgattatacaattgttgtaacggcgtctgcgtcacagccggcaccgcttctgtacctggcaccgtatgctggggttacaatggcagaagaatttatgtacaacggcaagcacgttcttgttgtatacgatgatctttctaaacaagcggccgcttaccgtgagctgtccttgcttcttcgccgtccgccaggccgtgaagcgttccctggggatgtattctatcttcattcccgtctgcttgagcgtgcagcaaagcttagcgacgcgaaaggcgcaggatcaattacagctctgccgttcgtagaaacacaagccggagatatctctgcttatattccgacgaacgtcatttccatcaccgacggacagatcttcctgcaatctgatttgttcttctcaggcgtacgtccagcgatcaatgccggattgtctgtatcccgtgtcggcggctcagcgcaaatcaaagcgatgaaaaaagtatcaggtactttgcgtcttgaccttgcgtcataccgtgagctggaagcattcgctcaattcggttctgacctcgaccaagcgactcaggcaaaactgaaccgcggtgcgcgtacagttgaagtgctgaagcaggatctgaacaagccgcttccggttgaaaagcaagtagctattctttatgcgctgacaaaaggatatctcgatgatattcctgtggcggatatcagacgttttgaagaagagtactacatgtaccttgaccaaaaccataaagacctgcttgacggaattgcgaaaacaggaaaccttcctgctgatgaagacttcaaagctgcaatcgaaggcttcaaacgcacatttgcaccaagcaactaactcgaatgctgatgagagaaaaaggttctctttttctctctttttacgcagatgaagagaaaaggtggtgaaatctttggcctcattacgcgatattaagtcaaggatcacgtcaacgaaaaaaacaagtcagattacaaaagccatgcagatggtatctgcggctaagctgaatcgtgctgaaaacaatgcaaaatcatttgtgccatatatggataaaatccaagaggttgtgtcaaacgtcggaagagtttccggcaacgtgaagcacccgatgcttctcagcagagaagtgaaaaaaacggcataccttgtcattacgtctgaccgcggtcttgccggcgcttttaacagttcggttttacggagtgcttatcaggccatgcaagaacgtcatcagtctaaggatgagtatgcggtgattgccatcggaagagtgggccgtgatttctttaagaaacgggagattccgatcatttccgagttaacaggacttggagatgaagtaacgtttacagaaattaaagatcttgcccgtcaaacgattcaaatgtttatagacggtgcgtttgatgaattgcaccttgtttataaccattttgtcagcgccattactcaagaagtaacggagaaaaaacttctgccgttatctgatttgggcagcggcggcggaaaaagaacggcgtcttatgaatttgaaccatctgaagaggaggttctggaggttttgcttcctcaatatgcagaaagcttaatcttcggtgcgcttcttgacagtaaagcaagtgagcacgctgcaagaatgacggcgatgaaaaacgcgacagacaacgcgaaggaacttatcgattcactttcgctttcttacaaccgcgctcgccaagcagccatcacacaagaaattacggaaattgtcggcggagcagccgctttagaatagaaagattttgtcaggagggatagcgatgaagaaaggacgcgttagccaggtattaggaccggtcgtcgacgtgcgttttgaagacggtcacttgcctgaaatttataatgcgattaaaatttcacagccagctgcaagtgaaaacgaagtaggtattgatttaacgcttgaggtcgctcttcatttaggtgatgatacagtccgtacaatcgcaatggcatctacagatggtgttcagcgcggtatggaagctgtagatacaggagcgccaatctcagtaccggttggtgatgtaacacttggacgtgtatttaacgttctcggagaaaatattgatttgaatgagccggttcctgcggatgcgaaaaaggatccgattcacagacaggcgccttcattcgatcagctttcaacagaagttgaaattcttgaaacaggtattaaagttgttgatttgcttgctccttacattaagggcggtaaaatcggattgttcggtggtgccggtgtaggtaaaaccgtattaatccaggaattaatcaacaacatcgcgcaagagcacggcggtatctctgtattcgccggcgtaggagagcgtactcgtgaagggaacgaccttttctacgaaatgagtgactctggcgtaatcaacaaaacagccatggtattcggacaaatgaacgagccgccgggcgcacgtatgcgtgttgctttgacaggccttacaatggctgagcacttccgtgatgtacaaggacaggacgtactgttcttcatcgataacattttccgtttcacacaagcgggttcagaggtttcagcccttcttggccgtatgccttcagcggttggttatcagccgacgcttgcaactgagatgggtcagctccaagagcgtatcacgtctacgaacgttggatcagttacatctatccaggcgatctacgtgcctgccgatgactacactgacccggcgccggcgacaacgttcgctcacttggatgcgacaacaaaccttgagcgtaaattaactgaaatgggtatttaccctgcggttgatccgttggcatctacatcacgcgcccttgctcctgaaattgttggagaagagcactatgcggttgcgcgtgaagtacagtcaacgcttcagcgttacaaagagcttcaggatatcattgcgattctcggtatggatgaattaggcgaggaagacaaacttgtcgttcaccgcgcacgtcgtatccagttcttcctttctcagaacttccacgtggctgaacagttcactggacaaaaaggttcttacgtgcctgtaaaagagacggtacaaggcttcaaagaaatcttagccggtaaatatgaccatcttccagaagatgcattccgtcttgtaggccgtatcgaagaagttgttgagaaagcaaaagaaatgggtgtagaagtttaatctggtcctaggagggtaaaagcatgaagaccgttaaagtcaatatcgttactcccgacggcccagtatacgatgcggatatcgaaatggtgagtgtgagagccgaaagcggcgatctcggtattttgccaggccatattccaaccgtggctcctcttaaaatcggcgctgtccgtctgaaaaaagacgggcagactgaaatggttgccgtcagcggcggttttgtagaagtccgtcctgatcatgtcaccatccttgcccaggctgccgagacagcggaaggcatcgataaagagcgcgctgaagctgcacgccagcgggcgcaggagcgtttgaattctcaatcagatgatactgacattcgtcgggctgagcttgcgttacagcgggctttgaacagattggatgtagcagggaaataagaaaaaatccttctctttatgagaaggatttttttatgaacgcacaagagaatcaaacagcgacagcaacgggcgatcctcttttggacgcaggtataaaccatcacaggcattcattgtatgccacgatttgcgatgtcttctaaagccaagtgtataagcgccgtctttatagggataaggttttacaacccattcagcatcttcatggcgggcaatcacacaatctataagataaacactgatcattttctcgaattcttcaataggaagattccaatcagcaagcaaaagttcttgtatactttgaaaatagaggttttcaagctcttcaaggctttctctcgtataggtaagagaaatgttaaaaaactgacacaattcattcagttcttcaatctgtgactgtctataatcataatagaatgcaattgcttcccattcctgatcaaaaattggcaggtcctcaccatattgcttttcaggctgaaaaaaagaatgattcacatttgccagctcctttccaataaagtataccatgtaaaagaatcgcactttaagcggggattagccctagatttggctgattattccgttctgtataaaatgtatcatctttatctgtgcttcttatataataagaaagggtatgaacgcagagaaaggagtgtaatagatgagtgtattgggacagcaggctgcaatcggcattgtcgttcacctgatttttatagcagtgacttggtgggcgttgcaagccgtcaatatagatccgttaatcaaaaaaggcaaagtcgtgcaggcaagactcctgatgattttgctgacaatcgccattggaacggccgttgccaatttctttttagattacctcaattattcacagcagcttccctatctattttaataggttttgaacattattaaatggtttggagaagcgggttgaagcgaatagctcgagttttgacgaagatttttacgtatggcgcctcttgcctccggtaaaactggggataagggggagagatgaacatgaagaaaaacaagtaagccacgctattatcatttccgtcatgttaagcttcgtcattgctgttttccataccattcatgcgagtgaattaacgccgttagcacagatggcagaggggatggaacgtcaagatgtgtcaatagataagtggacattgcatgcaaaacaaaacttgtcactgaccgaaaaagaattttatcaaaaagtgcaacgtttaaaacaagagtatcgtcaatatgattgggtgattgcacgggaagataaaatgataaaggcaattggcacatatactgacaaaaaaaatcgtacttcttttagactgcagcttgtcacaaccctcaaaaaacacaatccaacttcgtatttattatatgagcaaatgagtctagagacaccggatagctggaatgatacatatgaacagtttgaacgggagacacttgggatattccaagaaaaagtagttatttttacttgtctaaatggtcacttagatgataatatgaatattgttttgcaaaaaaagcaaatcagttattaaatgaatttcaagcaagatcagtagaacatgtagttgagccaaatttcgtttctatttctgcgtttacagatgagtgggaagagtacattatgacctcgaaacataaaatgaatttgcaaattgcacttagaagtgcaggaatgggcggaaaacataccgttacggttggcacaccaatcgttacgactgaatattaatatagagaatttagggacgcggaggggaataccttggaaaaaatcatcgtccgcggcggtcagaagttaaacggcacagtcaaagttgaaggcgctaaaaatgccgttttacctgttatcgctgcatctttattagcaagtgaagaaaaaagcgtaatttgtgatgtacctacgctctccgatgtatatacaattaacgaagtgttgcgtcatttaggagcagatgtgcattttgaaaataatgaagtgactgtaaatgcttcatacgctttgcaaactgaagcaccttttgaatatgttcgtaaaatgcgtgcgtctgtgcttgtcatggggccgcttcttgcgcgtacaggtcatgcaagagttgcacttccgggcggatgcgcaattggttccagaccgattgatcagcatttaaaaggttttgaagcaatgggcgcagaaatcaaagtcggtaatggcttcattgaagctgaagtaaaaggccgactgcaaggcgcaaaaatttatctggacttcccaagtgtaggagctacagagaacctgattatggcagccgctctagctgaaggaacaacaacgctggaaaacgtggcaaaagaacccgaaatcgttgatttagcaaactatatcaacggcatgggcggaaaaatccgcggagctggcaccggcaccatcaaaattgaaggagtcgaaaagcttcacggcgtaaaacaccatattattcctgaccgtattgaagcgggcacatttatggttgctgctgcaatcactgaaggaaacgtattagtaaaaggagcggttcctgagcacctcacctctttaattgcaaaaatggaagagatgggtgtaacaattaaggatgaaggtgaaggtctgcgtgtcatcggcccgaaagagcttaaaccgattgacatcaaaacaatgcctcacccgggcttcccgactgatatgcagtcacaaatgatggcgcttctgcttcgtgcaagcggcacaagcatgattacagaaaccgtttttgaaaaccgttttatgcatgcggaagaattccgccgtatgaatggtgatatcaagattgaaggacgttctgtcatcattaacggtcctgtacagcttcagggagctgaagttgcagcgactgatttgcgtgcaggtgcagcgctgattcttgcggggttagtggctgaaggtcacacacgtgttactgaattgaagcacttagaccgcggttacgttgatttccatcagaagcttgccgctctgggcgcagacatcgaacgtgtaaatgatgagtctgcttctgagcaagagaataaagaagtcgtttctgacttaaatgcataaacttacttgaaaatcagtatgtcactctggcatactggttttttattttttgtgtattatcatcattatgcgcaaaatagcaaaaaagaatacgtaaatgacaaataaagtttctgtccaaaacgagagtcatattagcttgtccctgcccatagactagactagagtcgaatcccgagcaggaggcagctgaatatgaaacaattcgcaatcacactatccgtactatgtgcattgattctcttggttcccacactcttggttataccattccagcataataaggaagcgggggccagcgtagaatcagaaaagacagcagtcagcacgaaaccagcatcgaaaggagcagaaacattgaaagcatcacctgtttctattcccgtctatcgaaccgcaaatcaatccgtagaaaacattccgcttgaagagtatgtgattggagtcgtcgcctccgaaatgccggcaacctttaaacctgaagcgctgaaagcccaggcgcttgccgccagaacatttattgtcagactgatggtgtcaaattcagcggtagaagctcctaaaggctcactggtggatgatacacagatgttccaggtgtataaaagcaaagcggagctgaaaaaacagtggggcacaagctatgagacaaaactgaagaaaatcacagatgcggtagccagtacgcaaggcaaaatcttaacgtacaacaaccagccgattgaagcatcctttttctccacaagcaacggctacacagagaatgcagaagcttattggacaagtgctatcccatatttaaaaagcgtcaaaagcccatgggataaaaagtctccgaaatataaggcaacgaaaacctttacagcggcagaatttcagcaaaagcttggcgtcaagctggatggatctagcgcagtagggaagattaccggcgagacaccgggccaccaggtcgcaactgccgtcattaacggcaagacgctgaaaggaagagacatacgtgaaaagttgggtctcaactccgccgattttgaatggaagcgaaatggagacacaattacagtcacgacgagaggatttggccacggtgtggggatgagccaatacggagcgaattttatggccaaagaaggcaaaacggttgatgacattgtaaagtactattaccaaggcacacaaatttctgaggcagatgcgtttttgaataaatatatggcgaaaaagtagaaaaagacgctcattgggcgtctttttctgttcctgaatatcttttatctaagagtagctgaaacggtttagaggagcttctgaccgtctttaaggatcagtccttttttcctgatttcaggctttgagattgtggtaaagtcatccacatttgtcgacagacttcgacagactcatataacgaaagccgaaaggcggacaatcttctcttttcataggggcgttaggtggaaatcactaataaaaacataggtttctatgcaaaagtaaacaacagcaatggggaagcccgccctatttatttctcggtttttgttgattacgatagattatgttcagcgttgaacatctgcacgcagaaacaaattggtaaaggggtacgaacatgaagaaaagattttcactgatcatgatgacaggattgctttttggattaacttcacctgcttttgcagctgaaaagacagaaacggaggctaaagcgccggcgaacgtggcggtcttgcttgatgccagcggaagtatggcgaaaagaatagatggtgtatctaaatttaattcagccaaaaaagaaatttcaaagtttgcgagctcattgccagaaggaactcaggtgaaaatgagcgtgtttggctctgaaggaaacaataaaaattccggaaaagttcagtcatgtgaagccattcgcaacgtatacggcttccaaagctttaacgagcaaagcttcctcaattctctcaatacaattgggccgactggctggacgccaattgccaaagcgctgaacgaggcgaaatcttcttttgaccagcttgatgcaaaaggggaaaaagtggtgtatctgttgacagacggtgaggaaacgtgcggaggaaacccgattaaaacagcaaaggaactgcaaaaagacaatatcactgttaatgtgatcggctttgattataaagagggatacaaaggccagctgaacgcaattgcgaaagtaggcggcggtgaatacttcccggcttatacccaaaaagatgttgagaaaattttcactcagcaatcactaatgttatctaaataagaaaaaagaggctggtgatggtcagcctctttttgtatgtaacaaaaacttcaaaactaattagctgtctgcctgtagcatagtagcagatttccgtttttctgtcataatcaaggcgaaaaaagaatgaatgatcacacaagctgtttatgctttctgggcggaaatggctaaaaatgaacggcatttcaagcgattttggacagatcgtgaaagcagcacaaaaggcagcatgtcctatatctttttgcattttcgtattctagcataaagaagaatccaacatatagttggaaaatatgaaaaagaaaggaagtaatcatatgaaaaaattgctggctgccggtatcattggattgttgactgtttccattgcctccccgtcttttgccgctgagaaacaggctgatacaaatgtagctgttttgtttgacggaagcggaagcatggttcaaaaaacaggaggagagcgcaaaatagacattgccaaaaaatcagtaaaatcttttgccgaacttcttccaaaggatacaaatcttatgcttcgcgttttcgggcatgcagggaacaataaactgtccggtaaagccctttcgtgcagtacgacggaaaccatttacggccttcatccatatgaagggtctctgtttgacaattcattgagtgagctcaagccgactggatggacaccgattgccaaagcacttgcagacacaagaaaagaatttgaagcatttgacgcagacgggaaaaacgtggtgtatttaatcactgacggtgaagaaacgtgcggcggagaccctgcggcggaaatcgaaaagctccgtgcatcaaatgtggatacgattgtaaacatcattggcttcaactttgatgtcaagggtaatgaagagatgaaacaagcagctgtcgctggcggcggagaatatatttcagcgaacagtgcggatgagttcgaacaggcttgggaaaaagaagcacaaaaatttactgagtaaggaacctaaagatcaggcgctcccccaggcgccttttttattggtttaaaaacagtttgggcgggaatgataccctaaaaaggggttgaacatatgaaattattcggaatgatttttcttatagccaccgttgcatttatattgcttggtgttcttctaaaactggcagccttcttttttgtcagcattctcaccttgatcgcagctattgtgctgtttacggttctgaaaaagaatcagcataatcaaacatagagtcctttatacagaggtgtctcagcgtgtcgacaaaccccgcgttcgttgtcaatgcacattggtgctcacgtgttataaaaggaacggcggctaaatgcttaggcgtcctgcctaaacaccgccgtcatcacatcctgtaaaagccctttatatagagggctctttttgtgtctcagaattcgacaaaatccgaggagtgtgaaaaaatataaaggcaggaacattgcggaggggaagagacattgaacgataaagtaactgcggtcagggatgtatggcgctatgaacaaggggaaataagcaaagtagaagaccggatggtgacggaattccctttgacagtgatactgaatggcagtgaatttgtgacgctcgtttgtacgcctgagcatatcgaagagcttgtcatcggatttctcgcatcagagggtgttatacgatttcaaaaagaaattaaaaggtttacaatagatgaaagtctcggttttgtatatgtcgacctcgttcaccctgagacattggatcaaaaggattatacgaaacgggtgatcggctcatgctgcggaaagggccgtcatttttattttcagcaggatgtcaaaacagccaagacggctgtcagccaaatcaagatatcgcctgaggcatgtctggcgcttatgaaagacatgcagcaagggagcgggacgtttcaggatacgggaggcgtccataatgcggcgctttgcgacacagagaagcttctgttgatgcgcacagatatcggtcggcacaacgcacttgataaactatacggacactgccttctaaacgggatgtccgtacgcgacaaactgattgtgttcagcggcagaatctcatcagaggtcctgttaaaagcggccaaaatcggcgtgtcgattgtcatttccaaatcggccccgacggagcttgcgattcaaatggctgaagaattgaatatcacagcgattggatttgtcagaaacggatcatttaatgtatatacacaccctgagagaatcagggagtaggaaggggctgtagctatgattacagagtcgcgtcagatgttggataaaagaaacagaccgctgagagaccttcgcatttctgttacagaccgctgcaacttccgatgcacgtactgtatgcccgccgaattattcggcccggattatccttttttaaagaaagaggagctgctttcatttgaggagctggaacggcttgcgacattgtttgtcacaagatttggcgttgaaaaaatccgcttgaccggcggagagcccctcatgagaaaggatatgccggaattaatcaaaaaactggcccgcataccgggtattcgtgacatcgcgatgacgacaaacggatcactgctgcctgtttatgctaagaggctcaaggaggctgggctgaaaagggttacgatcagccttgattctttagaagacgagcgttttaagaagataaacgggcgcggtgtttctgtcagcaaggtgctggaaggcattgaagcggcgaagcaagcggggctcggtgttaaaatcaatatggtcgttcaaaagggcgtcaatgaaaaagatatactgcctatggcccgttattttaaagaaaaagggcatatcctgagattcattgaatttatggacgtaggcaacaccaaccaatgggaaaagaaagacgtcatgacaaaggcggaaatcatagatttgatcaataaacacatgccggttgagccgatagcgcctaattatataggcgaagtggcttccagattccgctacttggacggctccggagaaattggcgtcatatcatctgtatctgatgcattctgcggatcttgcaacagagcccgtctttctgcgagaggagagctgtttacctgcttattcgcttcaagcggatttgacctcagagctccggttcgccaggaattaagtgatgacgaactatcagaaatgatcgggacagtatggaaaaatcggatcgatcagtattcagtcgatcgtacgctatcaaaagcatctggcaaaaagaaagtggaaatgtcttatattggcggttaatttgaagtcaaaagcttatcggcactgtccggtaagcttttttattagaatccgagtgcaaaaaatacgtagaaaaaccgaaatatataaggataggcataaagaaggaatcattgtaagaaaatttaattccaaagccatacattatgataaaatataaccaattagaaaatagaaagggttggaggggcatggccgcgtacgagatcccgtcatctcaagtaggagtgaaaatcaataagtggtataagcacattttagcatttcaagtggctgatgccgtaaaactgaaagaagaaattgatctagatatcgaacagatggaagaggatcagctgcttctcctgtattatcagctgatcagctaccggcaccaaattatgctggattatgtaaagcctgacctgcacgaggaatctcagcttcaatatcgtgaattgatcaaaacgctggaaagcaatcaggacagcatctccggattatctgagtattattttcacttgtttagaggaatgtacgaatttgaacagaacaattacatctcggctatatccttttatcggaaagctgagaagatgcttgcgtttgtagaagatgaaattgaaagagcggaatttcattttaaagtggcggaagtcttttatattatgaagcagacgcacttttccatgaaccatgccgtacaggcgctggagacgtataaggctcacgatttttacagagtcagaagaattcaatgccatttcgtcatatcaggaaactacattgactacagaaattatgaaaaagcgcttgaacatttagatgacgcgtatcgccttgctttattggaaggacagccccgtttgatcggatcagccctttataatattggtaattgctatgatgacaagggggagctggatcaggccgccgaatactttgaaaaagcgcttcctgtcttcgaggattatcagctggaacagcttccaaaagcgctcttcagcctgactcgcgttcttttcaaaaaacaagatagcgaagccgcgatacggtactatgaaaaagggattgccattgcccaaaaacgaaacgacttcttcagtctggcaaaatataaatttctgcaggcattatatgtggaatctgtcaatttgaatatgattcaagaagtatttgattatatggaagaaaagggcctgtatgtatatattgaagaatttgctttagatgctgcctcttatttcagtcatcgcgaacaatataaagaagcggtgtatttttatgaaaaagcggtcagcatgagagagatgattcaaaggaacgattgtttatatgaagtatgagacaaaaccatctgctggcagatggtttttttttatgcaaaaaaaggggagcatcggaacgtttatttccggggagaacaggaaaaatcgctacagcactgttttttgaacaaaagccgttttgggatgcagatatgcatgtgagggggaattcaatgtttggttttaatgatatggtgaagtttctgtggtctttcctcattgttctgccgcttgtacagattatacatgtttcagggcacagctttatggcttttatttttggcggaaagggatcgttggatataggcatgggaaaaacgctgcttaaaattggacccatacggttcagaacgatttattttatcgattctttttgccggtacggggagttgaaaattgacaatcgattctcaaatgcactcgtgtatgcagggggctgcttgtttaacctcatcacgatttttgcaatcaatctgctgattatacacagtgtattaaagccgaatgtgtttttctatcagtttgtctatttttctacgtattatgtgttttttgccctgctgccggtccgatattcggagaaaaagtcatcagacgggctggcgatatacaaggtgctccgttacggagagcgctacgaaatcgataaataacattagaatgtttattgcctctcagatcgggaagttaacaagtacacacataattgagaggggagaattaacatgggtaacgatagtgtaaaagacaaaatgaagggcggcttcaataaagccaaaggagaagtgaaggataaagtcggagatatggctgacagaacggacatgcaggctgaaggcaaaaaagataaggcaaaaggcgaaatccaaaaggatatcgggaaagccaaggataaattttcagataaagattaatcgtacggaagaggcaggaaacgaaatgtttcttgtctttttttttcgctttttctgatgtgaataaatataacaaaaaaagaagctgatttggtcaaggtaactaaattttttaaatattctttgaattaataggcctcttctatataatgatgacataagttgtaaacttttataacatcatttgaagaaatcaaacaaaggggttttgatgacggaatgtactgcaccgaagaaagtgtcggaagccacgggagtgcgagaaaacagttgatatcgacacaagcggggattcagtgaaggccggaattcttcactcattaagaggaacggtggcgatcagcgaagtgaccgtccatgatgcggagttaatggcaatagtcgggttctcggtatcgtggaggtcggcgcctcagactggcctccatgccatgcttccggttgcggagcaaaacaacgggctgccatcaggaatgtaacgtctggttatgatcaatcgatggttttgcacagccttagcttcgcccggggcagattgtcgctgtattaggccgactccggctaaacagagggggctatttgttttaatcaaacgtttgttcaaaacgaaaaggcggtcaacagcagcagcttgcaatcaccagagcgctgatggtaaatctgaaaaatattttacttaataaacaattggaaggaattcagattttaattgtcgaactagtcagacaagttattatagaaatttccagaaaaaaagacatttgttatcttagtcgagcgcagtctggaaaacgcgttaatctgatctttccgtgatcgacaggggaacggttgttgaccatggcaaggctgatgaagaaacggcatgccgctttgaaaggcatcttaccgtatgacccccattctcgaagaaagggaggtgatgtcccgcctgactgttccgcaaattcgtagtagccgcatctgctttatatgacaaaagaaggaggactacagatgaaactgacaccagttgaacaagagaaattgctcatttttgcagcgggggaattagccaaacagcgaaaggcgcggggcgttctgctgaactatcctgaggctgctgcttatatcacctgctttattatggaaggcgcacgtgatgggaagggagtagcagagctgatggaagccggccgccatgtattaacggaaaaagatgtgatggagggtgtgcctgagatgctggacagcattcaggtggaggccacatttccggatggtgtaaagcttgttacggtacatcagccaatttctgcggaggtgaagtcatgaagccgggagcatttcaaattgctgagggaaccattacgattaatgaaggccgtgagatacgggaggtaacggtaaaaaacaccggatcacgctccattcaagtcggttcgcattttcattttgcggaggccaacggggctttattatttgaccgtgagctggcgatcggcatgcgtcttgatgttccatcaggcacgtcggtccgttttgagccgggagagcagaaaacggtctcactagtggaaatcagaggacgcaagacaattagagggctgaacggaatggccgacacgtttatcgatgaacgcggcaaagaaaaaacgttggccaacttaaaacaagccggctggatggagggtgtaatccgatgaaaatgtcacgggaggaatatgcggaactgtttggcccgacaacgggcgataaaatcagattgggcgacacggatttatggatcgaagtcgaaaaggatttcacagtatacggtgaagaaatgatctttggcggcggaaaaactatccgagacggcatgggccaaaacggcagaatcacagggaaggacggcgctttggatttggttatcaccaacgtcgtgctattggattacacaggcattgtcaaagcggatgtcggtgtgaaagacggccggattgtcggtgtcggaaaaagcggaaatcctgatatcatggatggagtcgatccgcacatggtcatcggagcggggacagaggtgatttccggtgaaggcaaaattttaacagccgggggagtggacacgcacattcattttatttgtcctcagcagatggaagttgcgctttcttcaggtgtgacgacccttttgggaggcggaacaggacccgctacaggaagcaaagcgacaacatgtacgtccggggcgtggtatatggcgaggatgctggaagcggccgaggagtttccgatcaatgtcggcttcttaggaaaagggaatgcatccgataaagcgccgctgatcgagcaggtggaagcaggcgccatcggtcttaagctccatgaagactggggaacgacgccaagcgccattaaaacgtgtatggaagtcgtggacgaggctgatattcaagttgccatccataccgatacgattaacgaagcgggctttttggaaaacacgctcgacgcgatcggggaccgggttattcatacttatcacattgaaggggcaggcggcggtcacgctccggatattatgaagctcgcctcttacgcgaacattctgccgtcatctacaacgccaaccattccttataccgttaatacgatggatgagcatcttgacatgatgatggtctgccaccatttagatgcgaaagtgcctgaagatgtggcattcagccattccagaatcagggcggcgacgattgccgcggaggatattctccatgatataggtgcgatcagcatgacatcatcggattcccaagcgatggggcgggtcggtgaagtgatcatccgaacatggcaggtagccgataaaatgaaaaaacagcgcggcgctcttgccggtgaaaacgggaatgacaatgtgcgcgcaaaacggtacattgccaaatacacgattaatccggcaattacgcacgggctcagccatgaggtcggctcggtggaaaaagggaagcttgctgatctcgttctgtgggacccggtatttttcggcgtgaaaccggaactggtcttaaagggcggcatgattgcacgtgcgcaaatgggagatccgaacgcgtccatcccgactcctgaaccggttttcatgcgccaaatgtatgcgtcttacggaaaagccaaccgctcaacctcgattacatttatgtctcaggcaagcatagagcgtggtgtggcggaaagcttagggctggaaaaaaggatttctccagtcaaaaatatcagaaagctgagcaagctggatatgaagctgaattcggctttgccgaagattgagattgatccaaaaacctatcaggtctttgctgacggggaggaattgtcttgccagcctgtcgattatgtcccacttggacaaagatatttcttattttgataagacgcggccggagtgcatccggccgttctattgactaaaaacggtgcacaaaacccatgtatttagtgtatattagatgttgacaaacgaatcaaatgtaactattatagttacaacggtggtgaaaaaacatgattaacagccgtcttgctgttgccattcatattttatccctcatctcgatggatgaaaaaacatcttcagaaatcattgcagacagtgtcaacacgaatccggtagttgtgcgaagaatgatcagcctgctgaaaaaagctgatattctcacatcacgcgccggggtgccgggtgcaagcctcaaaaaagatcctgctgatatttctcttttagaagtgtaccgggctgtccaaaagcaagaagaactctttgcggttcatgaaaacccgaatccgaaatgtccggtagggaaaaaaattcagaacgctctggatgaaacgtttgaaagtgtgcaaagagcgatggaaaatgaactggcaagcaagtcattaaaagatgttatgaatcatctcttttaatcaaaagggatgacttctcaccgctaacatgtaactaaaattgttacaaataaggaggaaatgaaaaatgaaaattggtattataggcgcaagcgggaaagcgggaaacgagattttgaaagaagcgaaaaaaagaggccatgaagtgacagccatcgtcagaaacgcttcaaaagtgcaggagcaagacgtagcgattttggaaaaagatgtgtttgaactgactgcggaagacatcaagcctttcgacgcggtcgtaaacgcttttggagcagcacccggccaagaacatcttcatgttgaagcaggaagagcactcatcagcattttaaaggacgcgaagcacacaagattgcttgttgttggcggagcgggaagcctgtttgttgatgaagccaaaacaacccgtttaatggatacgccggaatttccgaaagaatatttgccaactgcatcaaatcaaggcgagaacctgaaagatttgcagcagacagactccatttcctggacgttcctcagtcctgcggcattttttgatccagcaggaaaacggactggctcttaccaaaaaggaaaagacaatgtcatcgtaaatgcaaaaggagacagctatatcagctatgcagattatgccattgccgtgttggacgagcttgaacatcccgaacacaaaaatgaacgcttcacagtggtaagcgaagcggaataataaaaaacccggagccagctccgggtttttctcattaataagtgctgtacgtatcgctgaaaaggccgtcagcaatcccaagcattaaaaagatgaagaaggcgataatcgcaagaatggatacagcaatgcttacgatcaaataaatcccttgcatctttacgaatttcgcgtaattctccagcattaagtcttcagactgtccgctattgtgttcagccatttggcctgcttccctagctgacctcatcaaaaagataccggaaataatttgcagtacgcctggcacggcaccgattagaaaaaagaacgcgcctgaaagcgcggtaattgcgcccataataataaataaaatgcctgtagcttttccccatttcgaaatgctgatgagggttttgttcattgtttcaggattcatgtatactggctcccctttacaaaaaaatactcacttttcttttatacactatttgtgagaagttttgtatatagaaaataacattttggggattgaccctaacgttgcgtgattgtttacgataaaaaagaggaggtgttatgtatgaaatatcaagttaaacaagtggcggagatatcaggcgttagcattcggacgcttcatcactatgacaatattgagcttctgaatccttcagcgcttactgatgctgggtatcgtttgtacagtgacgcagacctggaaagactgcaacagattttatttttcaaggaaatcgggtttcgtctggatgagattaaagagatgctggatcatccgaattttgaccggaaagcggcacttcagtcgcaaaaggagatattgatgaagaaaaaacaaagaatggatgagatgattcaaacaattgacaggacgcttttgtccgttgatggaggggaaacgatgaataagagggatttatttgccggattaagcatgaaagacattgaagagcaccagcagacatacgctgatgaagtcagaaagctgtatggaaaggaaatcgcagaagaaacagagaaaaggacatctgcatactcggcagatgattggcgcacgatcatggctgaatttgattcgatttacagacgaattgcggcgcgaatgaagcatgggcccgatgatgcagagattcaggccgctgtgggggcatttcgcgatcatatttgccaatatcattacgattgcacactcgacattttcagaggactcggggaagtgtatatcactgacgagcgatttaccgattcaatcaatcaatatggagaaggtcttgccgcttttttgcgggaggcaatcatcatttactgtgaccatcaggaaaacccccggccgtaaaggccgggggtttacgcatcttataagatcggcgacaacagccgcgagacggattcttttattcgaatccacaacgggcgctgcagatactcctcataggtgaattttctggatactagcaaatcttctttaaaagttgaaaccagttttttagcaatggtgatatcgtaaataaatgcattaacctcaaaattcagcctgaagcttcggacatcaatgttcgctgtgccgactgaagcgatttcgtcatccaccacgatggttttcgcgtgaataaagccgttatcgtaaatatagacagtggctccggctttcagcagatcgccgatatacgaaagtgtcgcccagtatacaaaggcgtgatcgggcttgttcggaatcataatgttaacgtcaatgcccgaaaggcaagcgatccttaaagcatccagcaggcttgcatctgggataaaataaggtgtttgtatcaaaatggaacgcttggcgttcgaaatcattttgatgtagccatttttaatttgttcccattccgaatcagggccgcttgtgacaatctgcatcccgacgttgccttttgggccgtaatcaggaaagtgatttggaatatatgtcagcgtatggtgatgagaagcttggttccagtcaaggatgaatcgtgtttggatggcgtgcacggccgttccttgcagccggatatgcgtatcccgccaataaccgaatttcggattaagccctagatactcatctccgacgttaaagcctccgacataaccggtcataccgtctatgatcacaagctttcgatggttccggtaattcagccgcaggttaatcggcctgagctttgacgggaaaaagacctccacatgcccgccagcctcgcgaagctctttaaaaaacttttttctcagcgttctggacccgagttcatcataaagcactctgacctgaacaccttctttcgccttttggatgagagcgtcccgcaattttttgcctaattcatcgcctttataaatataatactgtaaatggatatgatccttagcctttgaaatgtcactcagcagccgctgaaatttatcccgtccatctgtaatgacgtcaactgaattatcctctgtaaacacagcatggttattcataatcagcatataaattaaatctttgttatcaaaggttgcccggttgttaaactgaaattgcttggtttctaaatcttcaagctgatgcttcagcagcctttcaattccaatctttttccggtcttcccattgaaacaaatgcttgcgtctgagattatggccgaataataagtataaaataaagcctaaaacgggaataaagaaaagaacaagcagccacgcccaagatgcactggcatcgcgccgttctttgaagatgacaatgatggccaaaagaatatttaaaatgaaaaaaagtgataaaaggatggaagaaatactcactttgtaaccccgctcattcatatttatcaagaagattgccattagtattccatgaataacagtgatctgattcccattacaaattataacactcacattttaaaagaataaagagcggcgatccagattcttcgtgaaaaatacgggcagatttctttaaaaccagcttgcacctgcgttaaaataaacacatatgataacgttcgtgaagcttgaaacatcaaataaagggggaggattatatgaacttttacagagtcgaacaaatgccggggttcatcaaaacagaaatgcaaaaaattcaaaaggccgtacagcctttcatgaaaaaaaccgtcatttaccgttttcttgctattccgcttgctgcattctctctctttaatttagctgcttttctatttcatgcttcagctgacagggagtccctgatcagcgcaggcatattcgcccttttggcggcgctcgggctcgcatttttttaaagaggcaggctatcagcataaacaaatccaaaaaacggttcacatctatatgctgaacaggatcaaaaagagcgaaatcctttcagaagagcggaaaagctcctacgcacgacaaataaaggaagagccttttgcgatgcggagttttgttgaatttttgactgaggaagacagacgcaaaaaaatgtattaaagaagatctgcacccggattgttgagattttccagacgatccgggtgtgtttttttgcatgcagacacccgaaataaaaagtgcggtttcggattgattccgacttcatccgtttttttgatattcatttctgggtaacagcgttgctttgttgatttcctctactagagatgtctattgtatgcttgcttcaggatttggtgtttacgccggcctgctttgaatagtcaaataaaataggcatggttccgtttatatggaactcatgccctgtcctgtctcatcattattcaaacaccggatcatcctcataataataagaatccggatcatcatacgaaggcgtgttctcaaaagcagcaatgccgattaccaccagcacgaaaatggctacaatgatcccgatcaggacagtaacgatactggatgctgcataaaacagctgcatttttataaatgtcccgtaattttcaagcatgctttcgccagcgctgccggttagatttccttcggcttccgcggctgcttttgctgagcgcatcaaaaatacgcctgaaataatgagcagtacgcccgggatggcgccaatcactgtcatcaaaacagacagagtgacaagcgatcccataatgattaacaagatgccagaaattttgccccacttggcaatgtcggatagcgacttgacagcggaggcgctcagctggcggctctcctgtccaacaggtgcagtctcctgttcaacaaggctattttcttcattatgatgttcaatttcgttttcatctttatccagactaatcatgaaagctctctccctaaaatttttaaatcgtatcttttcccgtccatttcggcgatgccggggaatagtccccattctgcaaacccgtgcttttcaaacagcttcaggcttggtttattatgcccgaaaatgaaggccataagtgagcggatgccaagattcggggcaatgcggagcgcttcttgaagcaaatatgatccaacacctttgccgcggcatgcttcgtcaatgtatatgctgacttccgctgttttattataggctggccttccataaaatgtttcaaagctgatccaggcagcgacgtttccgttttcatcctcggccacatagagcggacgtgactctgtatgtcccgaaaaccattccatccggtcttcaggagttaccggttcggtatcggctgttaccattcgagaagcaatcgttgaattataaatcgccacaacagcctccaagtctctatgttcagcaagacgcaatgtcatgttcatacgtttttggcactcctctcaaaaaaatacatattttcgttcagtctgtgcaaactacatctaaaaaagtttttttggataggttgtatatattttcagaaaagtgttcagaatgttgctgaggtgatgaaacaatgagagaggaagaaaagaaaacttctcaagtcaaaaaacttcagcagttttttcgtaaacgctgggtgttccctgcaatttacttagtcagtgcggccgtcattttaacagctgtcctttggtatcaatcagtatcaaatgatgaggtaaaggatcagttggctgataacggcggaaactccgcatatgacaacaacgacgatgcagttgaagtaggaaagtcaatggaaaatgtcgcaatgccggttgttgattctgaaaacgtttctgttgtgaaaaagttctatgaaaccgatgccgcaaaagaagagaaagaagcagcactcgttacctataataacacgtacagcctaagcaaaggaattgacttagctgagaaagacggaaaagatttcgatgtctctgcttctctgagcggtacggttgttaaagctgaaaaagatccagtgctgggatatgttgtggaagtagaacatgccgacggtttatcgactgtgtatcaatctctttccgaagtaagcgtagagcaaggtgacaaagtaaaacaaaatcaagtgatcggaaaatctggcaagaacctttacagtgaagacagcggaaaccacgtgcactttgaaatccgtaaagatggggttgcaatgaatccgttaaactttatggacaaaccagtttcttctattgaaaaagctgccacccaagaaacagaagaatccattcagcaatcttccgagaaaaaggacggatcaactgaaaaaggaacagaagaaaaatccggtgagaaaaaggatgattcaactgacaaatctggttctaaagaaagcagcacaacagaagacactgaacagtcttaatgaagaaaacgtctatccttgtgatgggcgtttttttctgttactttttgctttgttttaccgtctatgtagttacatgtaggcacgtacgttataaaggaggttatgtcatgaaccgcctattgctcgcaggctggatcttttttatcctgctttctgtctgtacggaaagcttcagcggcatggtcgtatcgcaaacggtggcttttcattttcagccgcaccctgatctgtctcaatttttagttatggattttactgagcttactgtacctgaagcgtttattcaaaaaatcggacacgcgttttccttctttgtgctgacatatttgctgtggaaacagcggggcagcataagatcagctgcagccggctcatttgcgtttgcttttttcacagaagttcttcagctcttcttcagcaggaatggttgtatccgggatgtgctcatcgatgctgttggaattgggttgttttatggtttatatgtgttggcgaagcgaagaaaacaagagatgtatgagaaatattaaagccggctgtcttgatttcagacgccggcttttgtctttcttagaaattttgatcggttggttttttcgtcagtttattgataatggcttcgtagatcctcacgaccaaatcgacgaacgggcgaagcagatctgaaaatctaaagaaaaggaacccgataatgatggcgacaacgaggctgcccaatacatctaccggatagtgatgtcccacccaaattctcgaaaagcctgtcaaaagcccaaaaatgacaagcggccagccgattttgcggtttctgaaaagcatcgcaatagaaatcgctaatgcacctgtcgtatggtcacttggaaatgaagcatccgcagcatgcggaatcagtgtatgcactgtatgcgcaacgaacgggcgcggttcgaaataaacaagcgtaatcaaatagttgatcacaaggcctgcaattcctgtgatgcctgcgtatagcacatgttttctgctttgtgtgttcccaaacagccagattgccaataggataagggcataggcgacaatggcatattccgtgatgaagaccataatggaatcgagaactgaattgtgatgagatagtccatggattgctttaaaaatttcgtagttcaaataatcaccttttacatttttatatttagtagactaatcttactcatgaaaagtttcaaataaaaatagagattgtctgaaataacggcgcttgaagagaattcgaagaggaatcgcggtttctggggggattctgtgcacaaaaaaagagatccggagtgtccgaatctcgtaccgatattaaagtgcttcaggtccttcttcgcctgtgcggatgttgatcgtattgctgatttcatagacaaatattttaccgtcacctggtgatcccgttttcagcacccttttagcggtctctgtcacttgatcaacaggaaccttgctgaccacaatttctatttttaaacgctcgtatacattgctttctatttttacccctcgatagagctccgtatgtgctttttgaaggccgcagccgtgtacattggagaaagtcagagaggtcactccgatttttccgagttcctgcttcagcttttcaaaatttgccggacgcgttacaatttctaccttgaacatttgaccgctcatagcgtcactcctcacatagaatcttgatatgctttttccccgtgcatcgttaagtcaagcccaagtgactcttcttcttcagttgcgcgaaggggaaggaagaggcttacaattttaataataacgaaagtgacaataaatacaaaaacataagtggcggcgatggcgacgatttgtttccagattaagcttgcatcaccgtaaaataacccatctgcgcccgctgagttaacagaggttgttgcgaataatcctgttgcgattccgccccatgtgccgccgatcccgtgcaggccaaaggcgtcaagcgcgtcgtcgtatccgaatttctttttaagcgagaatactccccagaaacaaacagctccgccgatgatgccgataataatggaagcgaacggtgtgacaaatccggcagccggcgtaatggcgacaagcccggcgattgccccagataccgctccgagcattgtcggttttttgttaatgatccattctactaagatccagccggcgatcccggctgcagccgcggtgtttgtgttgatgaacgcgtacatggctacaccatctaaagtcaaagcgctgccgacgttaaagccgaaccagccgaaccaaatcaaagctcctcctaagaaggtgtaaatgaggttatgcggagaagacgctgtaccgtctttccgtttgccgagcacaatggcaagaacaagtcctgccacaccggaggaaatatgaacaacattgccgccagcaaaatcgagcgctccaagctggccgatccagccgccgccccatacccagtgcgctacgggtgtgtaaaccaaagaggcccataaaaccgagaataaaagaaaagcgccgaatcgcatccgctctgcgaaggccccggaaataatcgctgtagtcagaacggcgaacgtcatttggaacatcataaataacgagtgggggatggtatcgctgtaatctcccggatcaaatccgacccctttgaggccggcccactccagcccgccgatgattgaattgcctggtgcgaaggcaagtgtatatccgaacagcacccaaacgatggaaacgatggcaatggaagagaaactgtgcatggcagtgctcagcacatttttgctctttaccattcctccataaaataacgctaatcccggggtcatcagccacacgagtaaagcgcaaaagaacataaaaactgtatcgcccatttgcatgtctcattcctccgtatctttcagaataaaaagcaattattatatttcttcattatagagaaaaaagaatgataaaacattttcatgtaagatttcctgacatggtttttaaggaatgttatcgagggacggaaagaaaggagaacggcattttttacgatataagactttgtatctataaaagaagctattcatatgagctgaaaagggaattgacattaattagaatactctatactgtattaagtgtactatatcaaataatacactgagggggatgtatgatgaagaaaggcggcaggctgaggaaagcggtacgcaagtcgattcccgcgacgttccgattgtttttagcctttaattttttcgtgtacggtctggcgaaagtggtaattggccagtttggcgaggtgacgcctgaaatcgaggcggctgccgggaaggggtttacgatcgtgtggacatttttcggttattctcatgtctatgaactgtttataggttttggtgaaatcctggcagctgttttattactgattccgcgaacggctgcattaggggcggttatttttatgcccattattgtgaacatcgtcttgattaactattgttttgatattggcgtgcaggatcttagcacgatattaatggttatgtgtcttatcctgctttggatggaccgccgcaaattcatgggcattttcaggcaggaaccgatagacagcaggcaggtgatgaagcgatgacgccccttatgattacagtgcttgccggtttgttcgtatgcacaacctgttactactacataaaagaaaaatcatgagaaaacgttccttctgagaatttcacaagcatcataaaagaacttaggcagtgtgaagagtaaaatatgcaatgtgagaaacactaacagtatcaggaggagacgtatgatgaatacactcaacattgattttcaaaaaacagcattggttatcattgatttacaaaaggggattgtgccgattgatcaaagcggccaggttgtcccgaacgcgaaaaagctcgtagatgaatttcggaaacataacgggttcatcagctttgtaaatgtagcctttcatgatggagcggacgccctgaagccgcaaacggatgagcctgcgcagggaggttcaggggaaatgccggcggactgggccgaatttgttccggaaatcggtgtgcaggatggcgattatactgtgacaaaacggcaatggggtgctttttttggcacagatttagacttgcagctgagacgtcgcggcattgatacgattgtattgtgcggcatcgcaacgaatatcggggtggaaagcacagcacgggaggcatttcagcttggctatcagcagatttttattacagatgccatgtccacatttagcgatgaagagcatgaagccacactgcgctttattttcccgagaatcggtaaatcgcggacaacggaagagtttctggaacaagtgaaatgatgttatcgaaaaaaagccgagctgtttttttaacagctgtggcttcgggaacaatgctgaatccgctgaactcgtctatgatctctcttgcgctccatagcatccagcatgagtttcacctctcgtttacaacggtttcctggctgatttcctcgttttacttggcgagtgccgtagcgcagcccgtaacgggaaagctcggtgatttgattgggcggaaacgcttgtttttattcgggcttattcttgttgcggtttctgccatcggggcgccgtttgcgccgacgtttatgacattattggtcatgcggctgtttcaatcggtggggagcagtgcgatttatccgtcaggtgtcggcttgattcggaatcatattcatgagcgccaagcttcagccttggctgtactctctatttttgcgtccgccatgacggcgctggggccgacagccggcgggtttttgattgtatggggaggctggccggcgatctttatcgttaatttgccgtttattatcctcagcttcttattgggcctgtatatgttcccgaaagatcagaaaaaaggggcaggaatcaaaaccattattcggcagctcgatattcttggaattgttttatttgccgggggaatcattttccttctatcctttttgctgtcgttcagcacgtcgccgcatgcggttgaaggtgtgcttggcttgcttctgctctgtgcgtttgtctggcgcgagctgaaaacggataagccgtttattgatgtccgtctgtttaaaacacagcgaaacctgtcagccgtgtatgttcagtttattttattgaatgttttcttctattgtttattttttggtttgccaagttactttcaggatgaaatgcatctttctgttcaaacgagcggcctgtttatgctgtttatgtctggaatgagcatcgttgtgtcacctctaaccggcaaatggatcgaccgatctggtgtcgtcaagccgatctttgcgggagcgcttttgatgacggctggagccgtgctcttaaccatcttttttatcaatgtccagaccatcggtaaaggcctcattctgtcgctcttgggtataggctacggactgggcaatgtcgcgcttcaggcagcgatgctggaaacgagtccttccaacatggtaggaacgacttcaggcctgtttcaaacctgccgttacctaggatcgattttgtcttcggtgatccttggcattctttttggtaaagaaatcacggcagcccattttgatatgatgggaatcattatgattatagcgggcggagcaagcctgttaatggctgtgagatttgctgcattaatgaaaactgcatcttaagaaagagacgggctctgaggtctgtctctttttcttgtttaagctgttcaaatacaaacgggaaaattgtatatcatagccagtgttattgtctgactcttcagttatattaagtgacatctaatgtcaaaaaacataacgtgtgacgacatatagacaatatggaaaggggagccggctatgaaattaaaagagagtcagcagcaatccaacaggctgagcaatgaagatctggtgcctttgggacaggaaaaacggacgtggaaagcaatgaactttgcctccatttggatgggatgtatacataacataccgacctacgcgaccgtgggaggattaattgcgatcggcctttcgccttggcaggtgctggcgatcattattacggcatcacttatcctatttggcgctcttgccttaaacggccatgcggggacaaaatacgggctgccgtttccagtgatcattcgggcttcttacgggatatacggcgcgaatatccccgcgcttctaagggcgtttacagctatcatgtggcttggcatccagacctttgcgggtagcacggcactgaacattttgcttttgaatatgtggccaggttggggagaaattggcggcgagtggaacattctcggcattcacttgtccggtttgctttcctttgtattcttttgggccattcatttactcgtattgcatcacggcatggagtcgattaaacgttttgaggtgtgggcagggcctttagtgtatctggtatttggcggcatggtatggtgggccgttgatattgctggaggattgggcccgatatactctcaaccaggaaagtttcatacgttttcagaaacattctggccgtttgctgccggagttactggcatcatcggcatctgggcgacattgatcttaaatatacctgattttacacggtttgctgaaacacaaaaagagcaaatcaaaggacaattttacggtttgccgggaacgtttgcgctgttcgcattcgcaagtattacggtgacctccggctcgcaggtcgcgttcggagagccgatttgggatgttgtcgatattttggcgcggtttgataacccttatgtcatcgtcttgtccgtgatcacactctgcatcgccacgatctctgtaaatgtcgcggcgaatatcgtatcacccgcttatgatatagcgaatgccctgccgaaatatatcaatttcaaacgtggcagctttatcacagcgttgctcgctttatttacggttccgtggaagctgatggagagcgcgacaagcgtgtatgcgtttcttggcttaataggcggcatgcttggaccggtggcaggcgtgatgatggccgactattttatcattcgcaaacgtgagctctcggtagatgacctgtattccgaaacaggacggtatgtgtattggaagggctacaattaccgtgcgtttgcagccacaatgttaggagcgctgatttcgctgattggcatgtatgttcctgtattgaagagcttatacgatatttcttggtttgtaggtgtgctgatttcctttcttttctacattgttctgatgcgtgttcacccgcctgcatcattggcaattgaaacagttgaacatgcgcaggtccgccaggctgaataagatctatttagacggtatattttcatatttttgaaatggttttccataaatagaacatttataatggttttagaaatctattctaaaacgaaatgggaatcgaaaatgagaaaatggtattttattcttttggcgggtgttttaacgtctgtcatcctcgctttcgtttatgataagacaaaagcgaatgaggaaggatctggggattatctgtatgtttcgccaaatggcagtgatcaaaatgaaggaacaaaagaaaagccgtttcgtacattggcacacgcatctgagaaggctgctgccggcacaactgtcatgattcgggagggcacgtatcatgagacccttgatgtaaagcacagcggtacggacggaaagcctatcacattccgaaactatgaaaatgaaaacgtcgtgattagcggtgaatccgttgcgaacgctgaatatgaaacaccgcttattcgtattcacgataaacatgacattgccatcagcggtttaacaattcaagatctttctgtttcatctgaggaagcaactgctatagggatttatgtatcagggtccagcagtcatatcgccattaaggataatcacatccgggggattaagacaacagcggatgaaggaaatgctcacggaatcgcagtttatgggactggcagcatgaaagacatccgaatcgaggacaatacagttgagaaactgacgcttggagcgagtgaagcagttgtgctgaacggtaatatcgacggcttcacagttgcaggcaatgtggtccgcaacaataataacatcgggattgatctaattggttatgagggaaccgcggataaaaacgattacgtgcgaaacggagtcgtagaaaacaatacagtttatcaaaactcgacttacggcaatcctgcttatggagatgaatactcagcgggcgggatttatgtcgatggaggacacgatatcgaaattaagaacaacacagtttacgataacgatattgggattgaagcaacgtctgaacacaaaggaaagtatgcaaatgccattcagatcacagacaacaaagtgtacaacaatgcgtacaccggtatttcaatcggaggatatgacaaaaagcggggcggcaccagcaattctctgattgcccgcaatattatgtaccggaatgacacaaagggactgtacggcggacagctgctgctgcagtacgatacgaaaaacaacacaattgaaaagaatatattgacggccggtgattccagattatttatcggaaacgactttacagaaaacgaaggtaatacggtcaatcataacgtgtaccacaaggaagcggatcaagacggcatatggatgtggaaaaagaaagaatatgattcattttcttcgtatcgaaaagcaacaaaaaacgatcaacaatccatatatgccgatccgatgtttcgtgatgaagcgtcctatgatttttcgttagatcctgattcacctgcgcggcctgtcattgaataattgctataagcggcgttctctcgttcaaccgagagggcgccgtgttttaatggaaaaaagactgccgggatttcccggcagtctgacaagttattctgcaatagacacttttccttcagcctctgcaggttttttctggctccacgtgtagagaagcagagcaattaaaacgaacagccccgctgttaaataaatggcagagaagccggcagatgctacaaacaatccgaatacatacgatcctacagcaattccgctgtcaaagaaggtaaagaacgttgccgtcgcaaaaccggagcggtgagccggagatttctgaatcgccaatgtttgcatgcaaggaacgattgatccgtagccaagaccgataaccgcccctgaaagcagaagcattaagccgctatgtgtgaaggacagcatgcagagtccgacagagaaaatcaggattgatggataaatgacaatgcccggtccgactttgtcgaacaatttccctgtgaacgggcgtgcaatcatcattgtcaccgcaaaacaaacaaagaaatatccgctgatatccgaaaggtcaactgatttggcgaatacagacagatatgatgtgactgttgaataacagaaagaaataaacaaaccgaccgtcgcaattttgagtgcgcccttttcaaacatatccgagaacgcaaaacggaatacagtcgtgccgctgtccttactttgcggcacttttatcaagaacgaaacaagtaagcccgcaaccataaacagcgcaaaggctgtaaagaatacaggaaagcttaccactctcatcaaattcaggccaaggaaaggcccgatcgccatagcgaggttcatagacatggcaaagtatccaagcccttcaccgcgccgtttggctggaataatatcagcggcaattgcacctgtaacagtcgttaaaatgctgaaccaaatcccttggaagaaccgcaatccgagcagcagggaaaagttatgaatcggcatatacagaaaagatgatagggcgaagagcgccattgatacaatcgccattcttttcttcccgaaacgctcaacgatggctccggagaaaggccgtgtaatgatcgcagacagaaggaacaggctgattaaaagcccgccttgtgattctgtgccgccaagctcttgcagtgtatagatcggcaatacagttaaaaatgtataaaagaacacaaacacaaataaattgacaagcaggaccataataaaatccttggtccatatcgcatccgcttttttcaaatgtatgtcacttccttattttcattgttgtaaaaacatgcggaataaatgagaaaaagcttctttatcttcatcccggaaatctgcaagcagctcttcctcgaatttcaacattttcacattgatttcttcgtattttttctcggcttcttttgtgaggacaacaagtttttcccgtttgtcttcaccttgccgtctctgaacccagccgttctcctccaggcgtttgatcgtccgagtcacagtcggcgcttccacatttaaataggaccaaatctctttttgagtcattggtccgatcgtacgcaaacaatataaaactgaccattgagatgaataaaggccgaatggctctagctgttcattggctttcttggcaatcaggcgggcgctttggttgatttgatgaatgaggtgtctgttgacgtaggacatgtcggtctccttctaaaaaacttacctaagtaactaattgcttatttcattttacaggagcgatcaatagttgtaaagatgaaaatttagtgacgcgaaatagtttgctgaatctgaaaaagttcgtttcaccccttgtccttattgagtttttagcatattcccaaaagaatgctaatacactgttacaaacctaacaaagagagtgtttgaggtgagggatcgtgggcatatttcacaaacttacttttaaaaccatacaacgaagaagcggcataatgaacgactctttacagaatacggatctcatttcacacttctcacatccattttagggaggtcgagtggtgtgcacgattacatcaaagagcgaacaatcaagatagggaagtacatcgtggagacaaagaaaaccgttcgtgtcattgcgaaggaatttggtgtttccaaaagtacagtacacaaggatttaacagagcgtctgcctgaaattaaccccgacttggcaaacgaagtgaaagaaatactcgattatcataaatccatcaggcatttaagaggaggagaagcgacaaagctcaaatataaaaaagatgaaattctcgaaggagagcctgttcagcaatcgtaatcacctggcattgccttcttgaaatcgttcataaaacatccgcaaaaatttgtaaagaacttattgtgcttccaactttttttctatattttatgataatatatataattagggcacaatgtggatatttactgtgaaacagattttcaaggaggatataaatagatgtttgcaagggatattggtattgacctcggtactgcaaatgtactgatccatgttaaaggtaaaggaattgttctgaatgaaccttccgttgttgcacttgataaaaacagcggcaaagtgctggcggttggcgaagaggcaagacgaatggttggacgtacacctgggaatattgttgcgattcgcccgctgaaagacggagttattgctgactttgaagtaacagaagcaatgctgaaacattttattaacaagctgaatgtaaaaggcctgttctcaaagccgcgcatgctcatttgctgcccgacgaatattacatccgttgagcaaaaagcaattaaagaagctgcagaaaaaagcggcgggaaacatgtgtaccttgaagaagaacctaaagttgccgctatcggcgcgggtatggaaatattccagccaagcggtaacatggttgtagacatcggaggcgggacgacggatatcgcggttatttcaatgggcgatattgtcacctcctcttctattaaaatggctggggacaagtttgacatggaaatcttaaattatatcaaacgcgagtacaagctgctgatcggcgaacgtactgcggaggatattaagattaaagtcgcaactgttttcccagacgcacgtcacgaggaaatttccattcgcggacgggacatggtttccggtcttccaagaacaattacagtaaacagtaaagaagttgaagaagcccttcgtgaatctgtcgctgttattgttcaggctgcaaaacaagtgctcgaaagaacaccgcctgaactttctgctgatattattgaccgcggcgttattattaccggcggaggcgcgctcttaaacggccttgaccagctgcttgctgaagagctgaaggtaccggtcctcgttgctgaaaatcctatggattgcgtagccatcggcacaggtgtcatgcttgataatatggacaagcttcctaaacgcaaactaagctgatttcacaaacctcattctgaaaaagaatgaggtttttttatgaaaaagccttcacgaaaagatgttaaatgacgataataggataaaatactgagtttttattatagaacgaacgttcctatatgacaactggaaaaaatgccatttttagaggtgggaaatttgttaaaaggattatatacagcaacatccgcaatgattgcccagcagcgaagaacggaaatgctttcaaataatattgctaacgcaaatacatcaggatataaagctgatcaaggctctatgcgcgcgttccctgagatgctgctcagcagaatagaatcaaaatctccggccgggacatcaaggacggaaatcggttccgtgaataccggagtatatatgcaggagctcaagcctctctttacacagggaagcctgaagtccacagaccagcctacagacattgcattgatcgaaaatcaagttccgatgagtgcggaaaccaatgaaaaagctgctcttttttatccggttcaaacagcggatggaatccgttattcaaaaagcagcacattttcactaaatgagaacaatcagctgacgatcaacggacgccctattttatcgacggatcgccagccaatcactgttgataatgagaatttcactgtgtctgaaaacggtactgtgacaacgaacggacgcacagccggccagattgatgtcagaatggcggaagatgtccgcaatctcaaacgggacggaaatgatttgtacagcacggcggacggtaatgatctgccaagcgcagccggaaataatcaggtagcctattcattaaaacaaggcgtctcagagctttcaaacgtggatgtgacaagcgcctatacagaaatgactgaagcgtacagatcgtttgaggcgaatcagaaggttattcaggcttacgataaaagtatggataaagcagcaaatgaaattggaaaaatttaagaaaacggaagaaaaaacgggggacatcaactatgctcaggtcaatgctaacggcatcaacaaccttaaaccagctgcagcagcagattgacacaatcagcagcaacctttcaaacagcaacacaaccggctataaggcaaaagatacgaatttttctgagcttgtcagacagcaattcgatcaggttgatgaaaaaaacgaggaagtggcaaaagcccgaaaaacgccgcccggcttgcgccttggcgtcggagcgatgatgagttcacgcctagtctctgatcaaggaagcattcagaagaccgatcgcgatctggatatcgcatttacgtctccataccagtatcttcaggtaaatgtaaatggaaaccgccagtatacgagggacggggcgctgtatgtaacgccgtccgctgcgaatgccaaccagctgcagctcgtcactggaaatgggtatcccgtacttgatgagaacggcaatacagtgaacatcgacagctcaatgaagaatatcaccattaataagaacggcaccttaaccgcatctgacggaaacgcggttcagcggtttaatcttggcgttgtccaagtgaataaccctcaagagctgaaatccgaagggaataaccttttctctattgataatgcggcagcttttgaagagctgaacggcgctaatagacaaaacatcggcatgcagcagggctcacttgagatgtccaatgtcgatatttcagaacaaatgacagatttgatcacgtcccagcgttcatatcagctgaacagcagaacgatcacaatgggagatcaaatgctcggtttaatcaattcagtcagataataagaaaatgggcgtttttcaatcagccgcgcatgataaaaaaagcggctttttcgaaatcgtcctttttttgtagtattccgtaatatcttctaacagcacttctaaatccacccacgcctcgattttttctaattcaagcacatattcgagcagctgctcataagggtcttcggctgatgtgtagagggcttcaagcgtttttaattttaaataaatggtttgaatgtctaccttttcagataattcttttcctttttgaaggacggctttagcttctgtgatgttccctgttttaaaaagcgctctgacagactcgtacacacaatgaagatatgagactggtgaattcatttcaaattcttgattctttaatacttttctaaagtaaagaagcgcttcctggtcttttttctcggtcgcttttaaaaagccaaggttataataagcgtggcatagcaggttttcgtcatgtagttgctgggttttcttaatgatttctttgaaaagctgttcagctttttcatagcgttcttgatcaatataattcacggcgagcaaaagtttacaggtgattacctttttgatatagccgaattggtgcaaatagatgtgtaatgcttttttgacgtattggacggaaagcggcggtgatttcatcaagtaataggcgccggcggtttgataatataaatcagcggcttcaaacgtattgtgaatggcggccaggtactgttcagcttttttaaaatgatgtactgcatgtttcggagctgtttttaccatctcatataacccagagaaaaaatacagataatatttcaattcatcatccattttgtcttccaggccatataggccatcgaacaatgaatcgagtccgttctggttttcaaaaagcagctgatggcgggcctgaaacaattgataacgcatccaaagttttgtgttctttttgatctttggaaggtgctgatcaattttctctttcagtgtgcaaacgtgattcattttgcgtttgctcattgcggaataccactcgtctaacatgtttagcattcttttttcaataaacttcgaaatcattttcctacctctttgctattggtaaaatctataattatcatatcataacttttgacggctctcattgacagttggttacattttagcgcggttgaaaaagagattaattcataatatacttttcaaatgtacagattggatctttgatgattgctatacatactaatgcagatgaaggagatgtcaagacaatgcttgatactcagcaaattaaagaaattattcctcaccgttatccgtttttgcttgtggatcggattacggaagttgaagagggcaaacgggcaaaaggctataaaaatgtaaccgctaatgaagagttctttaacggacattttcctcagtacccggttatgcccggcgtattaatcgtagaagcactcgctcaagtcggagctgttgcgatgttgattaaagaagaaaaccgcggcagactggctttttttgcaggcattgataactgccgctttaaaaaacaagtcaagcctggtgaccagcttcaccttgaggttgaaatcattcgtgcccgcggcacaatcgggcgcggaaaaggcgttgccacagttgatggcgaagtcgtttgcgaagtagaactgacttttgccctcggagaataattgaaaaaaggcagatggccagcggcacatttgtctttttttctttacaaatatagaaaagcaggtgattgtatgtggaatgaatttaaagcctttgccatgcgggggaatatcgtagaccttgcgattggtgttgtgataggcggcgctttcggaaagatcgtcacatctctagtaaatgatatcattatgcctttggtcggtttgctgctgggagggcttgacttttcaggcctgtcgtttacgtttggcgatgctgtagtgaaatatggcagctttatacagacgattgtgaacttcttaattatatcgttctccatttttatcgtcattcggactttgaatgggttaaggcgcaaaaaagaagcagaagaagaggctgcggaggaagcggtggatgcgcaggaggagctgctgaaagaaatcagagacctgctgaagcagcaagcaaagtcgccggaataaaaaagatgccgttagaaacggcgtctttttttatctcaattttcgtttaggttcgttctgtgtccttcagttctttagggcttcctgttgtttcagcgagatgaatgagcattgagacagaggtgcctgcatccggagtgctgctgatcatcaactcgcttccgcaaaaatgtttcagccgctgattgatatttttcaatccgacgctgcgatcaaaatccgttgataagagatctatttgtttttccggagttatcccgggaccgttatcctctactttgatgtgatactcatttttgctttgttttttagctgtcagtttgatccatcctccgcctcttttcttgctgacaccgtgaagaacggcattttccaccaagggctgaatcattaaaggcggaaggataaagtcaatgtcttcatctatatcgaaaagaacctcaagccgattactgaatcgcgtcttttctatagaaagataggaattgataatcgaaagctcatgtctgaaggaactgatggctgatgtattttgaaagtcaaaactcattcttaaatagttggtaaattcctctgttacctcccgggccttttcaatatccaaatgagtgagagaaataatcgtgtttaatacattataaagaaaatgaggcttgatttgcgactggagaaacgccatttccattcttgtggcttgatttgctgtatgtttcatcattatcaggttttgaatacgcgccataaattcagagtaatgatagggtttttgcaaaatgtcattcgctccggcatgaaaagccttgtatttgtcatggccgataatggcagctgtaatgatcagaaccggaagatcaaccatgctgaatcgttcgcgaattttcatacagacttcgaaaccagtcatatccggcatcatcaagtcacagcttcaggccttgcaccgggacaatacgcttttgttgaaacgaaagcgccagccggttatgtgctgaacactgagaaaatagagtttgagatttctgattcctctgaaggaaagcctgaagctacagatgccgggatcgccattaaagcattccagtcaagtggagaacgtcgaaagcacgtgaaatatacttatttttacttcacaatcaaggcggcggataacaattaaaagtgtcgatctggagcttccgatcgtaaaaggcacaaccaatgaaaatcttttgataggggcggcaacaatgcgccgggatcaaaaaatgggtgagggaaattatccgttggcgggccatcatttgaagcaaaagaatcttctgttcggacctctggaaaacataaaaacaggtgcccaaattgtcatcacggattttaaaaaggattatatctattctgtaacatcgaaagacatcatatcggaaatggatgcagatgtagttgaggagacaaacaaaaaggagattacgttaatcacatgtgacaaggcggtcaaaaccgaagggcgcctcgttgtgaaaggggaattggttgattcttttggccatacaaattaaatatgcaagagtgaaagcacgaagagaaaagctgccgttcaaaacggcagcttttttcatgcagaacatatctattctaaatgtctattgtgatgctcttcggttctgagtctgttttggggaacatgccccctcatatttataatttttgcttaaatgcctcaatgagttttgttcctgtatagccctcttttacaagggactcgagaatggtttcagtgccctgctgttttcttgtgaccatttgtccgtagagtaaaacctgaatgctttcttccagcttgacgatatttttcactgctgctgtcagctgggcggggcgattgctttttttcgtgatcgttacaaatactttggcttcagattggctgttttgaagctgttcaaaaaaagacagatgttctttctgtacaagcgcctcaatcagccagtgattttcaccgtcttctttatttataatcagtccgtcaataaggggaaactgttcaattgattgttcttccttgtccactcgttccacattcaggtcaaccagtttaaaggttttcatttcttctcaccccgattacttccaaagttttcttgccttccattataacataaacgttttcgaggaaaaaatcctgcaatgttggggctaaagaattttgtatgagcgaaacatttaataatttctattttttcattatactgtaactgactatggattacggagagatgtggtatgaatcaatttcgtttaaaagaaatttatattgacggcgttccttctgaaagtcatttgattcaaaaggaagtaacatatatgttaagccgtaaagaagtgtttgaggttcatctgaacaaaaaaggaagaataagttttttatacgaaacacaagatggcatggagcagtataaaatcaagctgtcaatgccggaaaaaaaattgagctttcagtggtttgcgtgggatggctcttcctatgtgcgcatgaatacgcaaaactggctgacaaagcaaatctttttccgttttttaaaaagtacatatttcttcaaaggaaaaaagcaaaagatgtttttagctgaaggaaaaatgaaaacgaaagataaaaacagaggctgaaagccatttttaagcgtttttcttttcttgttgcatcatttacaatacatacaaccgcaaggagaggaggaatcgcatgttcaatcaggtcatgcttgtcggacgtcttacaaaagatcctgatcttcgctacacttccgccggtgcggcagttgcacatgttacgctcgcggtgaaccgcagcttcaagaatgcttcaggtgaaatcgaagctgattacgtcaattgcacactttggagaaaaacagctgaaaacacggcgttgtattgccaaaaaggttctctcgtcggcgtaagcggacggattcagacaagaagctatgaaaacgaggaaggcgttaacgtgtatgtaacagaagtgttggctgacactgttcgttttatggaccctaaaccccgggaaaaagctgctgattgacacccctgctcctcccgttatctatccattcactattatccggatcttcgcatcatcccctcaaaattgaccagtcgaccagactggttctttctttttgcctacttaggaaaaattggttctctcgacgcatttttacttaaaatcacttattaatgttgaataaaatcaaataaaaacttataattacttataaatgattgctgagaaaaggaatgagggcgtgtaccaagaagaaagattagtagcgattttggattttttaaaacagcataaccgaattacaacggagcagatctgtacgctcctgcaagtgtcaagggatacagcgcgacgagatcttgtgaaacttgaggaacagaatgccatcatccgcacaagaggcggcgccattttaccgactgtgcatcagaaaattcaaagctattccggccgcctgaaaacagtgtctgaggaaaaaaataagatcggcaggcttgcagcatcgcttattcatgatggagaccgggtgattttagacgcctctacaactgttcaggcatgtgcaaagcatttgaatgcggttgattgtaccgtaatcaccaattcgattaatcttgcggatgtgctgtccgataaagagggaattgaaatttatctgctgggaggcaagctggaaaaggagcaccgctttctgtacgggtcctctgtgattgaaaagctctcaagctaccatgttgataaagcgctgattggtgtggtcggcatttccgaacatggcattacaattgcgcatgaagaggatggcatggtgaagcggaaaatgatacagcaggcaaagcaggtaattgcgcttgcagaccattctaagctgggcagcaccagtttttatcagtatgcggagctgaatgaaatcgacctcttgattacagacaggctgccgaatcaggcattttgtgacttgcttgaccgaaacggcgttgagcttctcgtgacagagcaggatgaaggaaaggactgacaaacgtgaaattaattgcgattgacttagatggaaccttactcaacagcaagcatcaggtaagcttggaaaatgaaaacgcactgcggcaggcgcagcgggacggcattgaagtggtggtgtcaactgggcgcgctcattttgacgtcatgtcaatctttgaaccgctggggatcaaaacatgggtcatcagtgcaaacggcgccgtcattcacgatcccgagggcaggctttatcatcacgaaacgattgataagaaacgggcgtatgacattctctcatggcttgagtcggaaaactattattatgaggtattcacaggttcagcgatttatacgccgcaaaacggcagagaacttcttgatgttgagctcgacagattcagaagcgcaaatccggaagcggatctttctgtccttaagcaggcggccgaggtgcaatacagccaatcgggctttgcttacattaactcctttcaagagctgtttgaagccgatgagccaatcgatttttacaatattctcggcttttctttcttcaaagaaaagcttgaggcaggctggaaaagatatgagcatgccgaagatttgacgcttgtcagttcggctgagcacaactttgagctttcttcccgcaaagcttccaaggggcaggcgctgaagaggcttgcaaaacagctgaatattccgctcgaggaaactgctgctgtaggtgacagtttaaatgacaaatcgatgctggaggctgcgggaaaaggtgtagcgatgggcaatgcccgggaagacatcaaatcgatagccgatgctgtcaccttaaccaatgacgaacacggtgtcgcacatatgatgaaacatttgttgtaagtatatgtgctgccacaaaagcgcaccctgttgataaccggcgtaacggattttttggaaattcggcgtgacggctatgaacggaaaaagctggctcttttagagccagcttttttagtcatgattattgcgctgtagcgcttaatgtaaacaattcttcgagctcctgtgtggaaagctcggtaatccagttttcactttggataatttgatcgttcagggtttgcttggattcaagcatgacatcaattttttcttcgattgttcctgtcgtaatcattttatgaacgtggacaaagcgctcctggcctatgcggtatgcacggtcagtcgcttgattttcaaccgccgggttccaccatctgtcataatggatgacgtgattggcggcggtcaaattaagtccggtgcctccagctttgagtgaaagaatcagtgtcggatattctttcctttgaaatttctcaacgagtgtatcccgctcttgcttggagagactcccatttaaaaattgcacaggttccccgaacgttttttcaagcagccgcttcatcatgttccccatctgaatgtattgcgtgaaaatcaggcagctttcgttttgggcgcggatcgctgtcatcagttccagcaatttttcgagcttgactgatctgccggccagcagctcggtttgctcttcctttaaataaagcgcgggatgatcgcatatttgcttgagccgtccaagcatgctgaggatcagcgcttttcgctgcatgccggtcagggatgtcatatggtcaaaagtgtctttgacgagctgctcataaagggatgcctgctcggctgacagagggataaattctttttcttccagcttctcaggaagattaagcgcgacctcttcatcccgtttcgtccggcggagaaggaatggccggattaattgctgaagctgtccgattctcttttcgtcccggtctttttcgatcggcagcacatagcgtttatggaagccggtcaaactgccgaggtagcctttattcatgaagtcaaaaatagaccacagctcagtcagtcggttttccatcggcgtgccgctcagcgcgatatggtgaagccccttcagcttcctgattgcgcgtgattgcttcgtatgcgcgtttttaatattttgcgcttcatcaaggcagatcgtgttccatgtcacagaagaaagctcttcagtatcggcatgtgacagaccgtatgaagtgagcaccacgtctgcgttttcataatgcgcggcgaaatcatcaccctttggccggcgcggcccataatggagcgcgacagacagatcaggggcaaaggtttgaagctcccgctgccagttgccaagtacggatgtcggcgcaataatcaaatgaggcgttttttgtcggccgctttccttcacgtgaaggaaataggcgatcatttgaatcgttttcccaagccccatatcgtcagccagacaggcgccaaaaccgctttcccgcagaaacagcagccagttcatgccgtatttctgataagggcggagcgttcctttgaaagaaggactgactttgtgctccggcaggttttccgcggcagtgagctttcgaatcagtgacctgagctgtttagacagatcaaactgaatgccggcaaaagcagatgtatcaatcaggtccgaatcctcaagtccgccatcctgctgatccattagctcccgcgccagaatatcagacatgtggagtccctctgattctgctttttccatcaggcgtttcatctgtttgataaactgcggatcgattttaacccattgcccgcggatattaacaaggcgcctgttgctggcgacaagctcattaaattcagcctcagtcagttcaattccatttgtcgcaaaccgccagttgaaatcaagcagtgcattcatgccgacaaatgactcgccgcgcggggaggaagacacctttgctttcagcatcatgttgctgtctctgacaatctgccaccaggacggcaggaggatttctacccccatatcgacaagcgtctcacttgcttctgacaggaagatccaggcttcttcctccgagatcagcgttgtcccggaatcaaacgacagccacggaaccgttctgtgaaagcggtcctgctcacgcgcgattttatcgctgtacgcctgccacgattttttgaggctcttcagtccgtcaaagaattctacagcaccgctctttttatcgcgtaaaaacatctcgatcttccattcgtctccgtcaaagtccggttcatttaagcgcaagccgacagtaaatggagattgatcgtcaatccagccaatgccttccagaaaatcctcttcatcaagaaaatggccacggaatgtcgtaaccgcaggcgatttttccttgatatgttcccatttctcccgcaggtcatcgtcgtactggatgtaatcctgtacggcagcggaaaaccattccgcagtaaagccttccagtatattatcgcggtccttccagcgaaaaacaccgtttgtccatgcgtcatagtcaggcataaaatcgccgtccgcgataaattcatagatggtcgatgccgcctcgatcagcggctccgtttcttctgtaagctgcacggagctgaatgagttgaacgagtttttgccgagaagctctacagtcatccatggagatagaaggacagcagtcgtcccgatgaagctgacatcctctagaaaggttccgtaaaatgaggattcatgccattggaacaaatgctttttcatatggctgtagggaagaggctgctcattctcatcaaaggctgagagcgtaaatgacccatcttccatttgttcgacgtggatgagaatttctttaagactcgccatcaatcaactttcctttctgcagttcttcttgaagcgcacgcaggcgcttgtaatgcgagctcagcagctgaatataccgctcccacaccttctgctttttcgcttttttgtacagggtgcgcaattttttcaaataccgggcggcttccttgtacgagctacggttcttctgatcaatgaaaaaagccacttctctatggtaagccggtataagcgcctcagggtcgctcgctgcaatttccttgagcatcattttatccatttcattgatggaaaagccgacaaggctatgaatttcaatccactcggcatagcgttttttttcatataaatgatggctgtattctgtgaacgtatacggcagacagcccgcggcaaagcgctcaaacagcgcttgatcattggtttgctgcacataggcattcaacagaaggaacagctcgccgatcacatcgcgaatctctttaaacggcttatccagcttcgtataacccatcgcaattggttcaatttgctggtaccatgttttaagccgtttccagtccttcttggcagtcatttcactcagccattggaatgtataagggagcgcttccggcgggaattgatccgcttcctcaaaaataacgtcatcatttttttgcaggaattccaaatgcaggcgcccgaattgcaattcgggagaaaaacgccgtcctgcttcttttttcaatatctcctgttcgcgtgccacccattttggccgcgacagcagcgcactccaaatttcaccgaagacgcggatgcgttcatattggaaaatttcttctttcaacagcaaatgccggataacatccggtgttttatccaaaaacggatcaagcgcaaaagacagcgcgtacgtttttaatttatcaatagagctgtagattgtatccatcagctgttcaacgtacggattgagggaataaaaatcttgttcggggtttagcttgcccgcttcaatcaatgtgaacatgcgaagccaaaccgcaatcgcggaatgaatctgatacaggcttttcagctccggcttgttcggcgcatgtttttttaatgcggacaggtagccgtaatagaggccctgcatgttttggctgccttctggcgtacgtgcctgccagagagaaaactctgaatcaaaaaaagcaagccagcttgaaagtgattcttcattaggcagcaccttttcctgaaactggcggcggacgagctctttgctttcctcaagcttttccctctccagccaatactctgtaaaagtacccactcgctcgaacattgcatatacatataaaaacacagccagcatatggcggcagattcttccggacggacatgaacagccgcttttgactatgacaaacaagttcaatgtgacccgcacaggcacaacatcctgcacgtaagccgtaacttccgtcggactcactgcttgtaaacgatagactgaatcctgccgatataaaataagggcttttttgatcagctgaacattttcctcattgtaaggaagaagttcttttaactgttcagcagatgccagcacatcgtctttggaaatcatattctgaagcatgattatcgctcctaaccgagtcacgtaataaaaagatccaatttctctattatatcgcaacacatcggccttaaaaagtttttcctaaaaaaggacataaaaaataggatgtgtcgaatgatgtattagagattgcaaattgataaccagcatcatataataatcgtgttttcaacttaatggaagctgaaaggaaaaaaagatgagtgaaaagaaattgaatcaagaagaatttctgaaaattttgatgcatgcacatgaaattggtgagcagtcatctgagatgacgacgaaggaaatgcttgaaaatttgatttctcatattaaaaatggatatgcaacataaaaatcccgcacgcctttagcgggatttttttatgcgagagaacgtgactgcccgaataagagaaaatgagacagcactgtcaacacagtaaatatagcgcttacataaaaagtactaacataacgcattgtaaaaaaatgtcgaattatgtcacgtgaaaagctggagaaatgcggtttcaacgttgtataatcgtagatggaaaaggatgttataagagatttggaggtatcatgggagaatctacaagcttaaaagagatattatcaacgttaacaaaacgcatacttttgattatgattgtaaccgcggctgccactgctgccggcggactcattagtttcttcgcacttacacccatctatgaaaattcaactcagattctggtcaaccaatcgaaaaatgaacgaaaagaagtccaatttaacgatgtccaaaccaatcttcagttaatcaatacgtacaatgtcatcattaagagccctgccatcttagatgaagtcattaaagaaatgggcctgtcgatgacatcccaagaactgaatgacaaaattaccgtatccagcgaacaggactcccaagtggtcaacatatcagtcagggatgaaaacgcggaaacagcggctcatattgccaatactatagcatctgtttttcaagacaaaatcacatccattatgaatgttgacaatgtcagcattctgtcaaaagccgaggtttcagaacacccgtcccctgtatcgccaaagccgctactaaacattgccatcgcgtttgcggccggattggcgggaagcatcggactggccttcctgcttgagcatttggataatacgatcaaatcggaagagcagctcgaatccttgctggacatacctgttttagggacagtttccaccattgcgaatgagcagaaaacagcaaagaccttacagggtttccaatctgaaaaaacggggagtggacattttggcgcttagaaaaaacagaggctcgcggatgcagagaaatgtcattgcaatgacagagccgaaatccttgaactctgaacaatatcggacgattcgcacgaatatagaatttgcttcagtggaccggcaaatgaaatcagtcatgattacatcggcttgtccgggggaaggaaaatcaacaacggccgccaacctggctgtcgtattcgcccaacagggaaaaaaagtgctcctgattgatgctgatttgcgaaaaccaacagtacatacggctttttttcttgaaaatacggttggcttaacatctgttttattaaagaaaagctctatggagcaggctgtacaagcatcgaatgaaaaacatcttgacgtgctgacgagcggcccgatcccgccaaacccggccgagcttctctcctcgaagtggatgaaggagcttgcatacgaagcgtgtgcggcatatgatatggtcatttttgatacgccgcctattcttgccgtagcagatgcacagattttaggcaacgtggcagacggttctgttctggttatttcaagcgggaaaacagaaaaagaacaagccgcaaaagcgaaagaggcgcttgcaacgtgcaaaagcaagctccttggggcgattatgaacggcaaaaagctttcgaagcactctgaatacggatattacggaaccaaggacaatttcatgcaaaaataaataacgtgcatcgtgcccgttatttatttttgcgaaaaaagggggctaggacatgatcgatattcactgtcacattcttcccgcaatggatgacggggcaggtgattcggccgacagcatagaaatggcaagagcagctgttcgtcagggaatccggacgatcattgcgacacctcatcataacaacggtgtgtataaaaacgagccagccgcagtcagagaagcagcagatcagttaaacaaacgtttaatcaaagaagacattcctttacatgtgcttccgggacaggaaatcagaatctacggcgaggtggaacaagaccttgccaaacgtcagctgctttcgctgaatgatacaaaatacatcttgattgagtttccgtttgatcacgttccccgatatgcggagcagcttttttatgatttgcagctgaaaggatatattccggttatcgcccatcctgaacgcaacagggaaattcgcgaaaacccgtccttgctgtatcatcttgtggaaaaaggagcagcatctcagattacttcaggaagtcttgcggggatcttcggcaagcagctgaaagcattttctctccggctggttgaagccaatttgatccatttcgtagcctcagatgcccataatgtgaaaacgagaaattttcacactcaagaggctctttatgttctagagaaagaattcggctcggaacttccttatatgctgacggaaaatgcagagcttctcctgcggaatcagaccatcttcagacagcctccgcagccggtcaaaagaagaaaattgtttggtttttttaacagccgattctcatttcaccactttctttttgagagcgatataatagtgtattgtatggttgaatcacatttcagaaatctgtacaggctgtacccgacaggctatgcgggagatcattcgcattcatgataggatgttctcatacgatattacggaagctgcaaagcagcaatttaactgttggagggaaacaatgaatataacagtcatcggaacaggctatgtcggtcttgtgacaggtgtttctctttctgagattggacatcatgtaacctgcattgatattgacgctcacaagattgatgaaatgagaaagggcatttcccccatatttgaaccaggtcttgaagagctgatgagaaaaaatacagctgatggacggctgaactttgaaacgagctatgagaaaggcttggcacaggcagacatcatttttatagcggtcggcacaccgcagaaaagcgacgggcacgccaatctggagcaaattacagatgcggccaaacgcatcgcaaagcatgtcaaacgagatacagtcgtggtaacgaaaagcacagtgcccgttgggacaaacgatttgattaatggactgattactgaacatctagcggagcctgtcagtatttcggtcgcatccaatccggaatttttgcgtgaggggtcggcgatctatgatacctttcatggtgacaggatcgtgatcgggacggccgatgagaaaacagcaaatacgctggaggagctcttccgtccgtttcaaatcccgatttaccaaacggatatcagaagcgccgagatgatcaaatatgcctcaaatgcttttctggccactaagatcagttttataaacgaaatttcgaatatatgtgaaaaggtcggcgccgatattgaagcagtcgcatacgggatgggacaggataagcggatcgggagccagtttttaaaagcgggcataggctacggcggctcttgttttccaaaggacacaaacgccctcgtgcaaattgccggcaatgtcgagcatgattttgaactgctgaaatccgttatcaaagtcaacaacaatcagcaggcgatgctggttgataaagcgctgaacaggctcggtggggtgacgggaaaaacgattgcccttttaggcctgtcatttaaaccgaataccgacgatatgagagaagcgccgtcaattgttattgcagaccgtctcgctgcgctcgacgcccgtatcagagcctacgatcccattgcagttagccatgcaaagcatgttctcccgcaagctgttgaatataaagagacgatcgaggaagctgtcaaagggtctgacgccgtcatgattttaaccgactgggctgacattaaacaattcccgttagcggcttatcaggatttgatggaaacgccgctcatatttgacggcagaaactgctacacattggatgaggctttggctgcaggagtggagtattattctgtcggacggaaggcggttgttccgtcaggtgcaattcaatagatgaaaaagaaaggctggttgcgcaccagtctttttttcatctattgcggggtgctgaatacatttgctactatttaactattgtttggaaaattatgcagaagtagggcttctttaaacattcgtttgaaaaacattagaagaaaaccagaaaataaaaccttggagatgccggaaaaggagagaatctgatgaatcatctgcccgaaaaaatgagaccgtaccgcgacttgctggagaaatcagcgaaagaatacgtgaaactgaatgtgagaaaggggaaaacaggacgatatgacagcaaaattgccggtgatccctatttccccaagcatgaaacatatccgactgacgaaaatggacagccgatgaaacttctggcgcagattaatttctcgcacattccccagcttgacggctacccttcttcaggtatcctgcagttctacatttctgttcatgatgacgtctatggattgaattttgacgatcgatgtgaacaaaagaatttcagagtgatctattttgaaaatatcgtagaaaacgatgacgagcttgtttctgatttttcatttattggcacaggcgaatgtgattttccgattttatcagaagcggcagtcgagcctgtgaaatcttcggaatgggtgctgcctacagattttcaatttgagcagtatacgggcatggaaacaatggagttctttggtcagttcggcgaggatgaagaagacatttataatgaactggctgaaaacggatttggccataaaattggcggatacgcttcttttacccagcatgatccccgggaatacgcatataaagaacacaccatcatgctgttacaaattgattcagacgatgatatcgattcaatgtggggagacgtcggcatcgccaattttttcatcacacctgaagatctaaggaaaaaagacttttcaaacgttctgtacaactgggactgcagctaatacaagcttttgatccaaagggtcagaaggggggaataatagaagccaaatgacaaaatcagacatggccgaccagatgaagaacataaacatgaacaataagctcagcgccgaaagaggcagatcaacaacatctgcctctttcaagtgcctttataactatgacattaggtgatttcattttataaaacgcttttattagctgtataacgaacaaaaacaagatcaaatacctacatttcaagagcgttatatgcctaaattaagccatttaccctatttaagccgccttctggctattttaaaatataatatatggaaataaagtatggaaaagtctatcttcatcagcccctccatacgactttttgagtattaagaggtgattcagatgggttatgaaagtatgctagcggatatcaaaagttcgctcaacggaaaaatttcagacgtggaagacaagatcgaaaagctgaaaaaagcaaaaaaggacatagacacactgcaagaagaggcaatcactgaaatcaaagaaattgtgaaaccggaattgggcaagcattggacgggaacaaaagccgatgatttcgacaagggaagagaagaggcgaaatcggaagcatctaagattgtgaatgataaatataacgagtatatggcttcgattaacgggaaaatttttgatcttgaatgggataaagctaaatatgcatcggaattgttcatagcaaatggtgcagcagatcttcttaaaaagggagaagagttcgcggaagaagtcggaaatacaattagtaaactaaaatggtggtgatctttttttatgtcagaaattaagctgaagtacgacacagtcatcaaaacattagattctgtcaaagatgcgcttgctgacgtatcaatcggcgccgcaggatccaacggaaaaaacagcctcgattatacgaaaaaataccatgagcgtgaggagaacatcaaaaccatgctcggagattacaaaaaagcggtacagaaaaatatcgaggatacaaaggataacgtagattcactcaaagagcaggacgaggcgatagcggtaaaatagaacagaaagggcagtgcgatgagtaaagtatttgaatcaaaatctttaatcgaagaagcgaagagcagaaaaaagcaatatgagacgcttgaagagcagctgaatacgctgaaaaaagcgtttcagggagttgccgatttaggcgataattttaaaggaaatggcgcggacaatattaaagatttttttcagggacaggcagaaatcgtagacagctggctgacgcttgtctctgctcaaattgcgtttttaaacggcatttcaggagatattaaagatcaagaactgaatgattcatatgtggaaacttcttttttggatcatgagctgcccaatggagacctgaaagcctcagagattgtctccgctcataaagaagaaatcgattctattttgtcaggcatcagcgatattattgatctcgacatgtacacgcttgacgactatgcagataagatgggcgatgcccaaaaaatcagacgtgatacaatcacagctgtcgataagcttgatgaatccctgaccactgaatatcaaaatttagaatctctggacaacgcagtgctcaccaaatattctgttctcatgcaggccaccagcaatgggaagagcgcatcccctatgtactatgacaaaaaagccttccacagcaatgaagtctacaaaagcgtcattgaagtagaaaatcaaggaacaacctatatcgatgcaaaaacccagcaagcagaagcaagacggctccaggaaaaagccgaggaagaagcaaacaaaccgtggtacgaaaaaacatgggatggagtttgcaactttactggagaagtcactggctattatgattataaaagagcaaccgaaggcgttgatccggttaccggagaaaaactctccaccgcggagcgtgtgacagcaggagctatggccgctgccggattcataccagtcgtcggctgggcaggccgggccttcaaaggcggaaaagccatctacaaaaccggaaaagcagctatcgctgctgaacacgcattagacgcctacaaaacaggcaaatccttagacattctcaaaatgacagaaatgggcgcatacggccttgttgcgtcaaacggattctcagaagctgtcacaggccgggatatgttcggaaacaaagtgtctgaggagaagcggaagcaaggggcgctggaagctattactattattggtggagcaggattggcacactactttgatcggttgtaccaaaaaaatgctccatatgtcaataaagtgagtaatgaaagccttattagcaatattgctaagactactgaagaaaaacaaactaggcttcaatatttaagaaataagcatggtgtattgtctaaagaagatcttcaccatcgaataaatctaagggcagaagtactaaacgaacttagtagaattaaatcttctggtctaactaaaaaacaaagaggccctgcggtagctggtgtattggacaaaaaaacaggcaattattattttggaataaacaatatagatgggaagccacctaaggtactacatccacttattcatgatagaattgtaaatatgcctacagaacttaaagaaggttatataaagacgtcaggggcgggttctcatgccgaagttaatgctctaaatgaagcgttacttcaaagacctgatgcggatttaaaagatttaatggtatatgtagtaagtgctaggaaaataaataaaaagatgccagaaggtgtcccaatgcctagatgtccacattgtgaatatataactcaaaatacaaattatataccggaggctttaaagtatggaaaatgaatatgatatgaagagtataaaagaaaagggagtggactttgaggatttatggttctcttcggtaagtgatgagattttagataatcctgaagacgaaaatggccagccgtttacagggctggcttacgaattatatccaaatggtcaaatcatctattttactaaatataagaatggtctggcccatggtttaacatgtgaattttatgaaaacgggaataaaaaaagtgaaaaagaataccgatatgggcaattgcacggtataagcataatttggtttgaaaatggcaggaaaaaaagtgagcaacagtatgagcattccatactaatttctgaaaagaattgggatgaagaaggcaatctattaaataagtacgagatagatacagatagtcctcattttgaaatactagaatcgagaagagagactcacattaatttaggtcgagagtgagcaatcgttatgaaggtatttgatgtgcataaatttgatatgaaaaaggaacaagactttttacaagtgcaatttaaccttaaaaatcgtatcaacctatcccccacgatccatccagactccatcaacacctgcgcaggcgtcgacctggcctattgggagcaggatggagaaccatacggagtgtgctgtattatcgtaattgacgctgatacaaaagaagtcattgaaaaagtgcacagcatggggagaatcagcgtgccgtatgtttccggttttcttgcgtttcgcgagctgcccttgatcatcgaggcggcgaaaaagctggagacggagccggatgtcttcttgtttgatggcaacggatatctgcattacaatcatatgggcgttgccacccatgcggctttttttctgggcaagccgacgattgggatagcgaaaacctatctcaaaatcaaaggctgcgatttcgtgacgcctgaaattgaagtaggcgcatacaccgatattatcattgacggcgaggtatatggacgggcgctgcgaacgcggcgggacgtgaagcctattttcttgtcttgcggtaattatattgatttagacagcagctatcagatcacgatgagcttgatcaatcaagaaagcaggctgccgatccctgtccgcctggctgaccttgagacgcatgttttgcgaacgttttatcagaaaaatcacgtgtaacacttggggctctaagtcatcaagtgttttttttgtatgtgtgtgccctggtctcaaaaaccttgtcgtccttgtggagaggttttatttgaatgttttccgtgtcaaatcgataaaagcctttaatggcgcagacatccacttgtccttatgccatgctaattgagtgaaaacggggcaatcgctctgccaattgagttctttcatccggcctgctgcaatatcatcttttactgtcatttcaggcaagattccaatcccaagtccggccatcacgcattgtttgatggcttctatgctgacgaattccaatttgttaggatagataccggagtcatgcaaattgttctcaaagagcgtgcggtacgagcagccgtcctctgtcagcagaagagtttcgttttgaagatccttcaatgttactggtaaatccgcaggaaaaggatggtcattagcagccaccattttgatctcatcctgaatcaaagattcaacgtgcagtgcgtcttccatccggtttacatccaagatgaaggtgatatcaagctggccctgtaagagctgttctttcgcttgttcattggagatatatggtttgaatatgagctttacttggggaaaagcctgtttaaattcttttatgatagggggcaggcggtatgtgcactggctttccgtcgccccgatttttaaggttccggttgtttctcttacttgatttgtggccattttcgcttcttctgttaacgcaatgatcttctgtgcataagatttgaacgtttttcctgcttctgtcaagataagccgcttgccgagccgttcaaataaaggcgttccgatttcttcttcaagtgatttgatctgagaggtaacgcttgattgtgcataattaagcattttggcggttagggtgaagtttacatgttcagccgccgtaataaaggtgatcagctgcttcaattccacttgttctcttcctttctaaatcggttttagcgattggattaatcgaaataatcatctgtattgattgatgaatccattatatgatgaagaaaatcattcgtaaacaaaggagcagatgcatcatgaaaattgcggttattaacggcggaactcggtctggcggaaatacggatgttcttgcggagaaggctgttcaaggattcgatgcggagcacatttatttgcagaaatatccaattcaaccaattgaagatctgcgtcacgcccaaggcggctttcgtcctgttcaagatgactacgattctatcattgaacggatattgcagtgccatattcttatattcgccaccccaatttattggtttggcatgtcagggacattaaagctgtttattgatcgctggtcacagacgttgagagatccgagatttcctgattttaaacagcaaatgtcagtgaaacaggcatatgtaatagcagtgggcggagacaatccaaaaataaaagggctgccgctgattcagcaattcgaacatatttttcattttatgggaatgtcctttaaaggctatgtgctgggagaaggcaatcgtccaggcgatattcttcgtgatcatcaggcgctgtccgctgcgagccgcttactgaaaagaagcgatgcgatatgaagtttttgctgtcggtcattgctggcttgctgattcttgcactctatttattttggaaggtccagcctcctgtttggatacaagttgaaaccaattcgtcccagttgaagcaatctgtgagaatggcaggaaccacgctgcaagtcaagcacatgatcaagagtgacgcaggagaagaaacagctgtcatatcaaacggcatttctgggctaaaataaaaaagcacctgtccaggtgcttttttctataaataagggatcacaaggcccccatataaaaacgccgcaataatcaaaaatgccggatgcattttgaattttgtcatggcaaggagcgaaattcccgtaatcacgatcgattggacccagccgatcgctttgatgccgtctgcgccgatttgccaggtaagaatgagcatcatgaccgcgatgacaggctggacggacagcgtcatgcctttgatgacaggtgattggcggaagcgctggatgatgcgcagcaggacgatcaatgcgagcgccgacggtacgacggttgcgatcagggcaattaggaagccgggccacccgcctgcgctgtagccgacatacgcagcgattttcgtggcgatcgggcccggcaatgcgttcgcaagtgcgagcatatttgagaattgatcgtttgagagccagctgtatctgtttacgacttcttcaaacattagcgggatagacgcaggtccgccgccatatcccagtaggtttgcgataaaaaacgccataaataaatagatcgatatcatgaggctgacattcctttatcttttgaatgtttatttgtgattttgtctttcagtttaaaatgaaacgccccgtaagctaagaaaatgataatgaccaggccgggattaatctgtaaagtttgcaggccgataaaagcgatgataaaaaacaggatgccggtaacccagccgaaacctttaagcgctttttggccaaactcgtacgccatgattccgagcatgaccgcaattaccggcgtgacggcaccaatcatacctgcaacaattgctgaatggcttaacacatttacagccgcaaacaagcccaccatcgcaagacatgtaggcagaatgtgggcgaggatcgccacaattgcacctaatgtgccttttagcttaaagcccagataagcagccattttggtggcaatcggtccgggaagcgcattagcgattgctaatatttctccgaattcatcatcgtcaatccatttatatttattgaccgcttcatggcggatcagcggaatcacggaaggtccgccgccgaaccctaatatgccggtgcgaaccattgcggccgtcatatcccgataaggatggtttttcatttgtttctctcctttacagcttcattcccatacggcttttgtatcgtttgatcagcatctggcaatcaacactgacgacgcctcgcaatggatacagccgttttgttaagaattcttccatttcttgatcgttggtaaagatcccatgcatatgcagcttgctcgggcctgtcatgtgataaaggctggtgaccgcaggctcttcctcaagcttaagagcgacctcttctaaaaattgcggttctacctcgacattgaaaaacacggaaacatggatgccgattttagcgggattgatgacagcggtgaatttttcaataacaccggcttcaattaattggttgatacgggcctgaacggcgacccgtgacaaatcgactcttttgccaagatccgtataagaaattctgccttcttcatgcaaaatcgtgagaatttgtttatcagtctcatcaagtacaaggttggggatttgatattcatgactcaattgctccacctgctttcgtagccttttagcaatcattttatcataaaagttacgtatagaaataataatttttcatttgttttcgaaatgaatgcgaaaatatcttattatttgcgaaaagaagaaagttcgtcagtttttctgccggatcagtagatgtgaaaaatcaggctccctatactgaagaaaatttcttaaaaaaggggacttgtgatgaacaaatctgtcatcggtacaaagcaaatggtcgtcagtccgcattatctcgcttctcaagccggaaaccgcatactggataagggaggcaacgcgtttgacgccgctgttgcggtgagtgcttgtcttgcggttgtgtacccgcatatgaccggacttggcggggattccttttggctgacctttcaccaggaaacaaaggcagtaaaagtctacaatggcagcggccgttcaggaaaaaacgtaacgagagatgtatataagggaaaaagcgcgattccgctgcggggaattgacagtgctattaccgtgccgggaatggttgatagctgggatgcggtcctgaaggagtacgggcgtctgtctcttgcagatgtattggagcccgcacgcgattatgcccaaaatgggtttcctgtatcagctgatcagtgtcgtcacacagaaaagaatattgaactgctggcttccacgccttacacggctgacatcttcacgagaaggggcaaagcacctgtcccgggagagcggtttgtgcaaaaagagcttgcagacagtctgaacttgattgctgaaaaaggaagaagcgcattttatgaaggagatctcgctcagcggattgtctcacatttacagaataacggcagttacatgacaatcgatgattttaaagcgcatcggggtgagtgggcagcgcctgtatcaagtgattatcgaggatacagtgtgtatcaggcgccgccgaattctcagggatttaccggtttattaacactgaacattttggaaaactatgatttcacccaaatcgaacacggttcatttgagtattatcacgtgcttgtggaggcattgaaaaagagttttctagatcgggatgccgtcctgactgatccggcgtttgcagacattccgcttgaaaggcttttggacaaacgttatgcaaaacaattggcagaagaaatcggctatctcgcaataccggcagaaagcaggccggtgggaagtgatacggcatatgcggccgtaatcgatgcggatggcaacgcagtgtcattcattcaaagcctgtactttgaatttggctcggcagtcactgccggtgatacaggcatattactgcaaaaccgcggatcgtttttctcactggatgaaaatcatgtcaacacgcttgaaccgagaaagcgcaccttccatacgttgatgccggctatggtctgtaaaggcggaaagccaaaaattctgtacggcacacaaggcggcgaaggccagccgcagacccagacggccatcattacccgaatgctggactacggaatgcatccacagcaggcaatcagcgaaccgcgctgggtatggggcagaacgtggggagaggaatacgaaggtctcagagtcgagggcagattcacagacaaaacaatccaaaaactgaaagacagcgggcatctcgtggaggttgtcggtgactatgatccgctgatgggacaagcggctgcaatcaaagttgatgaagaaggctttctccaaggcggagccgatcctcggggagacggagcggctgtggggatttaaataactatagggtacaaacataaatcaaaagcataaacataagggagacctctacaatgtggtacatatactgtttatcttcaggtctataatgccactccataaaaatacgtattgagtcaatcacaataaaaaataaaagaagcaaatattcaactggaaaaaaggagagtgaaaacacaaacaaaataagtaaagtgatttcgatccatttgtgtgtattgctgacatgcttatatcgccagccggatttatcaataccgtattttttctttataaaaaattgagaggcgagactgatggtaatagcgatcagcattaaaatccaaaagtttgtcattccaattcctcctaatctacctttatacgaagaaaaaggaaaaacgtttcataaaagaacaccccgagcttgctctgggtgttcttttttttgatattttttcagttatttacaggcgatattttgtaatcataaggtctttttgactagtttcttctatttaaatagtccttctcttcagctgggacgaatcagtgtgaattcttcccccagcttggcatagtgatttcccgccaatcgtgaggcaggctttaattcatccgttaaaatatatcccttttctgcatcatacaccttttcatctaggtggaagcagacaactcttccgatgagcagatctgctgtagtgatgccttgatcattgtcaaaggtaatatgccgctctaatttgcactcaaagcgaacgcgggcttccttaatgccgggaactgaaacagctttgctttcaacaggatgaagcgaggtgcgtgtaagctcgctttcatccggccttaagcttgcagctgtttcattgatatcttcaatgatggcttcatcactgacatgaacgacaaattctccgttctccactgcgtttcgtgctgtatctttttggcgtccttccgtcctgttaacagaaatactgagaagcggaggatctgagctgacgacgttataaaaactgaaaggcgcggcatttaccgctcctcctgaagaaagtgttgtcacaaatgcaatggggcggggaataacggtacctgacaatagcttgtatgtgtctttggcactaagctgatcagcttgaaatatgtacatagcaacaaccgcctttatcgttaggataccttgattataacgaaatggtttaaaggaaaccaaatgatgcgggttgcatatgttatgtcatgacatatatctaatacagggcaaataaaaaaataggcttccgtacctccgccggcagcctattgaaacaatgaaaacttagattatttgtatttctttttgactacccagcaattgccgtctttccagtattcttttttgctgtcataatcatcgtgtcttttgtagtcgtcgcagtggtggtgcggttttttgtagtatttcttatgggaacgataagattttttgtgtgtgcggcatgacttcttatagctgcgagattttttcttgtgagaacagtaagactttttgtagctgcgagattttttgtaagaacggcaagattttttatagctacgagattttttgtaagaacggtaagattttttatagctgcgagattttttgtgagaacggtacgattttttgtggctgcgagatttcttgtgagagcagtatgattttttgtggctgcgagattttttgtgagaacagaatgattttttgtgactgcgagattttttgtgagagcagtatgattttttatggctgcgagattttttgtgagtgcggtgcgactttttatgactgcgtttttttccatgaggctcttggtataaataatcctttaaaccttctttttttgcggatttcaccgcttcttcgatgtcagaatgggaatagtggcccaatttgaaatcctccttttaaaaatatgttaaggatgaagatccttactaccctcatagtacgcgcggttttaaaaagtgtataagtgttccgctgagatcttataaaaataaaagcctaaaatttgtaaggaggattatggatgaagaatcaatccaatttaccgctttatcagctgtttgttcatccaaaagacttgcgtgaattaaaaaaggatatatgggacgatgatccggtgccagctgtgatgaaggtaaatcaaaaaaggctggatattgatatcgcttatcggggatcacatatcagagacttcaaaaagaagtcataccatatttccttttatcagccgaaaacattccgcggcgcgcgagagattcacttaaatgcggagtataaagacccttccttgatgagaaacaaattgtctctggattttttctcggagctagggacactgtctccaaaggcagagtttgcgtttgtaaagatgaatgggaagaatgaaggggtttatcttgaacttgaatccgtagatgaatattatttggcgaaaaggaagctggctgatggcgcgattttttatgcggtggatgatgatgccaacttttctctgatgagcgatttagaaagggaaacgaaaacatcgctggagcttggatatgaaaagaaaacagggactgaggaagatgatttttatttacaagatatgatttttaaaattaatacggtccctaaagctcagtttaagtcagaagtgacaaaacacgtggatgtcgataagtatttgcgctggcttgctggtattgtattcacctcgaactatgacgggtttgtccacaactacgcattatacagaagcggggaaaccggattatttgaggtgattccttgggattatgatgcgacttggggcagggatatccatggagagcggatggctgccgattatgtaagaattcaaggatttaatacactaaccgcccggatattggatgaatccgagtttcgcaagtcctacaagcgcctgttagaaaaaacgctccaatctctttttacaatagaatatatggaaccgaaaatcatggcgatgtatgaacggattaggccgtttgtcctcatggacccgtataaaaagaatgatattgagcgttttgaccgtgagccggatgtgatctgcgagtatattaaaaaccgttcacaatacctcaaagatcatttaagtattttatgaatgcgtgaaaatgggtattcgcggaaaaagcgacaattaggctattgaattagttcaacaaataaatgtgacacgtatatatgcagtatgtttatcatctatgtataagtgactaggaggaatttgaatgagcaagaggagaatgaaatatcattcaaataatgaaatatcgtattataactttttgcactcaatgaaagataaaattgttactgtatatcgtggaggtccggaatctaaaaaaggaaaattaacagctgtaaaatcagattatatagctttacaagctgaaaaaaaaataatttattatcagttggagcatgtgaaaagtattactgaggataccaataatagcaccacaacaattgagactgaggaaatgctcgatgctgatgattttcatagcttaatcggacatttaataaaccaatcagttcaatttaaccaagggggtccggaatctaaaaaaggaagattggtctggctgggagatgattacgctgcgttaaacacaaatgaggatggggtagtgtattttaatatccatcacatcaaaagtataagtaaacacgagcctgatttgaaaatagaagagcagacgccagttggagttttggaagctgatgatttaagcgaggtttttaagagtctgactcataaatgggtttcaattaatcgtggaggtccggaagccattgagggtatccttgtagataatgccgacggccattatactatagtgaaaaatcaagaggtgcttcgcatctatccttttcacataaaaagcatcagcttaggtccaaaagggtcgtacaaaaaagaggatcaaaaaaatgaacaaaaccaggaagacaataatgataaggacagcaattcgttcatttcttcaaaatcatatagctcatcaaaatcatctaaacgatcactaaaatcttcagatgatcaatcatccaaatctggtcgttcgtcacgttcaaaaagttcttcaaaatcatctaaacgatcactaaaatcttcggattatcaatcatccaaatctggccgttcgtcacgttcaaaaagttcttcaaaatcatctaaacgatcattaaaatcttcagattatcaatcatcaaaatcatctaaacgatcaccaagatcttcagattatcaatcatcaagatcaccaggctattcaagttcaataaaaagttcaggaaaacaaaaggaagattatagctatgaaacgattgtcagaacgatagactatcactggaaacgtaaattttaatagataatggaggagcatcagataaagtgatgccctttttcagttaaaggaggagaatcgtgaaaggtttgaatcaattccttaacacagatgttgaggttgtcatttcaggagatacaaggtttgtcggcaccctcatagatatcggacaggatatttttgttatttttgatggctgcaattatctttatattcccttgttgcatcttcatcaaataaacaaggcgaaaatagtgaccagtactgagaagccatttttgatcaatccggaagatccaatgatagaggcagaaactcaagctttttcatatagaaatacattaaacaaggtcaaaggccagtttattgaagtttatgtaactgggggtcgatcgatccatggatatgttacaaatgttttaaacgattatattgtatttttctcacccgtatttaaaatactttttatatctatgcatcatttaaaatggtttaccccttattcaactgaacaaacaccgtatactcttgacaactcacaattgccggtcgtgccttccaaagttcctcttgtgcgtaattttgaggagcagatcaaaaaaaatattggtgaattggtcatatttgatatgggagaggtgccagaaaaagtcggactattaaagggtgtctctaataatatcattgagcttattaacgcaagtggagagccagtcatttggaagttaaatcatctaaagacaatgcatcttccctagtgtatacaaaactgccctcttgaaaagcagaaggcagtttttcgtttcatactgtgctaaagaaataaccaactgatccaaaaatataaacatgttaacgtaaaaagaacagtcagcggaatgatgataatggtcgtttttatatattcgccccatgaaatactttcatcatgctgttttaatatatgcatccaaataagcgttgctaaggttcccataggtaataataatgaaccgatatcactgccgataatatttgccaagtagatgatttttgttgttgaaggattcagggtcatttcagttaaggtaaaagtactgatcattaacgctggatggttgttaaagagattagaaaaaactgaagtagagatacctgatgcgaaagttgcatgggcgaggcttccagaaaccacaggttcaaaataactcacaagtaactctgtgaatccaatattatgcagaccataaattaagacatacatagtaaaagcgaatataaaaatgtgccaaggcgatttatataacaagtctcttggggaggttttgaaataaatccatctccagctcaacaggataaaagatccgatgacagcgactagaggaacagaaataccggtatatgatgctgcaaatagactcattctgacgagaaaaacaaatgcaagcacaaacaacatgatttttgtttgatttcgttctggtaaaggagctgatggcgaatgaagaggatggtaccttctatgccgcagagactgaaaatggcccggtatatctggcaggcttttgggaagacgtttataaaagaacataaacagtagacaagtcataaaaatgagtcccatcatactagggacaaacatcatggcggtgtgaagatatagatccattccaatgattttgagagaaattaaattaacaatattacttacgccaatcggtgcgctagaggctgtggctattaaaacaccgcttaataaatatggggctttttgatgtttttttaaacctaaatattttagtacaagcaaaaggattggagttgtgatcaaaatgctcccatcattattaaggaaaatggtcatgagaaagcagagcaaattggttagccaaaaaagcttgatgcctgaacccttggattgttggagcagttttgcagccacccaataaaagaaaccaaagctttctagtgcaatggccataatcatagtggcaaggattgtaaccgatgcacccgtgacttttgttccgatttcccctaagtctgccaatgacacacttccgcacaataaaaccattaaagcgccaaatgtggcggggatagcttcatttagtccttttggtctccagaaaataaaaatcattgttacgaaaaaagcgagcaatgtgaatatgccggtgaactcaataatttacttcacctctctatctttcatttttaaaatcaaactaatgtcctgcgcttactgatgtccttgccaactatttgtactgtatgtatacgtatactgatataaagttgtactaagcgattatattaaattaataaaaattccataagaatcccaaaagaaaaaagagattgcaagtattgttcatgtacctgcatcactctctttagttcttgtctgctgacaatttgaaatatgaataaaatgctttataagcggattatgattgtctttgcggtaagcgataacccattctgcattaagctgtatttggtccatttttcgataagtaacatccaaattaaataattttttggccgaggaaggaacaaatgtcataccaattccggcactgactaaaccaatcaccatttgatattctgtggcttcctggacaatgttgggtctgaagcccgcttgttcacagaactgaataaaatccatgtatagagtaggccatgcttctttagcaacagtaataattggttcatctcttaaatcctcaatcgtaattgattccttagaagtcaatgggtgttgcttaggcaaagctaaaacacaagggctgctttgggcggtttcgatatgtaaagctgtatgctgtaagggaggatgaagtataccaatatcaatgttgccctttagtagctcctcctgctgcctagacgaggatatttcacgcagttctattttcacagatgggaattttttacgatattcccggacaatcggcggcagaaattcatatgtagctgatccgacaaaaccgattacgagaaggccttgctcgccgcgggccgtccgctgtgccagttcaattccttgtccgatttgcatcaatgccatgcggcaatgatttaaaaagatttctcctgctgcggtaagctcgacaaatcgttttgtccttttcagaagcgtaactccgacttcttcctccagctgtttgatctgctggctgagaggaggctgcgtcatgttcagccgccgggcagcctttccgaaatgaagctcttcggctactgcgataaagtattgaagatggcgaagctccattcaatatgcattcctttccataggttaataattcgtattacatattaatcataaggcgaatcgatattggaggtcaatttccaaagagtgtatagtgaaacttatcacaagatatttaaaattttacgtttaaaatgcataataaggagtgagggtgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctagcactctgcgcatcacgacactgttttatgaacagcactaaataaaaggagtgaagggaaatatgaaacgagaaagcaacattcaagtgctcagccgtggtcaaaaagatcagcctgtgagccagatttatcaagtatcaacaatgacttctctattagacggagtatatgacggagattttgaactgtcagagattccgaaatatggagacttcggtatcggaacctttaacaagcttgacggagagctgattgggtttgacggcgaattttaccgtcttcgctcagacggaaccgcgacaccggtccaaaatggagaccgttcaccgttctgttcatttacgttctttacaccggacatgacgcacaaaattgatgcgaaaatgacacgcgaagactttgaaaaagagatcaacagcatgctgccaagcagaaacttattttatgcaattcgcattgacggattgtttaaaaaggtgcagacaagaacagtagaacttcaagaaaaaccttacgtgccaatggttgaagcggtcaaaacacagccgattttcaacttcgacaacgtgagaggaacgattgtaggtttcttgacaccagcttatgcaaacggaatcgccgtttctggctatcacctgcacttcattgacgaaggacgcaattcaggcggacacgtttttgactatgtgcttgaggattgcacggttacgatttctcaaaaaatgaacatgaatctcagacttccgaacacagcggatttctttaatgcgaatctggataaccctgattttgcgaaagatatcgaaacaactgaaggaagccctgaataaaagaaaaaaagaaagccccttttagcagggctttctttttatttggctcttttcctgattttagataaaataacatcaaaacagtaaaggtgtggtctgatgaaaatattggttttggcagtgcatcctcatatggagacctcagttgttaataaggcgtgggctgaggaattgagtaaacatgacaatatcacagtacgggatctttataaggaatacccggatgaagcgatagatgttgcgaaggaacagcagctgtgcgaggaatacgatcggattgtctttcaattcccgctatattggtacagctctccgccgctcttgaaaaaatggcaggatcttgtgctgacttatggctgggcttttggttcagaaggaaatgccttgcatggcaaggagctgatgctggctgtatcaacagggagcgaagcggaaaaatatcaagcgggcggagcaaatcattactcgatcagtgagctattgaaaccatttcaggccacgagtaatctgatcggcatgaagtatctgcctccatatgtgttctatggcgtgaattatgcagctgcagaggatatttctcacagtgcaaaacggttagccgaatacatccagcagccttttgtttaaaatacagccctgtccaacatacggcagggctgtatttgtttaaaaatccggcagctcagacaggttattttccttgatgccgtccggttcacttcgcaaaatgtcacgcccgtatttatggaagacatcaacatgagcgagttttcctgattttgcttctgacagcgcagtagggtagtcgagctctcttcctgtattggttttcactgcgataatattgtcttcctcatttcttctaaccgcaataatttcttcttttccagatggaacattttcttgatcggcagttgtttgccgggctttatacgattcatatgctgcttcaaattgatccatatttacacctccgctttttagcgtgaacaaaaatgtcgatgatcatgtaaggtttcgacacagcatacgacaatatttcctgagaaatatcttgggaatgtgacaaatcaattcataataaaagggattccgcatttatgcggaatccctctcagttattttgtcatgtgtaaatcctttgttttcatataacctgtcgtaccgccgtaatcaacgaatacccaatcaaaatcaaaaccgcctttattcgttttactccagcctaaaaaagaaacgcttgtgtctgctggaagagtcttaatgctctttccgtcagcggatgtatacacttttgtttttgttttggtttttaccgttgtcgctgctttaacaatgtaatgagtggatacaaatcctgtttttccatttttatacttaacctttgcccagtcagcatttgagaaggaaatcagctttaggctatctcctaagtgcagcgtatcggctttctggcttgatgcggaaggcttcgttctgacatttagagcctctgctgataccaaataagaatcaatcggataactgtataaatcatcaatgcttaccgttgtttctggctgttgagcatggatcgtgccagcgccgccagcagccgccgcagtcattccagccgcaagtgctaatgttgaaaatagttttgttggtttgttcatgccgttcctctcctcacgtaagagaaataattcattctatatctctattcacgttatcgcaggttcctaaacatcagacaattatttttgtgtttctagtttgagaggcgcggatattgttttttgcacttttttcccgtgcaaaatatcatctgctgcttctgtagccaatttaccgattaattcaggctgctgagcgacggtggctgacagctttctgtctttaatggaagcgagcgcatctttattgccgtcaaaaccgatcaccaatatgtctttccccgagctgttaattgcctcgagagcaccgagcgccatttcatcgttgtgagcaaaaacagcttggatatcaggatgtccctgcagcaggttttccatgacagtcaggcctttcgtgcggtcaaagtcagctgattgttttgtgacaacttggagcttttggtctgcgatgttatggaatcctgagccgcgttcccgtgtggcagatgcgccggggacgccttcaagctctgccacctttgctccttttccaagtttgtcggcaataaacgccgcggccatttcaccgccttttacattatcggaagcaacgagggtttcaacttttccttgttccgcagatcgatcgattgttacgacgggcacaccgactgcgtttgcagattctactgccgttgagatcgccgaagaatcagtcgggttgattaataatgcatcaacaccttgctgaattaaatcttccacgtcactcgtctgtttcgatgaatcattttgtgcatcaacaatgatgactttcattccccgttttttagcttctttttcgatacccttttttaatgagacaaaaaaaggattattaagcgttgagacggacaagccaatggtgaattcctttttgttccccgagtttgatggctttgcccattggggaggctcaagcgaacaggcggttaacaaaaataatgataacgttaaaatgacggatacagcctttttcatgtaaaaccctcctaagctgacttcttgcggtctaacaataccgcaattaagataacaatccctttgacaaccagctgataaaatgatgagacgccaagcagattaagtccgttattaagtgtgccgatgatcagcaccccgattaacgtgccgacaatgcgtcctcggccgccggaaagacttgtccctcctaagacgactgccgcgatagcatcaagttcgtacgattctcccgcagtcggctgggccgaatgcaggcgggaagtcaatatggcacctgcaagagcggataaaagcccggctaaagaatagatcatcactttcacgcgcgtcactttgatgcctgaaatgagcgcggctttttcgttgccgccgatagcgtacgttcggcgtccgaatggtgttttatgaagaagcacccaaaggatgacaaaggcaagaaccatcgtaattgccggtacaggaatgcctaaaaagtaaccgcgtccgaacatctgaaaaccgtagtttgtgccaagtccggtaatcggatttccatctgtatacactagcgtcagtccgcgaaacacagtcatggtcgcaagcgtggcgataaagggcgccatttttcctttagtaatcaataatccgttgatcatgcctagtacggcaccaatgatacagccaaggatgatcgcgagaaccggatcgacaccggacacaatcatccccgcaactaaagcactggacagggcaagaatagcgccaacagaaagatcaatgccgcctgtcaaaataacaaaggtcatcccgaacgcgattaatccgttaatggcgacctggcgaagcaggtttaaaatattcagcggttcaagaaagctgggatttaaaatagatacaatgataacgagaataaataaaccaagaaacgggccgagtttttgcatgactccgtcgaagtgaatccgtttttgttctgtttgcagttgttccgttttcatattaccgccctcccgtggcaagtgtcataattcgttcttgtgttgcttctcgcgcatggatttcgccgctgattctgccttcatggacaacgataatccgatcgctcattcccagaatttcaggaagctctgatgacaccatgatgatagcgacaccgcgttcggtcagctcattcatcagcgtataaatctctcgtttggcgccaacatccacacctctggttggctcatccaagataagcactttcggtccgatgccgatccacttggctatcaccactttttgctggtttcctcctgataaatggcgtgcgtgcgtttccggtgatgctgttttgatagtgaggcgcttgattaacagatcgacaaattcagcctcccgcttatgatcaatgagaccctttggtgagaagctggacagattgggcagggcaatattttcgcggatcgaggtgtcgagcaggagcccttcatccttgcgattctctgtaataaagccgagaccttttttcacggcttcctgcgggttcttaatagccgtttttttcccagcgatccatatctcacccgtgtccagcctgtcaacgccgaacagcgctctcatcatttctgtccggccggctcccattaatcctgaaacaccgacgatctcaccggaacgcacataaaagctgacgtcctcaaaactcccttttacggaagcatttttcacctcgaatactttgtcaccgagagaaggagtgcgttttggatatcgttcagtcagctcccgtccgaccatttttttgacgacttcatcaaaatcagtttctgagatgtttgttgtatctaccgtttttccgtcacgcatgatggtaattctgtcgcaaatcgcaaaaatttcttccatgcgatgcgaaatatagacaatggagacgccgttcttttttaacgctgtaatgacctcaaagagcttgctgatttcacgttcagtcaacgctgcggtcggttcatccataatgattacctcggcatttgtcataagcgcttttgcaatttcgatcatttgctgctgtccgacggaacattcgccggcttcttgatcaagagaaagagagacggaaagtttgtcaaattgctcttttgctagcgctttcatttttcttgtttgtaaaacgcccagcttggaggatatctctttaccgataaatagattctcaagaacggtcatttccggccagatattcaattcctgatggataaaggctattccatgctgttccgcttctttcggattggaaaaatacgtttcgtttccgtttatgctgatttgacctttatctgctttgtgcaggcctgtcaaaatgttcataagcgtggacttgccggcgccgttttctcccattaatgcgtgaacctcgccaggcatgagctgaaaggaaacgcctgacagcacctgattttttccgaatgttttatgaatgtctttcatttcaatctgcatgtttcatcttcctttctagaaaagtacacctgcctgcaggatgcagttggcatatggtgtgaattctcctgttcttatgactgcctttgcatcttttgtcagcagcttaaactcctcgtgagaaaggtattcaatctcttgttcagagaaaagattttctagaaatttcgcattctcctgattggatgcttttatttcagctgcagcaatgactttttcgaccgccatttcctcagccagtactgccgctgtatcttggaaagccggaaggcccggcttcagtgaaagatcaattttcaaaacgccgtcaggaaccggcagtccggcatccgcgatgacaattttatcagtgtggccaaggtcggctaaaatcttggcaagatggctgttcagtataccgtgttttttcatgacagcagctcctctacttcatttcttgtcggcattccgccttgggcaccgaaggagcagacagaaagggaagcggcacgattggcaaaccgcaatgcggcttcaatgtcttttccctcagccagggccacggcaaatgctgcgttaaacgtatcaccggctccggttgtatcaacgggttctacagggaaggacgggatgagcacctctttgctgccagccgaatagcggacgccttgttttccttccgtaataaagagctttgccggataaagcgccagagcttcggaaatggtaagctcagggaataaaatcgaagcctcgtgttcattcggcgtcagataggtagcgtgatcaattgtttcctgcttgagcgggcgggccggtgctgggtttagtatgatcgggatatcgtgagaatggcagtatttgcacacctcatcaaccgtttcttctgggatttcctgctgaatcagcaccatatcgaccttttcaatctgttcgagcgcgtttaacgcatacgctggggtgatgtcatcgttcgcgcctttgacaacgacaatgctgttgtcgccttcagcaagcacaatatgagcggttccgctttccgtatgtgtaaccggttccatataatcagtgcgaacgccgttagctttgagattattcaaaatagctgttccataatgatcgtctccaactttgccgaccataaacacttgcgccccaagtctggctgcggcaacggcctgatttgctcctttgccgcccggcacagtctgaaatgacgtgccaagaaccgtttcaccggcttttgggcgtttgtccgaggtgaccactaaatccatagaacagctaccaatcacacaaatattacgcatcttaatcttcctttcttgtcgtctttcttcctatataggtgacaggcatttgaattgccgtttctgccagcggctgttttttaatgatacccaaaagcagtttggcagcttctttccccatatcatatgcgggctgtttaattgtagaaagtggcgggaacagaagtccgctttgcggaatgtcatcatagccgataatttgaatgtcctccggcacgttttttccgcgccgcaatgcttcatgtaaaacggcagcggcttgaatatcattactcgcgatcacaccatctgtcgctggataagaggcaaacagctccttcgccatcgattgtgcatctttaattgaaaatgaagctgtctcaatgacctgaaaatcaacttcagcctgctttaagatttccaaagcgccgttaaatcggtcttgagcggtcggcaggtgagcgggtcctctcaagagcgtaatgcgctggctttttccgtgaatgatagcctgggcggctaactttcctcctgtatagccgtcactggacacagaaggagccccttcaagcgttctgtccagaaaaacaactggataattcatgccgctgtattcctcgagatccgggtaattcgttgcggcaataatgcctgcgacatgattttgcttaaaggtttgaaggtattcaagttcttttttcaattcctcgtcactgttgccgaaaataaggcgatagccttcccggttcaattcatcctccgcaccgcgggcaagctgggggaagaaagggtttgtgatatccgggagcaaaagtccgatcagtcgggattctcttttatatagagatctggcgacttcattcgggtaatagttcagcttcgccatcgccgctatgacacgcgttcgcgtttcttcgtgtacatagccgttatcattcaggacgcgggaaaccgtcgcaactgaaacgcccgccgctccggcgacatctttaattgtagccaaaacagctcctccttgtttatgtaaccgtttacatagatagattatcatgaacaatccgaagttagcaataaaaatatcaaaagaaatctaattgtaaattgtatatataattgaaaaatttaaggttttcactctttttttgacaaagtcttcacaaatatggatgaagatttcttgaacaaatattaagttttattaaaattgtttcaaagtcatgcgtttagacctgtaaatggggagaaacagaaaagactatcatcccagaaaatgtttaattatgttagagaattcggactcgtatgtttagcgttttcatctcgaacctccttagtcattttggaatgggcctcatattgcttattccatgcagaaaggatgacattatgaccttgtccttaagaaacaggataaaattattttgtgttcataagaaccggaaacacgcatgatagcaggaaatgcttgataacaaaggctgaaaaaaagattgatttgaaatgcatattaaatacaaacagcagggtgtgactatacgtccagaaggatatcaggagaaaaatgaaagcgcattctctttgatttttttaaaaagtgataaggtataagtcctgctgttttccaaaaatagaaaacagtttgtaggtataaaatctctttcaaaagagaagtttggcttagtcgattagggaagattatgttacataatgccgattgagaattcatagtgattctatatactgatgaatgaatttacaacaatatagaaggagatgtcgaaaagcaatgtggttactcattatagcctgtgctgtcatactggtcatcggaatattagaaaaacgacgacatcagaaaaacattgatgccctccctgttcgggtgaatattaacggcatccgcggaaaatcgactgtgacaaggctgacaaccggaatattaatagaagccggttacaagactgttggaaaaacaacaggaacagatgcaagaatgatttactgggacacaccggaggaaaagccgattaaacggaaacctcaggggccgaatatcggagagcaaaaagaagtcatgagagaaacagtagaaagaggggctaacgcgattgtcagtgaatgcatggctgttaacccagattatcaaatcatctttcaggaagaacttctgcaggccaatatcggcgtcattgtgaatgttttggaagaccatatggatgtcatggggccgacgcttgatgaaattgcagaagcgtttactgctacaattccttataatggccatcttgtcattacagatagtgaatataccgagttctttaaacaaaaagcaaaagaacgaaacacaaaagtcatcattgctgataactcaaaaattacagatgagtatttacgtaaatttgaatacatggtattccctgataacgcttctctggcgctgggtgtggctcaagcactcggcattgacgaagaaacagcatttaagggaatgctgaatgcgccgccagatccgggagcaatgagaattcttccgctgatcagtccgagcgagcctgggcactttgttaatgggtttgccgcaaacgacgcttcttctactttgaatatatggaaacgtgtaaaagaaatcggttacccgaccgatgatccgatcatcatcatgaactgccgcgcagaccgtgtcgatcggacacagcaattcgcaaatgacgtattgccttatattgaagcaagtgaactgatcttaatcggtgaaacaacagaaccgatcgtaaaagcctacgaagaaggcaaaattcctgcagacaaactgcatgatctagagtataagtcaacagatgaaattatggaattgttaaagaaaagaatgcacaaccgtgtcatatatggcgtcggcaatattcatggtgccgcagagcctttaattgaaaaaatccacgaatacaaggtaaagcagctcgtaagctagggggaaatgcagacatgttcggatcagatttatacatcgcactaattttaggtgtactactcagtttaatttttgcggaaaaaacagggatcgtgccggcaggacttgttgtaccgggatatttaggacttgtgtttaatcagccggtctttattttacttgttttgctagtgagcttgctcacgtatgtcattgtgaaatacggtttatccaaatttatgattttgtacggacgcagaaaattcgctgccatgctgataacagggatcgtcctaaaaatcgcgtttgattttctatacccgattgtaccatttgaaatcgcagaatttcgaggaatcggcatcatcgtgccaggtttaattgccaataccattcagaaacaaggtttaaccattacgttcggaagcacgctgctattgagcggagcgacctttgctatcatgtttgtttactacttaatttaatgtaaggtgtgtcaaacgatgaaaaaagaactgagctttcatgaaaagctgctaaagctgacaaaacagcaaaaaaagaaaaccaataagcacgtatttattgccattccgatcgtttttgtccttatgttcgctttcatgtgggcgggaaaagcggaaacgccgaaggtcaaaacgtattctgacgacgtactctcagcctcatttgtaggcgatattatgatgggacgctatgttgaaaaagtaacggagcaaaaaggggcagacagtatttttcaatatgttgaaccgatctttagagcctcggattatgtagcaggaaactttgaaaacccggtaacctatcaaaagaattataaacaagcagataaagagattcatctgcagacgaataaggaatcagtgaaagtcttgaaggatatgaatttcacggttctcaacagcgccaacaaccacgcaatggattacggcgttcagggcatgaaagatacgcttggagaatttgcgaagcaaaatcttgatatcgttggagcgggatacagcttaagtgatgcgaaaaagaaaatttcgtaccagaaagtcaacggggtaacgattgcgacgcttggctttaccgatgtgtccgggaaaggtttcgcggctaaaaagaatacgccgggcgtgctgcccgcagatcctgaaatcttcatccctatgatttcagaagcgaaaaaacatgcggacattgttgttgtgcagtcacactggggacaagagtatgacaatgatccaaatgaccgccagcgccagcttgcaagagccatgtctgatgcgggagctgacatcatcgtcggccatcacccgcacgtcttagaaccgattgaagtatataacggaaccgtcattttctacagcctcggcaactttgtctttgaccaaggctggacgagaacaagagacagtgcactggttcagtatcacctgaagaaaaatggaacaggacgctttgaagtgacaccgatcgatatccatgaagcgacacctgcgcctgtgaaaaaagacagccttaaacagaaaaccattattcgcgaactgacgaaagactctaatttcgcttggaaagtagaagacggaaaactgacgtttgatattgatcatagtgacaaactaaaatctaaataatcggagtgataaagatgaaatttgtcaaagccatctggccgtttgttgccgtagccatcgtgttcatgtttatgtcagcttttaaattcaatgatcagctgacagatcaggaaaaacagaagattgatatggaaatgaataaaatccagcagcaggaagaaccggtaaacgccaataaataattcaaaaaagagagtgtctgatgagacactctctttttatttgcccagcatattcattctgtaaaaatattaaaaagtctcttaacatattcaaaaaaataccgatgttaaaactgcaaaaagaggaggagataataaaagtgaacacactggcaaactggaagaagtttttgcttgtggcggttatcatttgttttttggttccaattatgacaaaagcggagattgcggaagctgatacatcatcagaattgattgtcagcgaagcaaaaaacctgcttggatatcagtataaatatggcggggaaacgccgaaagagggtttcgatccatcaggattgatacaatatgtgttcagtaaggctgatattcatctgccgagatctgtaaacgaccagtataaaatcggaacagctgtaaaaccggaaaacctgaagccgggtgatattttgtttttcaagaaagagggaagcaccggcactgttccgacacatgacgccctttatatcggagacggccaaatggttcacagtacacagtcaaaaggggttatcatcaccaattacaaaaaaagcagctattggagcggaacttatatcggggcgagacgaatcgctgccgatccggcaacggctgatgttcctgtcgttcaggaggccgaaaaatatatcggtgtcccatatgtgtttggcggaagcacgccgtcagagggctttgattgctcggggcttgtgcaatatgtgtttcaacaggcactcggcatttatctgccgcgatcagccgaacagcagtgggcagtgggcgagaaggtagcccctcagaacataaagcctggtgatgtcgtctatttcagcaatacgtataaaacgggaatttcacatgcaggcatttatgcgggcgcaggcaggttcattcaggcaagccggtcagaaaaagtaaccatttcctatttgtcagaggattactggaaatcgaagatgacgggtattcgccgatttgacaacctgacaatcccgaaagaaaatccgattgtttccgaagcgacgctttatgtcggagaagtgccttacaaacagggcggagtaacacctgagacgggatttgatacagctggatttgtccaatatgtataccagaaagcagccggtatttccctgcctcgatacgcaacaagccagtacaatgccggaactaagattgagaaggcggacctgaagccgggagacattgtgttctttcaatcaacaagcttaaatccctccatctatatcggaaacggacaagttgttcatgtcacattatcaaacggcgtgaccattaccaatatgaacacgagcacatattggaaggataaatacgcaggaagtatacgggtgcaataaaagaaaaagactccaatctctggagtcttttctttatgcatattgccccgaaagaagctggtctataaagtaggccacaccattttcgtcattgctttttgtgacaaaggtgcttttttcttttaattcatcaatcgcattttccatggcgatacggtgtccggcgacttcaaacatggacaaatcgtttggactatcgccgatcgcatagatatcctgtgtttcaattccgtatatgtcagccagctttgttaacgcgcgtccttttcctgacgaggccggcaggatttcgataatatgttttcctgaagaggtttgcgccagttttttatgatgcttcagttcttccttcgcttgtttcagcttgtccatatcaaaggagaagcaaagaagcttataaatgttttcaccgccgtcaaaaaccgattcgatatgagggattggtttaatgccaaactgtttgaattgagtcatggctccttgccacaagtcatccgtctgctcgtttgggtttgcgctctttagaatgtcaagctccgcgtgcagcttagcttcgccgtcaaaaggagaaagcagatggtcatctgtatatacctcaaagtaaatgttttttgaaagtaagtaatcagcaatcgctttaccggcttcctgatccattaatgtccggctgatcaaacggtaacccgtgtcgtggatcgtaccgccattagctgcaatgatagggatgtccaagtcatccagcagcgcttttacatcaaatgtcgctcttcccgtgcaaatggtgacgaggatgccggcatcaacggcccgcttgatcgcctctctgttttccgcagaaatgacgctttctttattcagtaatgttccgtctagatcaatcgcaatacatttcatatgtaggggaacctccttaaaaatgaagctgcttcgtgtagtatgttcagcttgcctgtgaaacataatccatataaattaaggctaaacgttactttgataattttcaacaaggaaatatgtaaaacgggatggcgtaatcgccatcccgttcattatacacctaaatcgttttgcagctcttttttaacttcctgcagcttttgctgattcaatttgaaataatagactccggcaggttcataatcataacccgtcagctgaatagactcaactgatttcaatgaagtgatgaacgggaacaggccgatggcatctttaagagataagttcatttttaaattttgccccatcgtatccacaatatcatcataagccggaattgagctcaatgattttgatttatctataatggcgctcagcacttccatttgtctttgcccgcgtaaaaggtcactgtccgctttacgtgttcttacgtaagcgagcgcttcttccccatcaagcgtatgtgttcctttttgaagaacgactttaccttttgtatcttttttgatttgctgaatgactttatcgctttttacagttactttgacgccatttaactcgtttacgacgtcttcaaaagccgtgaaattgctttctacgacataatcgactggaatatccagcatttcttcaactgttttcacagttaagtcaacgccgccgtaagcgtgagcatgtgtgaatttatcatacccgtggcctgggatgtttacataggcgtcacgcggaatgctcagcattttagctgttttttctttccgattaaatgtaaccagcacattcgcgtcacttcttgcctgatcgacggtctcgccgtttttctccctggcatcaattcctaagagcaatacagaaaaagaatcttttccaggatcaaattctttgatccgttttacagattgttctccgcgtgcaaggctgacatgagcttccttagaagcattgttcagctttacaaaagcataggcgccgacagagcctgccgcaatgactaaaaaagccattaatccggcaacaactttcacccatttttttagttttcttttttctttctgcgctgtgatcgttcttccatatatcaatacctcacgtttctttaatatttgaagcgtaccattctatttgccatggggcaactactcgaaagacatttttcgataaatattcctatatttataagttcttgtttttgaaaattgataacgataatgtactgaatcaccttatattggacgccgcagcaggtaaaatgtttcggcgacattgaaaaaaatacaagtaaatgattggaaaacttatgatcagaaaaataaaaaggtttaatggccggaaaaagaggctaaaagatttctaaaaaaatcccacagacaatgtcattgcagctgatggagaaagggagtcatctttatgaaaaagcagtcaaatatatggctttattttttcggagctcttggaggcgcgttatatggctatgataccggagtgatttccggagctattttatttatgaaaaaggagttaggcttaaacgcgtttacagaaggtcttgttgtcagctccttgctggttggggcgatattgggctcaggagcggccggcaagctgactgaccgtttcggaagaaaaaaagcaattatggcagccgcgctgctgttttgtataggcggtcttggtgtggcactggccccaaatacaggagtcatggtgctgtttcgcatcattttgggacttgcagtcggaacatcgacgacaatcgtacccctttatttatctgaactggcgccaaaacataaacgcggggcgctgtcatcactgaatcagctgatgatcacggtcggcatccttctttcttacattgtcaattacatatttgccgatgccgaagcgtggcgctggatgcttggattggctgctgtgccgtcattgctcttgcttattggcattttgtttatgccggagagcccgcgctggctgttcacgaatggcgaagaaagcaaagcgaagaaaattcttgaaaaattgcgtggcacaaaagatattgatcaggaaatacatgatataaaagaagcggaaaagcaggatgaaggcggtctgaaggagctgttcgatccatgggtgcgcccagcgcttattgcaggtttgggactcgcttttttgcagcaatttatcggaacgaatacgatcatctactatgcgccaaagacctttacaaacgtcggattcggaaactccgcttcgattttaggcacggtcggaatcggcacagtcaatgttctcatgacattagtagcgattaaaatcatcgacaagattggaagaaagccgttactgctattcgggaatgcgggcatggtgatcagcttgatcgttctcgctttagtaaatctctttttcgataacactccggctgcctcatggacgaccgtcatttgtttaggcgtgtttatcgttgtctttgcggtcagctggggaccggttgtgtgggtgatgcttcctgaattgttcccgcttcacgtcagaggaatcgggaccggtgtttcgaccttaatgttgcacgttgggacactgattgtttcattaacctatccaatattaatggaagcgatcggaatcagttatttattcctgatttatgccgcgatcggtatcatggcgttcttatttgtccgatttaaagtgacagagacaaagggaagaagccttgaagaaattgagcaggatttacgggacaaaaacggacagggaggagcggccggaaaacagcagactgtcggaacataaaaaagggtgcgcgatcatgcgcacccttttgattgcttactttcccaccgtgccaaagttaatgattttaaaagaaatatcgtacttaaaatcagtctcagaaaatatttcatcccaatgcccttttactttattccagtagtcagggtgttgaatccttatgtggtctgataaaaagaccggatcggttttatactcgtgctgcagtttatccatcacctgctttacatctcgttcaagctttttttcaaaaatgttttccagcctgtgcaaataacttttgctaaaggagttttcattcgggttttggtcttctgtcaggatgcccttcgttttaacagaaatatgaaagacaggctttccgttttcaatgacgggcttaattttcgttttcgactttttaatttcaaacgtaatcggatgtcctttatctgtcgtcggcatgacaccgccttggatcgtccccatgacccatgacagtgtttgggtttcatcagctgaaagaaacccaacgagtttattgctgccccttttgataatgcctgctccgtcatacttggcttttcccttttcgtttttcacggcttgaataagataactgtacccgttctgagagtagacagaagctcttccgatgcgcagcggtatcataatcttaccgttatatccgctgtgagttgtcaaatcaatcagtttttcggagggcatcggctgctgctgattggggtttccttttgtgaaaacatcagctgcattccctctggctgccatcaaatagctgcttcgccgcagctcatcatcccggataaagtggttgaggacttggtctacattttgattcctcatcagtttttctcccagaaggatcacttttaaatgatcgctataaacaggagggtccttgatggatacatcactgactgcttccagaatcgttttcccgtgggacgttacattaacaaattcgggttttccggatgcttggctgtcttcgctttggggaagaagattttgatacgtcagtttgtactggtgatcatttgtctcatcgatcgccagccctctggcgaaggatagttgctcgatatctttgacatcccagcagccgcagagggccagcagcataaaaaacatgacggagaattttgatgctgttttcattgcagctgccccctccctatttttttctgtatccagcttaaaaaccagacgaagaatggaattgtaatcacaattaagaaagcatatccaagaagcgtcccgtaataaaacacgtcattcaagtccttgggatacatcgttatgaaaaacgtcgcagccagcattgcagtcagcagccatgcattgtttttattttttagatgaaagatttccgttaacccgatatgggcgcctttaaaggatccgagcatacaggcaaattgctgggctgtccaggtcagctgtaagaacaaatcaaatcgttcaataaaaatacccggaacctctaatgcgtgaataagggaaatggtcggccatgtcaccgtttttgcctcagccacagtcatacagccaatcacaatgagcaaagtaatgctgtagaacaatgtggaagtcgcgatgcccagagcaacagcctttttcacttgctttggatctctcataaaggggaccaggtaaaaaatgatttcaaatccggagaaatataataatgtttttgggaataaagagaaaaagctttgatagcctccttcaaataccggccggataaaatcaagctggaacaagcgaaagctgaacatcagaagcatcataaaaataataagggttataggaaaaatataagcgtatacttttgcaattgaataaacgcctccgcctacatgatagatggcaactgcaagaaatataaacaccacaactgccattggcgtatttttcaacaaaaagaatccgacaacctctcccaaaatccgagcttgaaagcaaacaatcccaatgaaatatagacagatatataaattcaatagaaagccgatgaattttccagctacaatgctgttgagcttaaaaagagtttttccgctgtttttttgaagaaaaggcaaaaaaagcagaacgatgataataaaaataacgccctggagcagtatcattagccatccgctcggactgccggtttcggcggctgagcggggaagggtcagcaccccggcaccaatcaatgtgctgctgatcataatgagcgtctgcataaatgtcagtttatgctctgatttcctcatagccatcacctttgtctgatgttatcttcgggatcgtttcgtgtcggtcttctttttaaaaacatcgtgggaatacggatgactgtgtctttcaaatcctgtccaggctgcgccatgatcgggataatgtaatcctggccaaagcttttcaggcgcatgagatggccgatcacaaacagataaaccattataacgccgtacatgccaagcgctgttgcacttatcataaccccgatccgaatgatccgcagcggaaagttataggcgtatgaaggaacggtaaaggatgccagtgctgtgacagaaacgacaatgaccataagcgcactgacaatttgcgcctgaacagctgcctgtccgatgacaacgccgccgataaggccaattgtctgtccaatcggcttaggcagccttaatccggcttctcgaatcaattcgatcgtaaagatcatgataaaggcctctacaaaaggcgggaatggtacgttaagcctgctgcctgcaatggaaatggccattctagtcggcaatagcccggtgtgaaaagaaacgagagaaatatacagaccgggcaaataaatggtgatcaggatgctggaataacgaagaaggcgtacaagtgacattgggatccagcgctggctgtaatcatcgggcgaatgaataaattcgtcaaccgtagccggtacaatcaaagcaaacggcgtaccatccactaatatggacactcgcccttctaatagagaactttcgacccggtccggtcgttctgtgcttaatattgtggggaaaattgaaaatggttcgtcttcaatcagctgttcaagcgtccccgattccggcaaattatctatattgactgatttcagccttttaaacacttctttgacgacataatctggggcgatatcctgaatataagcgacagcgattttctttttggtcctttttccgagtgtcatttctttgatgacgagattaggatcactcgtccgttcacgcaaaagcgccgtgtttgtccgcagcttttcaataaatcctattttagggccgcgttccacgacttcggaggagggttcatcaagactgcgtgttgcgactgactttgtgtcgaaagctaatcctccgcgatagccatcagcgagcaaaatggcttgccctgaaaaaacgagctgctctatttctttcattgtagaaacaacgctgtggtgaaagccgaaaaaaaaggcggataagtcttcaatcgagcattccttatgggccaacgcctctttttgtaaaggagaaatgacgtattgcgccagcattttattctctgtcagaccgtcaatatacagtaaacacgccttttgtctgctatctccgaaagcaaatgtataaaacatcatatcgtcgttttgtcccaatgtttttttcagtgtgtctaaattgttctggagatcagagtcgatttgcatagtttctctccttcttaaacatattgacggtttttattaatttgtatcaaaaaaggagaattattcttatcgaggaaaaggctgaaacaaagcttcttttcgacgtgatataatagataggaagcgttttctttgaaggggtaatgaaaagatgatgctttgtacatatgttgtcataggaaaaaggcagcttatacgggcgtttgtaagaggggcgcaccgggaaaatgatgatcagttatttacaggggaggggtacggatcatgacgcaatcaccgatttttctaacgcctgtgtttaaagaaaaaatctggggcggaaccgctttacgagatagatttggatacagtattccttcagaatcaacgggggaatgctgggccatttccgctcatccaaaaggaccgagcactgttgcaaatggcccgtataaaggaaagacattgatcgagctttgggaagagcaccgtgaagtattcggcggcgtagagggggatcggtttccgcttctgacaaagctgctggatgtgaaggaagatacgtcaattaaagttcaccctgatgattactatgccggagaaaacgaagagggagaactcggcaagacggaatgctggtacattatcgactgtaaggaaaacgcagaaatcatttacgggcatacggcccgctcaaaaaccgaacttgtcacaatgatcaacagcggtgactgggagggcctgctgcgaagaatcaaaattaaaccgggtgatttctattatgtgccgagcggaacgctgcacgcattgtgcaagggggcccttgttttagagactcagcaaaattcagatgccacataccgggtgtacgattatgaccgtcttgatagcaacggaagtccgagagagcttcattttgccaaagcggtcaatgccgccacggttccccatgtggacgggtatatagatgaatcgacagaatcaagaaaaggaataaccattaaaacatttgtccaaggggaatatttttcggtttataaatgggacatcaatggcgaagctgaaatggctcaggatgaatcctttctgatttgcagcgtgatagaaggaagcggtttgctcaagtatgaggacaaaacatgtccgctcaaaaaaggtgatcactttattttgccggctcaaatgcccgattttacgataaaaggaacttgtacccttatcgtgtctcatatttaaacttaatctcacttcgaggttaagtttttttattagaaaatggaagtgattcacctataaatgaagcatgcgcgtgccgataaataaactagttttatatactcatagaataagaaagaggagaaggaatgaaaaagagactaatcgcacctatgcttctatccgccgcgtcccttgccttttttgccatgtctggttctgcccaggcagccgcgtataccgactactcactatataaagtagagccgtcgaatacgttcagtacagaaagccaagcctcacaagctgtcgccaaactggaaaaagatactggctgggatgcatcctatcaggcttcaggcacaacaacgacctaccaaatttccgcctcaggcattcatagcgaatcagaagcgaaagcaatactgagcggactcgccaaacagacatcaattacaggaacgtcaagtcctgttggaagcaaacagccatatgtcaccatctcgtcaggtgccatctccggagaaaaacaggccaacactatcctagcaaagctgaaacaggagacgggagtggctggcgctgtaaaagcttacggagcagctcagccctatatgaacgtcatgacatcagacattgctgatgagacaaaagtcaaggcgcttatccagagcctggccaagcaaacggggattaaaagctcgtatcagcccatcacacacacggtgtctgtcacaaccattcagtctggcacaatcgtgggagacagcagagcagcgcagatcaaaaacgccttccaaaaggaatctgggctgcaggcatcattaaaggaaacagtgaaagggcaagcctattatacgttcacaactgccgccatttcaggtgaagccaatgccaaaactctattgcagcagctgaaacagagcactggcatcacaggcagctacaagtccatcaatcaaaaaacaaccgttgagtcatacaatgtccaatcagcttatttcaaagggctgagtacagtaaaggacgccatcagccaaatcaagaaaaacactggcgtatccggcagttatcaacaggttggaaaaagcacatcatataccgtgaatatgaagggtataacaaaacagcagctccaaaaaatagacactttctttaaaaagaaaaaatggcattacacgtcatccagcgtcaaaaaaacgacaacgtctgcagcttatcaaatcacgacggcaaagattttaggcgagcagcaagcaaacaaagcagcagccttctttgctcagaaaaaagtaaaagctgcaaaaacagcagctggatcaacagcagaaaatcaatatcagctcatctcagaagaaacatcagatcaagcaaaagtcacaaagggtttgaacatattaaagaaaaatcagctaagtgcttctgcgaaatccgtcaaaaaacaaatagctgacacgtttaaaatcacaaccgaatctctgcttgatcaaacgaaagtcaatcaggcactcacgtttttcaaatcgaatcatatatcagtagcaagccagaaaaccggtcagacagctgcgagcagctatcaaatcacaactgaagctatcatcagccaagaagagattgaccgcgttttaacatttttcaaacaaaatcatatcgcagtcacaacatcaaaaacaggccagactgcatatacacaatacaaaatcgtgacaacacagcttagcagcaaaaccgcattgaacaatgggttaacctatcttaaatcgaaaagtgtaaccccgagctatacaacgaaaagcaatacgctttataaaatcagcgtaaatgagcagttcacaggcaatgatacagctgctgcggcatcaacgaagctaaaacaattatacggatggacatcatctatcgtgaagatcaaaaacggcccgcaaatcatgaaaacaaactacaatctctcgcttcgtgatatggtccaaaaacaaatgacagtaagtccgcaaacagacggagcggcttacgtatcgctcacgtacattaatacagcaacatcaactgttacggctgatgtactaaatatccggtcaacgccggaagtcagcccgacaaacgtgatcggccagtttaaaaaaggcgataaagtgaaagtcatcggacagataaacggctgggctaagatcaatttgggctggcgaaacgcaagcagtgatgaagtagttcaatacgtggatccgaataacttttccagagacagcaaatactacttccaatttctcaagctgtcacagacagcgggtctcagcgttactgaggtaaatcagaaagtgcttgcgggtaaaggcatcctgacagggagagcaaaggcatttatcgatgccgccaatcaatatagcatcaacgaactgtatttaatctcacacgctcttctggaaacaggaaacgggacatccgctttagccaatggattaacctataacggaaaaaccgtatacaacatgtatggaattggagcatacgacagcaatccgaattactacggagccaaatatgcgtacgagcagggctggttcacaccagaagcggccattatcggcggagctaaattcataggctcatcgtatatccacaacacagcttacaatcaagacacactgtacaaaatgagatggtcagctacagcgacacatcaatacgcaacagacatcggctgggcgtacaaacaagtaaaccgcatgtacagcctgtattcattgctggacggttatacactttattttgatgttccggaatatcgataaaaaacttagaaagttgcaaataggctgtagctattaaatagctacagcctatttgattatcacacctcaatcttgtccgcaacaatcataaaaatactcattcttgaagcatttgagatggctgcatcatcgggtctgatttttgtactccctttcataaaacctatttcaagcacatttgatttttctccgccggcaaaataccaggatcccattcggatatccttttgttttaagcggaaatctccttctatcgattgatgcagtaaactaatatagcgttcatttaatgtgacttgcaagtttccatctgcattgatagtaatatttcggactaaatttgatgtgtaagatggtaaataacctgaagtcggaaccatccattttttgttttgagcattatactctaaaatgaaggtttgaataaatggttgaaatctttctggaggtgtatcttggtgccccacggtttttaataaaggggatcgaagcataggtacatgattcatgaagttttcataagaatggtatgcataaattctgcttatacgatttccttcttttccacttgtaattcccaccattaatgattttgccccagtttcaggattggtgtacatacagatcccttccggttcacggaagttattctcatatctggtggacaagtctttgccaacagtaatttctttttgcagcactattttattatcggaatcaaatacagttatgagattcggatagcttttgctgtttgtatctcctgtataccaatataaataaccgtcatctaaaaagaaaccttgtaaataatgaagttcgtcaggaatgttaatagtataaagaggattgtttttatttgctattgcatcgtccaggttaaagattgtcacccactgtttattattattattttttgtatcgtattgtctaattgccaactgtctattcttcatatcaagagcaggtgtaaccctatgatcgaaaggcatattcgagaatcgctgaagttctttagaattttcatctaaagtcgcgcctgctttatatgggaaacaaactaattcacttttatctgtttcgtttggtttatcgtatagagaccaaatataaatggtgccattacggttttcaattccaatatttgtaccatgacctccatgtttcaacagcatgctgtctaattgtaaaccttcaagagatagacgagttatgcgatagctttgggtgttgtcttttcctaatccacttgcgacttgggttgtataaatttggtggtttttctcatcgaaattgaatgattgaagtacggttttgtctgctacacgtagttcagtaaataattttggcgtgatgttggtgaaatcaaacagttctttttttctcataaatttaccacctctattattatttgctgccataagcaactaattacattaaagcaaacatacgttcggtattcaatagaaaaagaacacttgttctgttttgaacaagtgtcatcatttagcttattaaattttcgatgaaattcaataaattttggcttgaattcccatcagaatacttattccatctatcggaaaaaacttttattttggaataattaaatggggtttgaatttcatttattaatgattcactgtcatagcaggctcttccaggtattatggaaagataattatcaaccaatccccgcttctgttgataaagttttaaatcgtaagtataaaaaagaatgggtttatttaaaatcgaaaattcaaagggaacagaagaatagtcagtgattaatatgtctgcagccatgagtagatcaaacaaggcatagttagaaacatctttaatataatcactggaatatttaatatcaatattgttctgaatggcgggatgcagcttaacaaataaaacatattcttcttttaactgatgaattaattgttcttctgtaaaaggcaattgaattgattgcatattataatctctaaacgtcggtgcatagaggattatttttttctttgtatgtttagagtatctgaaattttttcttgttttctcggtaataagggtctgttaaaggtacacctatttttaataattggttatcctttattccaaatgatttcttgaagatatttgccatctcttctgagccaacagttaaataatcatacgaactgtatactttttggaaccttttaatatcagttttcgtccgttgcatgtttgtaatgtcttccaaaccaaattttttgagtgagccatttgcgtgccatacttggatacatttcgtttgcttccgcttatttaacacacttgttaatagaaagtaattatctgttatgatcactttactgttaaacattaggtatacagctttaatgagatggatagggtttttttcttgtaataaatatgcatctacattcgggaagctctcggcaatagcagaggcctgctgggtatacaggatgttaagtttataagagtattgtccttgttcatattcctcaagaatcgcttttgcgtttgcttcgaatgagatcaggagggtcactttgctttcaggtttcacccattgcagaaaaaaggcgattgctgataaaaaatacaaatagcaattcgccagtagtgatcttattttcatttttatcatccatttatttgaaagttttgtttttaaatctgttttgtatgatctttttcaggctttggatagaaagttttttgttttttcttcttttaaaaccgttaaagcatattttgggatgctaagcattcttttccatcgccatggattcaagattaaccggtagaaccattctaaatttaaacgtatcatccaggaaggggcccgtttgacattaccgctaaatacatcaaagcttcctcctagacctatagatacggctttagggaacaagtgtctgtagttatgaatgaatttctcttgatgaggataccctaaagctacgaataccatgtcaggatttgctcttgcaatttgttttgccactagggtgcgatcttgaacataaccgtctgaataacctgcgattttaatgtttgggtattcagaagaaattttggatacaacaccttttataacatctttcttcgcaccgtacagaaatatgcgttttttctttttgttagcaacgcccagaagttctttaaaaacatcgtaacctgcgattcgggactgaagcctgttgttagtcaaacgtgacatcatgactacaccgatcccatcaggcaaaatgaagtttgaagaagatagtacatcaaagtagtcccgatctttaatagctgcaaatgcaatttcagggttgactgtggaaatgacagcaccaatcttttgatcaatataatgtttctctaggtaatcgataaatgatgttaagttactgttaacataaggaatattgtgaatagtctctgtttgcatgtctggctcctccttcctttaagattctatttatatagttaaaaaccgagagtttctaaaagcaaaatcaagctaccttatattttaacataaatcttcaacaaaggattaacattatctttacattaaatttaaatatgtttccaattttacaattgaatgaacgaatgaacaacagaccttggtgccaatggagtctgagtgtaattacatattttggaatgtttttctcctcatgagtacttaaccttttttaggcggtatgctataattaatgatcagtgaagacatacgagaaatatgtcgatataaggaatacaaacaggtttttagaatttaatcgctaacgtcagtagtgtttttaatagtgtttaacattaggaaggagcgtttctttaaatgaaaaaagttatcacatatggaacttttgatttactgcattggggtcacattaaattgcttgagcgtgcaaagcagcttggtgattatttagttgttgctatttcaacggatgaattcaatttacaaaagcaaaaaaaagcttatcacagctatgagcaccgtaaattaattttagaaaccattcgatatgtggacgaagtaattcctgaaaagaattgggagcaaaaaaagcaagatattattgatcataatattgatgtttttgttatgggggatgactgggaaggtaaatttgactttctcaaagatcagtgtgaggttgtttacctcccaagaacagaaggcatctctacaacaaagatcaaagaggaaattgctggtttataatttaggatcctgatatcattggttcaatatctaattaaagtacttcttattgaaataagaagtactttttgatgcttacattgatttttgtgactaaagtatccgggtagatataaatttcaatgatcatatattctagatgccgaaagggagtaaaaaattgtctttacatgcggtgagtgaatctaatataaaacaaattcctgacatggattattattttatctctggtggactgccaagtaattatggcggtctgacgaaatcattattattgcgttcaaaattatttggagaagagtgtaaccaaaacacctttttcttaacgtttcgttttgatttagagttgtcttcaaaaattgatgaattgtacagcaacggtaagattgataaaaaattcacaagtgttattaatctattcgatgattttttaagtgttagaacaaatgggaaaagatcatacgaagaaaggataggccttgaccagataaaaaagcaagttggaatggggaaatttgcaaaaactctgttgagattgtttggtaagaagaacaatgaaatgtctgtagtttactacggagatggagaaactatccggtacgtcgactattggaatgataaaaaccagctcataaagagagaggaatatacgaagaacggaaacttagttctcgttactcattatgatgtgcagctaaacaagatgtatctgcaggaatatattaatgaccaaaatcaagtatatttagacaaactctatgtatggaacaatgaagaaaaagatgttcaattatctcatattatttggtactcccttgagggtgagataaaagtaaaagatgaatcggaactgcgtcaatattggatagaatatctgcaaaaacaaaatgataaacctaagttgtttttagtggacagcagaccgcaagacaaacatgtctttaaaagtgaaaaaatcaccttcttcctattatggagcaattattcataacaagcattacggcagcaataaatatcaaattaagggtcgctataaagaagtatttagtcagatgtataatttggatgctgtcttttttataactgaggagcagctagaagattttaaattgatttcaggggaacaagagacgtttttctttactccgcatacaattgataagcctcttgatcccgctgtattgaatgtgccgagtgaaaaatacaaagctgtcattatttcaagacttgcatctatgaaaaatctgatacatgcagtaaaagcatttagtttagtcgtgaaagaaattcctgaagcaaaacttgatatattcggatcgggtgaagatttcgaaaaaataaaaaagaaattgaagataccaaactgcagaacaatgtctttttgaaaggctatacggataaccctgactcagagtttcaaaaagcttggctaaccatttcaacctctcattttgaagggttcggtctatcaaatatggaggcactgagcaatggatgtccagttgtaacatacgattatgattacggagcaaggagcttagttactgacggagcaaatggatatgtcattgaacagtataatatagagaaattgggtcaagctattatctctttgatgaaagatgaaagtactcatcaaaaattttcagaacaagcttttaaaatggctgaaaaatattcaagacccaactatattgaaaattgggcttttgctcttaatcagatgattgaggtgcgaatagaaagagagaagttctctaaaaaggttggaaaaaaagatccttctattagttcctatactgaggattttgataaaactaaaatagaaattgacattgagaattttgatcataatgatattaaaaaaatacgtttagtgggcttggacagaaagaataaggctgaaattatttcaacaaacttacaaaatgatcaactgtttgtaattgatctcgaaaaagatgtaaatattgaaaagatagctgctaataaaacccaagttattgatttttatattgttttcaatgcaaatggccatattaaaacaatgcgaagactttcgagtgaagaaacaaaattgtcaggaaacagtatagatactaataatggctatagagtagagccctatacaacagttaaaggcaatttctcttggagggtcacggaaataaaagagagttaatgtccttagtagttgacactaataaaaggaagcaaaaaggaaagagcttttatacagaggagcagaaaaaagtaatgattgaaaacactgtgattaaatgtattttgaaaagcttgaaaaacaatttaggaagtcttgaattgttaatctcaattgattcagaacaccaatttttagaggattaccagttatttttaaagctgaaagagagacgttcaggaacggaatctgaatttccgcttcaaaacactggctcattagagtataaaactgagataaatgctcatgttttgcctatgcctgttgaaatgggacaaacatatgatttttatgtcgaatttcgaaaaaaatatgaagatgcggagcaggaaccactcttgaagcgtctttctgctgaagtaaattcaattgagcgcgcctttcatgtcgatcaaaccacagaacttttgattttaccttatacaactgataaaggcaacttttctattaaggtgaaaagagaggccaaaatcatcagatttgatcaaatcgagattagctctgaagaaataagcataacaggttatgcggggtacctgagttccgaaaatcaatatcggataaaaaacttgaaccttattttaaaaaagggtggagaaacacctattgaggaaaaatttccaatcaagctagaaagaaaaacacatggcctggaaaacatgagagcagatggttttgttccggaactgtatgattttgaagtgaaagtgcctttgaaagaaattcctttctcaaatgaaaaacgttatgtttatcgtctttttatggagtatatatgcaatgacgatgaaggaacggatattcagttcaacagcactgctcttgttttaggagatcgaaaaaacaaattaaaaggattagtaagtattattaaaacaaacaacgcaccagttcgttatgaagtctttaagaaaaagaaaaagcagactctaggtatcagagtaaacgactatagcctgaaaacaaggatgaaatactttattaaaggaaagaagaagagattagtatcaaaaataaaaaagatcacaaaaatgagaaacaagttaatcactaaaacatacaaatctctattcatgatggctagcagaatgccagttaaaaggaaaacagtcatttttgaaagttttaatgggaaacaatacagttgtaatccgagagcgatttacgaatatatgcgggaaaaccaccctgagtataaaatgtattggagtgtaaataaacaatattcagcgccttttgatgaaaagggaattccttacattaatcgcctctcattaaaatggctcttcgctatggcaagagctgagtattgggttgttaacagccggcttccattatggattccgaaacctagtcatacaacatatttacaaacatggcatggcacacctttaaaaagacttgcaatggatatggaagaagtccatatgcctggtacaaacaccaaaaaatataaaaggaattttatcaaggaagcttctaattgggattacttgatttccccaaatggttattcaactgagatctttacacgggcgtttcagtttaacaagacaatgattgaatctggatatcctagaaatgattttcttcataatgataataatgaggaaacaatatcattgataaagagtaggttaaatattcctcgtgataaaaaggttattttatatgcccctacatggagagatgatcagttctatgcaaaagggcgttataagttcgatctcgatttagatttgcatcaacttagacaagaacttggaaatgaatatattgtaatcttaagaatgcattatctggtagctgagaattttgatttaggtccttttgaaggatttgcatatgatttttctgcttatgaggatattcgagaattgtatatggtttctgatttgctgattactgattattcttcagtattctttgattttgcaaatttaaaacggccaatgctattctttgtccctgacatcgaaacctaccgggacaagttgcgtggtttctactttgattttgaaaaagaagctcctggtcctttggtaaaaactactgaagaaacgattgaggctatcaagcagatctcatcgcctgattataagcttccggtttcttttggtcctttctatgataagttttgctatttagagtcaggacgttcatctgaaaaggttgttaatactgtatttaaagctgaataatttaggttattttataaaatgtatagctgtcgatttttcggcagctttttagatacttgttgagaagtgaaaaaaaatgcaggatctgttacaataatcagcggtgctttcaaattttaaacagaaagattcccaaaaacaattaagtctaaggaagataaaaaatgaatgatttgttgcgtatactcagagagcaaataacgtcatttcctttaattttaagattggcggcttatgaaaccaagtctaaatatcaaatgaattatttaggtgtcttatggcagttcttaaatccgcttatccaaatgctggcctactggttcgtatttggtatggggattagaaagggcggtcctgtgacaaccggagcgggcgaagtgccttttattatttggatgctggcaggattaatcccatggtttttcatcagtccaactatacttgatggatcaaatagtgtatttaagcgcattaatatggtggctaaaatgaacttcccgattagttctctaccgtccgtggcaattgcatctaacttatttagttatatgatcatgatggtgatttatatcattgtactcctagttaatggtgtgttcccgagtgtgcattggttacaatatatttattacttcatctgtatgattgcttttatgttttcgtttagtttgtttaactcaacgatcagtgtgctgattagagattatcaatttttgctgcaggccgtaacaagacttttgtttttcttgttgccaattttttgggatgttaatgcgaaactcggtcaaagccaccccgaattagtgcctgttctgaagttgaatccactattctatattattgaaggattccggaacagcttcttagatggagcatggtttttccatgacatgaagtacacgctgtacttttggttgttcacattccttttattgttagtaggttctatcctgcatatgaaattcagagacaagtttgttgactttctttaatacgtaaggagattttacgatgaaactaaaagtttcgtttcgaaatgtttcaaagcagtatcatttgtataaaaaacaatcggacaagattaaaggattgttttttccggctaaggataatggtttttttgctgtgcggaatgtctcctttgacgtgtatgaaggggagacaatcggctttgtaggaataaacgggtcaggaaaatcgaccatgtctaacctgctggctaaaattattccgccgaccagcggtgaaattgaaatgaacggccagccgtcgctgattgcgattgctgccggtttgaataaccaattaacgggccgggacaatgtccggctcaagtgtttgatgatggggttaaccaataaagaaattgatgatatgtatgacagcatcgttgaatttgccgagattggcgattttattaatcagccggttaaaaactattccagcgggatgaagtcgcgtctcggtttcgcgatctccgtgcatattgatcctgacattttaattattgacgaagctctttctgtgggggaccaaacgttttatcagaagtgtgtagacagaataaatgagtttaaaaagcaaggaaaaacgattttctttgtcagccactcaatcggtcagattgaaaagatgtgtgaccgtgttgcttggatgcactatggcgagcttcgtatgtttgatgaaacaaaaacggttgtgaaagagtacaaagcgtttattgactggtttaataagctatcgaaaaaagaaaaagagacatataaaaaagagcagacagaagagaggaagaaagaagatcctgaagcgtttgcccgtttccgcaaaaagaagaaaaagccgaaatcactggccaatgccattcaaattgctattttgtctattctgactgtcttcatggcgggaacgatgttctttaatgccccgcttcgtacaattgcttcgtttggcgctattccgcaaaatgaagtgaagaaccatcatggcgatgcaaagggcaagtcagaggaacgcttaactgcaatcaataagcaagggtttatagcaaatgaaaaagcggctgcttataaggatcagggtttgaaacagaaggctgacgttacactgccattcggtacaaaagtaacggtagctgcaaaaggcaaacaagcagcgaaaataaagtttgacgggcactcttattatgtgaaacagagcgctgttgcaactaacatgaaacacgctgaattgcatgccactgcatttacgtcttatgtctcgcaaaacgcagcatcttcctatgaatactttctgaaattcctaggagacagcagcaccagcattcaatcgaaattgaatggttatactgaaggaaataaggctgacggcagaaaaacgctgaattttgattatgaaaaaatcagttatgtactggagaatgataaagcaacagagcttatttttcataacatttctcctatcaacccggcgtcactatccttaagtgatagcgatgtattgtatgacagcagcaagaagcgttttcttgtgaatacagatgatcaggtttttgcagttgataatgaagagcatacactgactttgatgttgaaataaaaaaaggctattggatgaatgtccaatagcctttttgtttagatttcttctttgtttagtaaaccttccataaatggaacgagctgatcgcgaagctctttatcctgcatcgcaaattcaagagttgttgtgatgaagccgagcttttcaccaacatcataacgcttgccttcaaaatcgtaagcaaacactctttgaatttcattcagtttttgaatggcgtctgtaagctgaatttctccgccggcgccaacctgctgctcctctaaatacatgaaaatctcaggcgtgaatacgtaacggcctaagatggcaagattagaaggtgctgtgtctttaggcggtttttcaatgaagtttttcacctgataacggcggccttcacttgtcagcggggcgatgatgccataacagtgtgtttcatcttcaggcacttgctgaacaccgataatagaagaaagtgttctttcatattcatccgttaattggcgcaaccctggtgtgtcagcctgaacaatatcgtctccaagcagaaacgcaaacggctcatcgccgataaagttaggcgcgaaccagacagcatgtccaagacctttaggttctttttggaggatatagtgaaagaaacttatcacttttttcagaagtgttcagtttttcctttatctaattgattttcgtttatatcatatcaaccctccttttcatctatatatctccatatgtaattcgtagtttagataaagtcccttagcctgataaagacttcactaaattttaccacgaaaatttttaggaactacgtattacaattccttcacgttttgacgatgaagtaatatgaggagggcgtacaaaataaatgacgcagcagaaagaaaatcattacacttgaaaacgcgacaaaaagaattgactcttccggaatagaaaacttgttgtaatgagtatagataagatatcagatctgtaaaaaatacacatcaatgcaacgatattgtcaaaaagtgctgatgatttacatttttaaagagccttaacttttataggaacatatgctattattgtttattattaatggaacgtaaaaaatatgtcgaaatgataaacaatcagttaaggatttttgttttttctaagttggaaaaggttggaaggtgatgttatctaatgaagaaagtgatacgtacggaatgtttgatttatttcactatggacatatgaagctactggaaagagcaaaagaacctgggattacttaatcgtacgattgtctacaaaggaatactatgaggccatttaccttacaagaatagcaggcatttcaactacccaaatcagaaaagatatggctagtttatagaagcactaactaaaagaggcttgaagtaaattcagttgcttctttttttcttgtttgcgtaaatattaatcttcactctttaaggagttcactgatgaaatttttattataaccaattgcagaagtttactagttagagtttattcagttttgtttaaaatttttgtccttctgccaagaaacaataaattaattttatttgaaagctattctggaaacagtttagctacaatcccctaccaattctacattatcaaataaggaattaaagaaaaataattttatatgcaccaactttgcgggataatgaattttaagaaagctggccagtataaatttaactttaatttgattagaggaaatgaagagggaaccttggagactctatggttattcttgtaagaatggtattatccagtttcagaacaatttaattagggaaatataaatattttgtgaacgatgtttctttaaataaagatattcgagatttatatttaattagtgatttattgattatggattattcttctgtcttttttgataatatgaatttttaaaaaaaccttgtattttttgtgtatgatctcccggcttatagagactgtatcagaggtttttactttaattttcagcaaaaaacgccaggaaacttgcttcaaacaagtgaagaacttatagatacggtaaaagagttgttacataatccttatatagatcataactatgaggatttttataataaattttgtaatttagaagaggcaaggcttctaaaagagtaattgaaacgatcctttaacttctaaataaagaggtacaaacatgttttctataattataccaatatataattctgaaaattatttaagatattcaatagagagtgtccttaaccagtcaattggatttaaggaaaatatagaactgatattaatagatgatggtagtgttgacagcagtcctcaaatttgtgaatcctttaaaaatctatatcctaataatattaaaatcatgaaaattgaaaactctggaccttctgctgcaagaaattgtggattatcaaatgtaagcgaaagatctaaatttattggttttcttgattctgacgatgcattctctcaaaatgcgctgcaaagtgtttatgattttttttgtgattccgaacatgtaaatattgcggtattacctgtttattacacaggtgaaaaagaagggggacataaattaaataatagatttgaaaaaggaacaagagttataaatattctcaacgattataaagctattcatttttatattggcggcactttttacagaagacatacactaactagtaccgtcctttttgatgaatctataaagttttgggaagacgctatcttttttaaccagttattactgaaagaaaaaagatacggagcagttgcagaaggaaagtatttttatagaaaacggaaagaacaggattctttagttgatcgttcatggtttaacaaaaaaaggtacacatatttgttgaatgaatgttacatgactttgttgatggattcattcaacaaatatgatatagttttgccttatttgcaatttttaattgtatatcatataaaactgtttttatatccgaactatagagatgtttataagtctgttttagatcaacaagaacaaagagtttttgttgatgattttattaaagttttaaaatttattgacccgcaatttataaaagaacaagatatgccgatgtactataaagaatttatgtttcacttattaaaagaaaatacagaagctcttgaaaatataaaaaaagaaagagtactgcatagttcatgtactgttacttcggcaaaaataaaagggcttagacttgaattaacagggcactttattaaccagtattatgagatgaaagaaaatgacagaatatatataaaatattttaaaagattaaaaaatgcaaacgaaaagaactgaaaaaacaattgaagtatggggatataaattaagagattttagatatgctggttttgttgtcgaaataccgatttgggcctttgcatttgactttgtactaaaaacaccaaatgattctttagaacttaaccatgtgaacatttttaaaagtttgcttacaagggtttttaaaaaaaggtaaggaatgcttttcatacattttactaaattaaaattgttttgcaaaaattagtactctcttgtttcttaattttatttacccgaattcttattcatataaacattatgttaggagtaatcttttatgaacgaaaaaagttttaactatgatttcagtgttataatgccgatttataatgttgagttgtatctcactgaagctatagaaagtatcattaaccaaactattggttttgagaatattcagttaatactggtgaatgatgatagccccgataaaagtgaaatcatttgtaaagaatatgctcagaaatatcccaataacattgtctatgcaaagaaacagaatggcggagtgagcagtgctcgaaattatggtttaaagtatgctgaaggtagatatattcaatttttggatccggatgatttagtttcagaaggaacattcgaaaatgttttaaacttctttgacgaacataagaatgaaattgatattgtagcaatccctattttttttgcagaaggaagaactggagaacataatctaaataataagttttcttctacaagaattttggatgtagaaaaagaaccgcatcatatattaactcattgttgttctacatttataaaaaaagatgccttgaaaaatatcaggtttgatgaaaattgtaaaataggtgaagatgccaaactagttaatttaatcatatcgcaaaagaaaaagtatggtctggttaaagaggcaaaataccattatagagttagagaagatggatcatctgccatgcagactgctaaagcaaataagaattggtttaaccattcacttatcactttctcaaagaatttaatcgatattataaaaaatcatgaacagaaaatacctttatttcttcaatatatggttatgcatgatttgaagtggaaattattgattaaggatatcagtgaaacacctttagacgaaaatgaatacagtgaatttttaacattgattcgagaagtattgtcgtatattgacgacgatgtcatcattgaaacaaaaagtgtcagccatttctatttatatcatgctttaaaaataaagcacggtgaaaattatagtaggtatgtatatgaaagagaaactgaacaggattattatttatacagagaaggtaaaattgtttcgaaattatcggatcaaactttaactattgaaattttagaagaaaatgaggattccattcacatagaaggcttttggagctcgctgtttaattctaaaggttttaagttttatgctaaaattggcgaaacaaaaataaaagcaaagaatataaaaagacagcataatgattatataagtttaggagaagtaataaaaaaatatcccggtttttcaatagatattcccaaaggtcatctagcagataatcatcatattgagttttttataactaagggtaaaaaaaggaagttgacaaaacttcgttttttcaagtattcaggtttgtcaaacgatttatataatacttatgtggctaaaaaagattatattttttattataattataaaaaattaatgttcaaaaaaaacaattttaaaaatagatttataaaagagtttcgtttcttaaaatccctacataaatcaggggaaaaatcaaaaaaacgaaaatcagcgattaagaaggcactgatggcaagaatggtacaccatgttttcactatttttaatagaaaaccagtatggttattcatagacagacaagacaaagctgatgataatgccgagcacctctttaaatatgcaatcaacaagaatgatggggtaaaaaaatactttataataaaaaaagatagcaaggattacgacagaatcaaaaaatatggaaaggtcataccatacagatcttttagacataaaattttaaccttatcctcttccaaagtaatatcgacacatgcagatatatgggttgtaaatccattttttaatatggagatttattttagagatttatttaactttgagtttatctttttacagcacggaataacaatggcagatcattctgaatggttaaacaaatacaacaagaatatcaaattattagtcacttctgccaaacctgaatatcggtctattgtgaaagggaattacaactataaaaaagagaatattttgttgggtggatttccgagatacgataatcttaagaagagtgagggagaaaagcaacttctaataatgccgacttggagaaaagatattgtattaccgaaagatcaggcaaaaggagtaagaccgtacaacccgaaatttaaagatagtgaatatttttctaggtataatgctttgattaatgatgaacggctaatcgaatttgctaagaaaaataattataaaataacttttttcctcacccagatattcagcaacagattgtagactttgaaaagcatgattatgtggagtttgccgactataacagcagctatcaaatgctatttaattcttctaatataatgattactgatttttcatctgttgcgtttgattttgcatatgagaaaaaacctgttatttattatcaatacgaaaagtcataccattttaaacttgattattatgattataaaaaatggggtttggtgatgtattagaaaatcataatagcttagtggataaagttatctattatatgaaaaacaatagtcgtatggaagataagtatagaaaaagagtagataacttttttgcatatactgataaaaataataggaatcgtatttataatgctattttggaattagataataataaagttgctaaatgaggttggtttgttttatattgacacttcaaatgttgggagaagttctgcgagacttctctttactttttaaaagtgaaaaaaactcaacatttgttacaatattcactggtacttttaaatttctttaaccgaaagatccaaaaaatcaattattttggtgtattatggcaggttttaaatccccttattctaatgatggcgtactggtttgtatttgggatgcgcaacagtaagctggtcataacaggtatcggagaagtgccttttatcgtttgaatgctggctggtttgattccgtggttttctattagcccgacaattcttgataaatccaacagcgtagttaaagggattaatatggtagccaaaatgaactttccgacagttcactgccttctgttgtaattgcttcaaatttatttaattattttgtaatgctggttgtttagtcattgttcttttagcaagtggtgtttacttagcttgcattgaatacaagatatttactatttaatctgcatgtttgtatttatgttttcatttagtttgtttaactctacaatcagtgtgtttgtctgggattattaatttttgcggcaggccgttgatcaggtcttcgcagttgataatgaagagcatacattgactttgatgttgaaataaaaaaaggctattggatgaatgtccaatagcctttttgtttagatttcttctttgtttagtaaaccttccataaatggaacgagctgatcgcgaagctctttatcctgcatcgcaaattcaagagttgttgtgataaagccgagcttttcaccaacatcataacgcttgccttcaaaatcgtaagcaaacactctttgaatttcattcagcttttgaatggcgtctgtgagctgaatttctccgccggcgccaacctgctgctcttctaaatacatgaagatctcaggcgtgaatacgtaacggcctaagatggcaagattagaaggtgctgtgcctttaggcggtttttcaacgaagtttttcacctgataacggcggccttcacttgtcagcgggtcaataatgccgtagcggtgtgtttcttcttcgggcacctgctgaacaccgataatagaagaaagtgttttttcatattcatccattaattggcgcaaccctggagtttcagcctgaacaatatcgtcaccaagcagtaccgcaaacggctcatcgccgataaagttgcgtgcgcaccagacagcatgtccgagacctttaggttctttttggcggatatagtgaatgtcagccaggttagaagcctttttcactttttcaagcagctcagtttttcctttttcttctaggtttctttcaagctcaggagagtaatcaaaatgatcctcaatcgcacgcttgctttttcctgttacgataataatatcttcaataccggcttcaacagcttcttcaattatgtattgaatggtaggtttatcaacgataggaagcatttctttcggcattgctttcgtagccggaagaaaacgtgttcctaagcctgctgctggaattatggctttacgtacttttttcatttaaaaggcaccttccttatgatcgaaaaaatttatggttaaactattctctatttacccttttcaatatgtttttacacatttttatgatatcggataaaccatttttaaacaagctttatccttaatattaaaacttatatcattttatttgaatcaagaatgaaatgatttaaaatgatgcattttcatgtagaatatgtagtatgaatttatttactatagcagaaaaccaggtgacaaatatgaaaaaactaaaagtgatgaccgttttcgggaccaggcctgaagcgatcaagatggcaccgcttgtgcttgaattgaaaaaatatcctgaaatagatgcctatgtaacggtaactgcacagcacagacagatgctcgatcaggtgttagatgcgtttcacatcaagcctgacttcgatttgaacattatgaaggagcggcagacactggcagagattacgtctaacgcacttgtaagattggatgagttgtttaaagatatcaaacccgatattgtgcttgtccatggtgatacgacgacgacgtttgccggaagcctagccgctttttaccatcaaattgctgtcggtcatgtggaggcggggctccgtacagggaataagtattccccgtttccggaagagctcaatcgacagatgacaggggcgattgctgatttgcattttgctccgacaggccaggcgaaagacaatttattaaaagaaaacaaaaaggccgactctatttttgtaacgggcaatacagcgattgacgcactcaacacaacggttagggatggttactcacatcctgttctcgatcaggtgggtgaggataaaatgattctcttgaccgctcaccgccgggaaaatttgggtgagccaatggaaaacatgtttaaggccatccgcagaattgtaggggaatttgaagatgtacaagtcgtttaccctgtgcacctgaatcctgttgtccgggaagcggctcataagcattttggtgattctgacagagtgcatctgattgaacctttagaggtgatcgatttccataactttgcagcgaaatcgcattttatattgaccgattcgggcggcgtgcaggaggaagccccatctctcgggaaaccggttcttgttctgcgtgatacgacggaacggcctgaaggagtggaagcgggaacgctgaaacttgcaggtacggatgaggaaaacatttatcagcttgcaaaacagctgttaactgatcctgatgagtacaagaaaatgtcccaggcttctaatccgtatggagatggagaggcttcccgccggattgtggaagaattgctgtttcattacgggtatcgaaaagaacaaccggattcatttacaggcaaataaaaaagaagctttgcacattgtgcgaagcttctttttgttttacttttcgaggctttccttcagctcttttgtaatatcggaaagggcgctttcatcagcttggtagtagtaaattccattgattttcgtgcctgtaccttttagttcgtgctgtttaatatgtttccgcgcacctttgtaatcggactggatatcccacatgttatcgaaggtcaagttcgttttcacattattttcaacaactttaaacatatctccgaatttcgtgatggaagaaatattagcgcctttattaataataccttggatgacttggcgctggcggtcctggcgtccgaagtcgcctctcggatcttcttttctcatccgggtataagcgagcgcttcttttccgttcagcgtgatttctcctttgccgaacgaataaccgtcataactgaacgcgaatgtgctgttaactgtaatgccgccaagtgtatcaacaacgtctctaaagctttccatgttcactttcacaaaataatcaaccggaacatcgaggaagttctcaacagtgtctaccgtcatctgtgtgccgccgaaagcgtatgaatggttgattttatccattgtgccttttccgataatttttgtatacgtgtcacgcggaatgctgaccatgtcggttgtattcgtttttgggttaacggtcatataaatgagcgtatcggcacggcccttatcgccgtcgcgttcatccacacccatgattaagacggaaaaaggatcttttttattgatactgacctctttatccctctttttagatttatcaatgctttcatgaatacttgccacggttgaagctgctttatgccataagtagtatgcatagccgccagttccgagtacaagaagtccgattatcgttaaaattgtcagtaataaagttttttctttttctgcgttcgtttctcatcctttgcacctcgtctgttaaattactttcattatgagttaaatttccaataaatacaactctatttaatacaagaatgaaatcctaaaatagtcgttttttataaaaaaagtttcattgtttcttaatttttctttaaaatataaaataggttgacgataaaatataatgaggtgaaaaaaatgaaaaaatttattgctttactgttctttatattgcttctttcgggttgcggggttaatagtcaaaagagtcaaggtgaagatgtatcgccagacagtaacattgaaacaaaagaaggtacttatgtagggttagctgatactcatacaatagaagtaacagtagataatgagccggttagtcttgatatcactgaagaatcgacaagtgatcttgataagtttaacagtggagataaggtcacgattacatatgaaaaaaatgatgagggtcagcttctgttaaaagatattgaacgtgccaactaagatatagggaggaacctgaaattttgaaatcttgcaaacaattgatagtgtgttcacttgctgcaatcttattattgattccatcagtttcttttgcagcagactcaaacatctcagttaaattgttaaattatattggaaataaatctagcatcagtctatcgccaacaggattttataaagtaactggagataatgttgctgttacggatcgttttgcaggcgcttcacgatacgaaactgcgactcttgcatccaacagccagtggaaaaatcctaatacagtgatattggtgaaccgagatatttttattgatgcattgcctgttattccattggcgaaaaaactgaacgcaccagttttatttactcagcctgacacgttaacaaaaactactgaaagacaaattgctaagtttaaccctgataatattttaatcattgggggagcgcgaagcatttcaaaagacgtagaaaacaagctgaaatcatatggcgctgtgaaaaggataagcggaaaaaatagatatgtcttatcagaaaatattgcaaagcaaatgggcagctatgataaagcgatcgttgtaaccggaagagtatttcaagacgctttagccattgctccatatgcagcagcacacggataccctattttgcttacagagaaagacaagcttccggattatgatttgccaaaacaagtcatcattataggcagttcatttagcgtcagtgatagtgtagaaaaccaaattaaaaaaacttcaactgtgcaaaggattcctggatcaaccagatatgaacttacggcaaatataattaagcaactaaagttgaaggctgataaagtcgtaatgacgaacgggacaaaatatgcagacgtattgataggcgcttcgcttgcctcgaagaaaaacagccaaattttatttgttaaacaagatagcgttccggctgcggctaaaagtataacgaaagataaagccacatatgcatacgactttattggaagtaccagttcaatttctgctgaagttgagaattcacttgctgatgaattttatttagctgacggtggcacctataatctaaaaatcaacagcggaaaattaaaccttgaaaacatcaaaacttacggaaactccctaagaattaaaccagaaaactattctacttcaaacagaattagtcttgatggaaagcagtatcttggcacggttaatttctctattgagtctactaaatatatccgaccggtaaatgagaatattccatttgaggattacttaaaaggagtaattccgaatgaaatgcctgctagctggtcacttgaggctcttaaagcacagactgtcgctgcaagaacctactcaataacaaaaacaggaactactgtacctgatacaaccgcttttcaagtttatggtggctacagttggaattcgaataccaataaagcggtagagcaaacgaaggggaaagttctgaaatataatggatctcttataactgcagcttattcttccagtaatggtggttacacagaagctagtaatgaagtgtggtcgtcaagtgtaccttacttgattgcaaaaaaagatacaaaggatcctcaaataggctggacgcttactttgtcaaaacaacagctagatacgaaatctttggacttaacgaagccttcttcttggtggtcttcagcgactgaaactgattctgcaagactttccggagttaagaactggatcttgaaaaataaagaaacaagcgctgattctgtcaaaattgcaagtattgacgatttaagctttagtggaacgacacaagggcagcgtgcaaaaacagcatcgatgaaagtgaagtattttgttaaaagcagtactggctcctataacttgagcaaaattacaaccattagtgtaccaacaagtgagttaagaacaatgattggagcgactgtatttaaaagtacttatgtgactgtaaaaaaagatacttcaaagtacacaatcagcggtaaaggatatggtcacgggatcggaatgagtcaatatggagcaaaagcaagagcagaagctggagattcatatagttcaattttgaaattttactatccaggtacaactctgacaagttattgattattttaggatataacgccatttaaggaggaaatcaattgcgttcttatataaaagtcctaacaatgtgttttctggggctcatactttttgtgccaacagctttggccgataactcagtgaaaagagttgggggaagcaatagatacggcactgctgtacaaatatcaaagcaaatgtattcaacagcaagtacagctgtaattgttggtgggagttcctatgcagatgctatttcagcagcacctcttgcttaccagaagaatgcgccattgctttacactaattctgataagctttcatatgaaacgaaaacaagattgaaagagatgcagactaaaaatgtaattattgtaggcggaacacctgctgtttcttctaacactgctaaccagattaaaagcttggggataagtattaaacgaattgcaggaagcaaccgttatgatacggctgcacgggtggcaaaagcgatgggtgcgacttcaaaagctgttattttgaacggcttcttatatgcagacgctccggccgtcatcccttatgcagcgaaaaacgggtatccaattctttttacaaataaaacatctataaatagtgcgactacgtctgtgataaaagataagggaatttcgagtaccgttgttgtaggaggcactggaagtatcagcaatacggtatacaacaagttaccttctcctacaagaattagcggttcaaacagatatgagcttgctgcaaatatcgtacaaaaacttaatttatcaacaagcaccgtatatgtaagcaatggattcagctaccctgactctattgcaggagctacactggcagctaagaagaagcaatctcttattcttacaaatggtgaaaatttatctacaggagcccgtaaaattattggaagtaaaaacatgtcaaactttatgattatcggaaacactcctgccgtaagcacaaaggttgctaatcagctaaagaatccagttgtaggtgaaacaatctttattgatccgggtcacggtgatcaagattcaggagcaatcggcaatggactccttgagaaagaagtcaaccttgatatagcgaaaagagtcaatacaaagctaaatgcttcaggtgctcttccagtactgtcaagatctaatgatactttttattctttacaggagagagtaaataaagcagcttctgcacaagcagatttatttctcagtatacatgcaaatgctaatgatagctcatcaccaaatggaagtgagacgtactacgatacaacatatcaagctgcaaatagcaagagactggctgaacaaattcaaccaaagttagcggctaatcttggaacgagagaccggggagtaaaaacagctgctttctatgttattaaatattctaaaatgccgagtgttttagttgaaactgcctttatcactaatgcatcagatgcaagtaaattgaagcaagcggtttataaagataaagctgcacaagctattcatgacggcacagtatcttattacagataatcgaaagagacaaatctaatcacagatttgtctcttttttatatgaaatgattaaaacaaataggacttgtatataaaatagtaaaagagtattaacaacatttatcagaaaaaacacgtaattcacacttcttaacataccatttacatccaattaacatccgtctgctaaactgactggcataggtcatcataacatcccaaacaaatcgtgaggtgtgtgtcagtgagtgcagagaaaagcatgaatgtgagtcgtgaattctcagttcaacaaatacattcttttacattatctgaaaagacggctcgttatttggcaataaagcgcgtaatggatatttggtttgcgctcattggattggcgattgcgctgccaatgattgcggtattttcaattttgatttgtttggagacgccggggcctgccatttatacgcaggaacgcgtagggaaaggcgggaagccatttaagctttataagcttcgttccatgaaaatagatgccgagaagtctggggcggtttgggcacagaagcaagatccgcgggtgacaaggatcggagcttttatcagaagaacgagaattgacgagcttcctcagctgtttaatgtgctgaaaggcgatatgagtatgattggccctcgtccggaacggcccgtatttacggaaaaattccagaatgagattccaggctttacacagcgtctggctgttaaaccgggattgagcggctgggctcaggtgaacggcggttacgatatgacgccgaaggaaaagctgatatttgatttatattacattcgcaatctgactttcactttagaattaaaaattatgttaaaaacttgtaaagtagtttggacgggtgatggtgcaagataaaacgggattccattattcaccatcaatctgagcttaaaaagaagtagggaatatgatgccaagtattacaaaacaaatcatgagcggtgcaaagtggacaagtatttcaaccatgtgtattacaatcatacaaattgttcagtttgccctgcttggaaatatgatgaccttaacagaatttgggcttgtcggcatgatcacaacggttacagttttcgcccagattgtgctcgatatgggttttggcgcagcattaattcagagagacgacgcgacggagcgccagctgtcaacattgtattggcttaacattatgacgggcgttttgctgtttgttcttttatatgtgagcagtcctgtcattgcgggattttatcaaagagaagagctggtgtttctggttcggattctggcgattatgtttttgatcgcgccaattggacagcaatatcagtatatgctgcaaaagcagctgcattttaatacgttaagcaaaatagagattttttcaaatgtattgtcattcggatatttagcgatagcggtttttatgatggatgcgattttggcgtacgtgatttctcaagtcctgctgcagtccagtaaagggattttatattgggctgtataccgaaaaaagtggcatcctgcttttgtttttgatttgagaggcatgaaggatttcttttcttttggagcctttcagctttcatcccgtcttgtgaacaggctgggagcaaatatcgacatgattttgatcggccggtttattggtgctgaagcattggggatttataacctcgcttatcagattgtcaccattccggttttgaagatcaatccgattgtcacacgggtggcattccctattttcgcaaaaaacaaatatgaaaacagcgtgatcagagaaggctttctgaatatgacaaaaatgctggcgcttgtttcgtttccgctgttaatcgggctcgtgtctgtgtcagacgcctttatcacagcggttttcggagaaaaatggcttgctgctgttccgatcctaaatgttcttgcgattgtcggaatactaagagtgctcatgaatccaaatggatctgtgttgctggctaaaggaagagctgacttagcgttttattgggattccggcgtgctgctgctgtacggattatcactgtttgcagctgtacagacgggaagcctgctgacagtcgcatgggtgtatgccattatcagcgttgttaatttcctgattgggcgctggcttttggcatatgtcatcaagcttaacctttcagcttatttccagtcgattatgaagccatttctgattactgcggcgatgggcatcatcgcgtttggtgtaagcctcagtaccgaacacttcagtatgcaggcagaaatgcggctggccatttcagttgcggctggggcgctgtgctatctctttcttttggtaaaagcgtaccctcaaacgaaaagcaaactactaagaaaaggacgtttgtcatgaagattttgtggatcacaagcgtatatccgagcagtatgaaacccggagagggtgtgtttcatgagacacaggtgcaagagctgcaaaaaactcgggcttgatatcactgtgatatgcccacggccttttcattcagcacctgtccgcatgctgaaaaagacatatcgaaaaaaggatgtcagaccggagtatgagattagaaaggggataccggtttaccggcctttctatcgggcagttcccggccagctgaagtgggcgcagcctcatcggagaatcgcatcagccgttttaaaaacaatgaaacagcgcgacctatatccggatctgatccatgcgcattttgccatgccatcgggcggggctgcggcagtcgtgtcagagtcagcgcaaattccttatgtcctgaccttgcatggcagtgatgtgaatgtctatccgcattacagcaaaggtgcgtttaaagccttcaagcgtgccgtaggttctgcgtcagttgttttagcagtcagccacaagcttcaggaagaagccaaaaagctttcgggctttgacagctcggttttgccaatcggcatacagctcagccgttttcaggggaatgaggagacgaaagaggaaatcagaaaaagactcggactcccgctcgatcagcgtctggctgtctatgtcggccggctggtcagagagaaaggcatttttgaactgtctgaagcgatcgaatcgctgcaggactctcctaaggcagtctttgtcggggatggtcccgcaaaatcgacgctgacgcagaaggggcatatcgtcacaggccaagtcccgaatcatcaggtaagagactatttacttgcggcagatctattcgtacttccttcttacagtgaggggatgccgactgttgtgattgaggcgctggcgctaagggttcctgttatttgtacggatgttggcggagtgtcgtctttattcggaaagcaccaacatctgctgattaaaccgaaatccgctcaagccttggcggaagcgatcactcggtacgaacatgagcaaatatggaagccggaagtagcagatgacttgtatgaaaccgtgcaggctcaatttgacgcaggaaaaaacgccaaggccttgcatcatcagtatcagacggtcacgaaaacgtccgtttaatcgtaagacactgcgaccattataaattggaagatcattttacaggagagggttgagcgctgtgaaaaaaatagctgtcattggaacaggttatgtaggactcgtatcaggcacttgctttgcggagatcggcaataaagttgtttgctgtgatatcgatgaatcaaaaatcagaagcctgaaaaatggggtaatcccaatctatgaaccagggcttgcagacttagttgaaaaaaatgtgctggatcagcgcctgacctttacgaacgatatcccgtctgccattcgggcctcagatattatttatattgcagtcggaacgcctatgtccaaaacaggtgaagctgatttaacgtacgtcaaagcggcggcgaaaacaatcggtgagcatcttaacggctacaaagtgatcgtaaataaaagcacagtcccggttggaacagggaaactggtgcaatctatcgttcaaaaagcctcaaaggggagatactcatttgatgttgtatctaaccctgaattccttcgggaagggtcagcgattcatgacacgatgaatatggagcgtgccgtgattggttcaacaagtcataaagccgctgccatcattgaggaacttcatcagccattccatgctcctgtcattaaaacaaacctagaaagtgcagaaatgattaaatacgccgcgaatgcatttctggcgacaaagatttcctttatcaacgatatcgcaaacatttgtgagcgagtcggcgcagacgtttcaaaagttgctgatggtgttggtcttgacagccgtatcggcagaaagttccttaaagctggtattggattcggcggttcatgttttccaaaggatacaaccgcgctgcttcaaatcgcaaaatcggcaggctatccattcaagctcatcgaagctgtcattgaaacgaacgaaaagcagcgtgttcatattgtagataaacttttgactgttatgggaagcgtcaaagggagaaccatttcagtcctgggattagccttcaaaccgaatacgaacgatgtgagatccgctccagcgcttgatattatcccaatgctgcagcagctgggcgcccatgtaaaagcatacgatccgattgctattcctgaagcttcagcgatccttggcgaacaggtcgagtattacacagatgtgtatgctgcgatggaagacactgatgcatgcctgattttaacggattggccggaagtgaaagaaatggagcttgtaaaagtgaaaaccctcttaaaacagccagtcatcattgacggcagaaatttattttcacttgaagagatgcaggcagccggatacatttatcactctatcggccgtcccgctgttcggggaacggaaccctctgacaagtattttccgggcttgccgcttgaagaattggctaaagacttgggaagcgtcaatttataaaaagaaaaagtgttacttggttgaagctgccggctgctaggctcggccgccggctcctgaaacatcaggaaaggggttaaacatgtgagtatcaaacgatcagcggtccatacgctagcgttactggccgctgctatatttggagtcgtcctattgctgggagccatccataaagatataggtttcatgcagatggctgctgtgcttgcggtgttggcaattggcctgtttttactgacgcttgcaaccgcatttacaacaaaagaacggctctttatggctgtaatctatattttgatcgcctgcacttttttaaataatgcattttttgccattcatcttggatttttcagtttgttcctttaccggcttctgctcattgcagcgggttgccttcatattttcggcatggttcggaatcgaacccatattgaaagatggcatgggctgcaagtaaaagggattttactctttttcgccttttggtttatatatggccttgtttctctgctgtgggccaagtcggtaacagttggcctcaagtatttagccttattggcaatggggatcttcttcatttatcttattgtcatgtacgtgcaaaaaatggagcggctgatgattgtttatgccatttggctggtgatgacggtatttctgatgatcattggtttttacaatcatatcacccaccatcatcttgcgagttccacattgtacagcggaccggagtacaagcagcattatccgacatcggtcttttttaatcaaaatgactttgcgacctttttatccatcagcttctttttttacatcacgatgatgaaaaacattaagaatggatacatcaaggcaattggccttgtgctctcgctctgtgcgttgtatttaatttttgccactggttcaagagccagccttctgggcatttttgcaggtattgctgtctacatcttcattgtattgccgcctgttttaaagagaatggctatatggctgtcggcggcgggaattgctcttttcgcagttcttttcgccagcaaaatctattcaaagttttgggagctgtttctggccccgcagacgctgcattcatttcatgacaggcttccatcaaatgtggctcgggcaaatctgctgaaaaacgcttggcattttttccttgattcatacggattcggagtcggggcaggaaatgtatcctattatcttgagcattatgctgtatatgatactgacaatgtggcagaggtgcataactggcttgttgaaattcttgctaattttggtttgttcatcatgctgggatatttgtccgtttatgcctacctcatatgggtgctttacaagttttatgaaagaaaattagaaaatcagtcaaaactgatcacagaaggacttattaccgctatggtcagtttcctggtatcaagtatcagcccaagctctgtttcaaatttatttttccattgggtgtttatggcgctcgtcatcgccgccgtgaatgtgttaaggcgatccagacaaatgcctgagccgatgtacagataaacagactacaaaaagcagggagacttatatgaacgatatattgataagaatagcccgtcgcataaaaaaaaatatcatttggatcatagcggtgccaattatattaggtgcggcggggtatatcctgccgtcacagatcgctgatcaaaagagctatacagctgaagatactttggctgtggggagctatgatcatccggtttataacagcacagaagagattccgcttctattaaagagcgactcctttttgaaggaggcgcttcctgatgaaaaggatgaagatgtagcagagatcaaagagaagcttacaatcaatacggaatccaaatcgttactgactttaagctatagtgacgaggataaggatagaacggaatctgtcttaaacgccatatcctccaccttcctcaaaaacgatcaaaagctgtatgcagaaagagaagccgtcatccgcagcagcatagacgcgcttgaaggcgagtcggtgagcgaggattccaaagtggataaagagagatttttatatgaactcaaaaacacacagcttaacctgaaagcggcaagtgttactgattccgaaaccgtaagtgagacagcaggcggcggtatgtctccgaaaaagaaagcagttctcggcgttatgattggccttacgattgcctttatgttcgttgtcattcctgaatttttcagagaatccttttaaaatcatacgatggagatgtgatcatgaccaattggaaacctctcgtatctgtcattacaccttcctataatgcgcgtgactatattgaagacacggttcattcggtattagatcagagccatcctcattgggaaatgattatcgtggatgattgctcaacggatgggacccgcgacattttacagcagtatgaaaaaatagacgaaagaattcatgtggtgtatctggaagagaactccggagctgcggttgctcgcaacaaagcgttggaacgcgctcaagggcgctacgtagcatttttggacagtgatgacaaatggaaaaaagacaaactggaaaagcagcttgagtttatgatggagcgctcctgtgcgttctctttcacgggctacagcttaatggcgcaggacgggaccccgctcgataaatttattcatgcgccggaaagcctgacgtacgatgacgccctgaaaaatacaattatcggctgcttgacggtgatgattgacagggagcaaacgggacagatccaaatgccgaatatcagaacgagacaggacttagccacatggctgtctcttttaaaaaaaggatttactgcctatggaatgaatgaatgcctggctgaatatcggcttgtcaataattcaatttccagcaacaaatggaaggctgcgaaaaaaacgtggtttgtctacagggagatcgaacggcttcattttatgaaagcaacatggtgttttgttcaatatgcaaaaaacgcggtgaaaaaaagattatagctgcaaacagagagaaaaggtgatgaaggtggaaacaaaagaagcaatcattcatgtcatcgttgccactgctgaatggggaaaagaccaattgagatacagaaggcaccggctggcagaatttttagctgctcaggaggaaacgaaggaagttatttgggtatgtccggctccgcgtgcccaagggaaagagtttcaggaagtccattctggcatcaggcaattcgctgtcaaagacctgctgcagaaaaaaatgtttcgtttcggacgatatacagatgtcttttacagacataagctctccccattactcgatgagcttacacctgcttctgcaaacggtgaacgctgctgtttatggtacacgtttcccggattcccgctgctgtcttcgctgtattcttgggatcaggtcatttatgactgcagtgacctatgggctgcgccgatcagcggccgatcaaatctgctgtctgaattccggcgaaaagtcattaaatcggcagagctgagaattatacaacgagcagattcaataacctgttcatcagattatcttcacaaggaagtagacaaaaaactgactgcaggacgagaaaaggttcatactgtggaaaacggtgtggagtatgagctgttttctgcaaataaacaagctcccgatcgcagtatactgcaggggagagaaggaatagtgttaggttttattggcgggattaaaccgaagctcgattttaaaatgattaaagaagcggcactgcaaaagcctgattggacatttttatgggttggcccggatgccaccaatggtgatgtttcgtttcaagagctgctgaggcttcccaatgtcatatggaccggtccggcagatccaaaagaagtgcctcattatatggagcttatcgacattggcattatgccatataaacaatcaccgtataatcaagctgtgtttccgctgaaactatttgaatttttagcggcaggaaaacctgttgtaggcactaatcttccgtcaacctcaaaaatgcaaaagccgtatgtatacgaatatgtagagggcgatcatccgattgattttatagccgcttgtgaaaaagttctcggtcaaaacggagacgagacctataaagaaatgcgccgaaacatcgcccggacacaagattggaattgcttatttagacaaattatgaaatatacagggattcaaaaacatgcgtagtcctataaattgggatgcgcgttttttgattatacgtgtttctttttgatgaagcttgttataataactaaggagaaggtataatggaaggaacggttctctatataaataaagacttcatttaattccaaaggagacttctttatgcttgacgaacgcatgattcgcattgttgttgcgtttattgtctcgctgctgacagttttaatcataaccccaatcgtaaaaaggattgcgattaaaataggtgcagttgaccagcccagcaatcgaaaagtacatgacaaaatcatgccccgcatgggcgggctggccatatttatcggggtggttgcaggcgtgcttgcatccggtatttacacagaaacaaggatgacggcaattacagtcggagcattcatcattattgtgttaggtattcttgacgataaatatcaattaagtgcaaaagttaagtttttgattcaattaggtgtagccattatgattgtaagcactggcttaaaaatggactttttctcagtaccttttttaacagaacgatttgagttaggatggatggcttatccgctgacggtattatggattgtcggcatcacgaacgcaattaacctgattgatggattggatggccttgctgccggtctttctgttatcggcctgtcaacgattgctgtcatggcgctatccggcggaaaagtgctcattctgtcactctcattagtcgttattgccagcacgctggggtttttgttttacaacttccatccggcaaaaatctttatgggagatacgggatcactgtttttagggtatagtatctcgattctttcattattaggcctgtataaaagtgtcacattgttcagtatcgttatcccgattattatattaggcgtaccgatttttgatacaacatttgctatcatcagaagaatattaaacaaacagccgatttcagcgcctgataagtcgcatattcaccatagactgatggcctttggcctttcacatcggatgtcggtcttagttatttatttaattggatttattttcagtatcagtgcgattgtacttaaaagtgccacaatttggctttctttgtttattatcttcattttgattatttttatgcaaatcatagcagaagtgacaggactcgtgaatgaaaaatttaagccgtttacaaagttttataaacggctggtgaaaaggaattaaaaactccggcttatgtgccggagtttttttctgcgcaaaaatgcccgatcctctaaaaggaccgggcattttttaataggatgaatcagttgttgaattcgttgtactgttgtttgagcttgtgctgctgtcattcgaatagctgcttccgttcgtcgtcccgtcagttgttgtgccagtgctgccagtgctgccagaactgcttgagctgtcagtcccgtcttcggtaccggaagtgccagtgcttgtatcaggagtataatctaaatgctcttgaagcgtttttctgactttctcgagatttgtagcatcaggttcaaagtaatatgtgttgttaggccctaaatacaaatcagaacctgtaatgctcaatgtgtcgatttttttgctggtaaagccgctgtaaatctgctgaagcgctaaaccttcagtaatgcgaatattggtttcaacgttttcgctggctttttctgcgattttatcaattttagcaatgttgcttgcacttgacatgcggtcaatcagcgcgtttaagatttgtttttgtctgtcattacggccaaagtctccgcgtttatcctgttttctcatccgggcatatgctaaggcttcttcgccgttcaaatgcatctcgccttttttgaagtaaatccgtttgctttcgtctacatcacttttttcatcgaaatcgaaaggcacgtcaacatcaataccgccgacttcattaatcacatctttaaatccgtcaaaatcaactgtgacatatttatcgatcgggatttgcaagaagttttcaacagtttcaactgtttcatctttaccgcctttgctgtaagcggcattgatcttcgtcttgcttcccgttgtgtcaccagctaattgcacacgtgtgtcacgcggaatgctcagcattttcatggttttatttttgggatccagggtaacaacaataagagagtctgatctccctttttgtcctttagtcgcgtaatcctctattcccataaataaaatagaaaatggttttttcttcatgtctacaacttcgttgcgaagatttgatttattcccgcgggatagggcatcgtacgattcatccgcagcgttaatggttttataaagtttatacccgccaagccctacaactaccaatagtgcaagggcgaacaataacattattctttttaaaattttcctacgtttgctctttttcttttttcgcacacgcactctaacgcgttcagccattattcagtctcctttatgtgattgacggctttttcaagatacgtcaactctccctctttaatatcactctttccatttgtcagttctgtcatccattcagaaaaagcgttggtttctttttcttccacgtatgtttcgaattcaacattttctgaataatggatttcctttaacagaaattgtgactcccttaattcattttcaatcttgccaagccatgtgtaatctgcagaagtatgcatgattcgcataagcttccgttctacaacacctatatgatttaatccttcagacactgatttcccataagcgcgaattaatccgccagcaccaagcttaatgcctccgaagtagcgtgtaacgacggcgcaagtatccttcagcctgcgtttttttaaaacctcgagcatcggcactcccgctgtaccgcttggttccccgtcatcattggctttttggatatgatcattctcgccaataacataagccgagcaattatgagtcgcattccagtgctgtttctttattttctgtataaattcctgtgcctcttgttcggtagaaacacggcttaaatgacagataaaacgcgatttttctataacaatctcgtgttctcccgcttctttcacagtaaaatagctgtgcagcatgctagctgaccctcctgctaagcataaaagactgcctatacaaattcgtacagtctttagaatttttgtgcgtattttggtatcataaagagtagatagtatataaaaatgtttttttctagaatatacgcattctttcattataattcgacataatttgcagatcaattacatttataataaaaatatatgacaacgccgtgacggagggaaattatgaataaaacaaagatggattccaaagtgctggattctattttgatgaagatgctgaaaaccgttgacgggagcaaggacgaggtttttcaaatcggggagcagtcacgccagcagtatgaacagctggtcgaagaactgaaacaaattaaacagcaggtgtatgaagtgattgagcttggcgataaacttgaagtgcaaactcgccatgcgagaaaccgtttatccgaggtcagccgtaattttcatagattcagtgaagaggaaatccgcaatgcttatgaaaaagcccataagctgcaggtagaattgacgatgatccagcagcgtgagaagcaattgcgcgaacggcgggacgatttggagcgcagattgctagggcttcaggaaatcattgagcggtcagaatcattagtaagccaaattacagttgtgctcaactacttgaatcaggatttgcgcgaagttggactgcttcttgctgatgctcaggcaaaacaggatttcggcttaagaattattgaggcgcaggaagaagagcgaaaaagagtctcaagagaaatccatgacggacccgctcaaatgctggcgaatgttatgatgagatcggaattaatcgagcggattttccgtgaccggggcgcagaggacggattccaagaaattaaaaatctccgccaaaatgttcggaatgccctttacgaagtgagaaggattatatatgatttaagaccgatggcccttgatgacctaggcctgattccaactttaagaaaatatctatatacaaccgaggaatataacgggaaggtcaaaatacattttcagtgcattggagaaacagaggatcagaggctagcgcctcagtttgaggttgcgctcttcaggctcgcacaggaagctgtgtctaatgcgctaaagcattctgaatctgaagaaattacagtcaaagttgagatcacaaaggattttgtgattttaatgataaaagataacggtaaagggttcgacctgaaggaagcgaaagagaagaaaaacaaatcattcggcttgctgggcatgaaagaaagagtagatttattggaaggaacgatgacaatagattcgaaaataggtcttgggacatttattatgattaaggttccgttatctctttgactatgatttgtaaaatagagccaaaaggcatattgaccgaatgctagagtatatagaacaataatacaaggaggcgtggcttgtgactaaagtaaacattgttattatcgacgaccatcagttatttcgtgaaggtgttaaacggatattggattttgaacctacctttgaagtggtagccgaaggtgatgacggggacgaagcggctcgtattgttgagcactatcatcctgatgttgtgatcatggatatcaatatgccaaacgtaaatggtgtggaagctacaaaacagcttgtagagctgtatcctgaatctaaagtaattattctatcaattcacgatgacgaaaattatgtaacacatgccctgaaaacaggtgcaagaggttatctgctgaaagagatggatgctgatacattaattgaagcggttaaagtagtggctgagggcggatcttacctccatccgaaggttactcacaacctcgttaacgaattccgccgccttgcaacaagcggagtttctgcacaccctcaacatgaggtttaccctgaaatccgcagaccattacatattttaactaggcgggaatgtgaagtgctgcagatgcttgcagacggaaaaagcaaccgcggtattggtgaatcattgtttatcagtgagaaaaccgttaaaaaccatgtcagcaatattttacaaaaaatgaatgtaaacgaccggacgcaagccgttgtggtcgccattaaaaatggctgggtagaaatgagatagtataataggagacttgccttttactaggcaggtctttttttaggctgccgtttcccttacaatagagttataaagcaataaggcaggtatcgaagctatgaatattgcagtcgtaacagacagcacggcatatattccgaaagaaatgcgtgaacaacatcagatacatatgatccctctccaggttgtttttagggaggagacttaccgtgaagaaattgagttggactggaaaagcttttatgaagaagtgaaaaaacataatgagctcccgacgacttctcagccgccaatcggcgagctggttgcgttgtatgaagagcttggcaagtcttatgatgcggttatcagtatccatctttccagcgggatcagcggaacattcagcagtgcagcagcggctgattcgatggtcgacaatattgatgtgtatccatttgactcagagatcagctgcttggctcaaggcttttatgcccttaaagctgctgaattaatcaaaaacggagcatcatcgccggaagatattataaaagaactggaagaaatgaaaaaaacagttcgagcttattttatggtagatgacttagcccatcttcagcgcggcgggcgattaagcagcgcccaagccttcattggtagtcttctaaaggtaaagcctatccttcattttgacaataaggtaattgtgccttttgagaagattcgcacacgtaaaaaagcaatttcgcgaatttatgagcttttagacgaagatgcgagtaaagggttgcctatgcgagctgctgttatccacgctaatcgagaggaagaagcagcgaaaatcattgaagagctttctgcaaaatatcctcatgttgaattttataacagctattttggcgcggtaatcggcactcatttgggtgaaggtgcgttaggaatttgctggtgttttaaataaggccaaatctccgtttttagagcggagatttttttatattcttattttaatagttggacagaaaatattcattcaggcatactgtttcgaaaggaggcgtgctatgtgaatgtgccagttgaaaaaaacagttccttttcaaaagaattgcagcagacgcttcgaagccgtcatttgctcaggactgagctctcattttccgatgagatgattgaatggcatatcaagaatggatatatcactgctgaaaattctatatccataaataaacggagatatagatgtaataggtgcggacaaactgatcagcggtatttttctttttatcactcatctggaaagaataagctgtattgccgttcctgtgtcatgatgggcagagtgagtgaggaggttcctttatattcatggaaagaggaaaatgaatcaaactggaagtctattaagctgacatgggatggcaagctttcaagcggacagcaaaaagccgccaatgttttaattgaagcaatatcaaaaaaagaagagctcctcatctgggcggtttgcggcgctggcaaaacagaaatgctgtttcctggtatagaatcagcgttaaatcaaggactgcgtgtatgtattgcaacacctcgcaccgatgttgtattagagcttgctccaagactcaaggctgcctttcagggtgctgacatttcagcgctttacggaggaagcgatgacaaagggcggctatctccgcttatgatttccactacgcatcagcttttgcgatataaagatgcaatcgatgttatgatcattgatgaagttgacgcttttccatattctgctgatcaaacccttcaattcgctgttcaaaaagcaagaaagaaaaacagcaccctcgtttatttaagtgcaacacctcctaaagaattaaaaagaaaagcactgaacggacagttacattcagttcgcatccccgcaagacaccaccggaaacctttacccgaaccgcgctttgtatggtgtggaaactggaagaagaaattaaaccgaaataaaattccgccagcggtgaaaagatggatagagtttcatgtaaaagaagggaggcctgtttttttattcgttccttccgtttctattctggaaaaggctgctgcgtgctttaaaggtgttcattgccgaaccgcatctgtgcacgcggaagacaagcatagaaaggagaaagtgcagcaattcagagatggtcagctcgatctattaatcacaacaacaatactggaaagaggcgtcacagtccccaaggtgcaaacgggtgtactaggagcggaatcgtctatctttacggaaagcgcacttgttcaaattgcaggaagaaccggccggcataaagaatatgcggacggcgatgtcatttactttcacttcggcaaaacaaagagtatgctcgatgcaagaaagcatataaaagaaatgaatgaattggcagcaaaagttgaatgtacagactagccattatttgaaaacgtggtacagtatactcatataaccgatgatgaggagctgtaaaaatgcttgtcaattcaaaagaaatcgtaatgaaagaactgctcgaccgatatatggaccagcttcatatggcctgtacttgccaagtatgccaaaacgatgtattggcactttctttaaacaaagtgagtccatcctacgttactgattttaaaaagatcgcatatacgaaagctgagctggtagataaacaaaaaaacacagcaatgcttgtcattttggctgaatctgctgcagtagtttcagagagtccaagcgatttatgtcaaacgaagcaggaggaggcattcataaactgatctgtttattatgtgattcgcaattttctcaagatgttacatggagagccctttttttactaaagcctgatgaaaaggtttgttattcttgcagaagcaaattaaagaaaatcacaggacatatctgccccctgtgcggcagacctcaatctgttcatgccgtatgcagggattgcgaggtgtggagaacaaggatcagagacagtttgctattgcgtcaaaaccgttcagtttacacatataatgatatgatgaaagaaacgctctcccgttttaaatttagaggagatgcagaaatcataaatgcatttaaaagtgatttttcttcaaccttttctaaggtttaccccgataagcattttgttcttgtacctattccgctgagcaaggaacgggaagaagagcgcggatttaaccaggcacatctcttggcagaatgtttagaccggccttcccaccatcccctcattcgcctgaataatgagaaacagtcaaagaaaaagaaaacagaacgcctgctgtcagagtgcatttttgatacaaaaaataattcagcagaaggtatgaatatcattttaatagacgatctttatacaacaggcgccaccttgcacttcgcagcccgctgcttattagaaaaaggaaaagccgcttcagtgtcatcttttaccttgatcagaagctaaatgattctgtttttatgccgatataatcactagaaattgacacaggcatattatctaataaggagaaaaaaagatgggagaactggctaattgtccgaaatgcaatgctttatttttaaaaacaaagctgcaaaccgtatgtcaggcgtgtattaaggaagaagaaaaatcatttgagactgtctataaatttttaagaaaacaggaaaaccggcaatcaactttgagccggataactgaggaaacaggtgtggaagaagagctgatattgaaattcatcaggcagaagcgaattcagatcactcatcttcctaatttggcatacccttgtgaaaggtgcgggacatcgattagagaaggcaagttctgcaaggcttgccagtctgatattaaggatcaaatggatcatttgaaccacgaggatgctctgaaaatcgagaaagaaaatagtaaaaaagacacatactatgcctataataccaaaaacagctgattccctaaactaactgaaaacgcagtcgataaaagggttaagattgtttaaagactgcaacggaaagcgagaggaatcctatgaaaatcaatcaatttggaacacaatccgttaatccatatcaaaaaaattatgataagcaagcggtgcaaaaaactgttgcacagcctcaagataaaattgaaatttcatcacaggctaaagaaatgcaacatgcatccgacgcagtcactggttcacgacaggaaaaaattgcgcagcttaaagcgcaaattgaaaacgggtcatacaaagtagacgcaaatcatattgcgaaaaatatgattaatttttataaaaagcaataaaaaaggagaaagcccatgtcagcgaaggcaattattgaacaattgaagcgactttgcgttctgcatgagcacctgctcacgctgtctgaagaaaagacggaagcgctcaaagccggcaaaacaaaagagctttctaacattttgacaaaagagcaaaaatatattcaagcaatcacgcagacagaagatgaccggatcaaaacaacttcggcctttctcggatatagcgaaaataatactatttccgcatgtatcgccaaaacctcaggcagtgaaaaggaagagctggaacaactatacgaatctctttctcaagttctcggacgtctgaaaaaagtaaatgagatgaataggcagctgacaagagacgcgctgcaattcatctctatttcgtacgatatgctggttcctaaggaaaataacttcaattacagcaaatcaattaaagctgagctgccgaaaagtagcaaaatgaaactgtttgattcaaaagcttagcagaaaggaattcagaaaatgacatctacctttatggggcttgaaactgcaaggcgggcgttaagcgctcagcaggcagcgttaagcactactgcaaataacgtggcaaatgccaatactgatggttatacaagacagcgggtctcattggaggcaactgactatttccctgctgtatctaaaaatgcagaaaaaacagcgggacaaatgggtacgggcgttcaaggaaaatcagttgagagaataagagatatctttcttgactaccaataccgtcttcaaaacaacagtgccggatactatgacacgaaggcaaaagcgctgtcccaaatggaaggcgttttaaatgaaacggatgacagcggcttgaacagtgtgctcaattcgttttggaattccctgcaggaattatcgaataatacaaatgaagaaagtgcacgttctgttgttgctcgaaaaggacaagctgtagctgaaacgtttaattatatttctgaatcacttacaaatgtccaatcgaatttaaaagcagagctaaatacaactgtgttggatgtcaattctctgctttctcagttaaacagtttaaataagcaaattgcacaagtagagccggtcgggcttcttccgaatggcttatatgaccagcgagatttgctgatcgataaattatcctcaatggttgatatcaaagtcagctacaacaaatcaggcgggaatgcacttgcatctgctgaaggaactgtatcaattgaaatccttgataaaaataaacagtcgctaggaactgttttggacggtaaaaattacgaggtttcagaacttgcagccaactatgataatgaaactgggttagtatcaagtatttcaatcggggatacagctgtacaggcggagtcctttagcagcaagggatcccttttagggtttatagagtcttatgggtatataacagcagatggccaagaaaagggcgtatacccggaaatgctttctgatcttgacaatatggcgcttgaattcgcgaaagctttcaatgaagtgcacagaaatggtgtgaccaagagcggtgaacaaggcggagacttttttgattttactggcggtgaaactgaacctgccaagggcgcggcgggcaagatcaaagtggctgacagcataatagattcaaaaggcgcaaacattgctttctcactgactggcgcagccaacgataacgcaaatgctacaaaattagcaaatgttttaaccggtaaaataaccattaacggtaaagaaactagtgttttagattattatgcgggtctgattggcgagctagggatcgaagctcaagaggctaatcgactggcgtctaatacagaaacacagctgaatgatgctgacataaaccgtcagcaaatgagcgcagtttctttagacgaagaaatgacgaatatgattcaattccaacacgcatacaatgcagctgcaagaatggtgactttacaagacgaattgcttgataaagtgatcaacggcatgggtgttggaggaaggtaggtagagtcacatgagagtaacacaaggcatgatacagcaaaactcactgagatatatcggttcaagctactcgaagctggataaactccagtcgcagatttcttcaggaaaaaaatctcaaaagcttccgacgatcctgtagtagcaatgaaaagcttaaagtataatacgcaactgtctcaagtgcagcagtacaaaagcaatgcttctcaagcctttacctggctcgaaaacacagaaacaaacattacagaaggaattgacatcttgtcaaaggtcagagaattagcggttgaagctcaaaatgatacaaacggcgagccggagcggcaagcgattggcgtagaggtaaagcagttaaaggaacagcttttaaatattgcgaatacacaagtgaacggcagatatatctttaatggcacaaattcagataagcctccggttacagataacggagacggaacttatacaatttctgatacagctgatgtcgtagtcaatatatcaaataatatgtcattgaaagtgaattcagatccaaagtcagcttttggaggcacttctgaaagcgggcagaatgtatttgaaatgcttgattcttttgagaaagcactaaattctggttcgctagatggcatggacagtgttttaaatgatattgatcatttttctgacggcatgagcgctgaacgatctgatcttggagcgagatataatcgtcttgaactggttaatacaagactgtcagcgcaagaagaaacagctaccaaagtgttatcagacaatgaagatgtagaactggaagaagtaataactgaatttattgcgcagcaaagtgtgcacagggctactctggccgttaatgcgcaaattgttcagcctacattgattgactttttaaagtaagcggctcttaggagttcgcgtttttttatagttcaggaggtagagtgatgcagattcccagattgattatgcatagtgttcaaggaaaaattggtttaacaacgacgcctgccagcttaaaaatggagcagcctcaagctgatctagagatcgaacagccgagtgcggaaatggaaatatcggtgacacctggaaaactcacgattgaccagacacaagcatgggaagaattagacagaaagcatgttttcaagagaattgaagaagccgcccaacaagggcatgaggatgtaatggagggaatagcacgcactgcagaagaaggcgacgagcttatgaagattgaaaataaggggaacccaatcgcttcacaagcaaggaggaactctgaaatgcaccaaattcaattaggcgaaaattatgctccttctctttcgagggtgaaaatacaatatactccgtcacagcttgatgtgcagattacgccgcgaaagcctgttattcaggctgagccgcataagccaattgttgaatatacgccaggaaatgttaaggttgacatgcttcaataccctgatttaaatatagatgtagaatacccgaaagaatcacccgaaaagtaaaaagaaaaggatcgtgaacaatgatcattcatacgaagtaccatggccaaatgaacataaaagaagaacaaatcattctttttgaaagcgggattccaggctttttagaagaaaaacagttcgtcatacttccgctttcagaagactctccattcgtggcactgcagtccgtcacttcagaaaatcttgcgtttatcgtcgtaagtccgtttatcttttttaagaattatgaatttgatcttgatgaatcaactgctgaacttttggatatcgataatattcaagacgtagaagtcatgacaatattgactatggcagagccatttgaaaagtctactgcgaatttattggctcccattattgtgaatcgcaagaacatgatggctaagcaagtcgttttacacgactcctcatatacgacaaagcatccgattggaggagaatcatgctagttttatcgcggaaaataaacgaagcgattcaaataggtgctgatattgaagtaaaagtgattgcggttgaaggggatcaagtgaagcttggaattgacgccccaaagcatattgatattcacaggaaagaaatttacttgaccattcaggaagaaaataaccgtgcagcagcgttatccagcgatgtgatctccgcattatcctcacaaaaaaagtgaggatttttttatttttgtattaacaaaatcagagacaatccgatattaatgatgtagccgggaggaggcgcaaaagactcagccagttacaaaataagggcacaaggacgtgccttaacaacatattcagggaggaacaaaacaatgagaattaaccacaatattgcagcgcttaacacactgaaccgtttgtcttcaaacaacagtgcgagccaaaagaacatggagaaactttcttcaggtcttcgcatcaaccgtgcgggagatgacgcagcaggtcttgcgatctctgaaaaaatgagaggacaaatcagaggtcttgaaatggcttctaaaaactctcaagacggaatctctcttatccaaacagctgagggtgcattaactgaaactcatgcgatccttcaacgtgttcgtgagctagttgttcaagctggaaacactggaactcaggacaaagcaactgatttgcaatctattcaagatgaaatttcagctttaacagatgaaatcgatggtatttcaaatcgtacagaattcaatggtaagaaattgctcgatggcacttacaaagttgacacagctactcctgcaaatcaaaagaacttggtattccaaatcggagcaaatgctacacagcaaatctctgtaaatattgaggatatgggtgctgacgctcttggaattaaagaagctgatggttcaattgcagctcttcattcagttaatgatcttgacgtaacaaaattcgcagataatgcagcagatactgctgatatcggtttcgatgctcaattgaaagttgttgatgaagcgatcaaccaagtttcttctcaacgtgctaagcttggtgcggtacaaaatcgtctagagcacacaattaacaacttaagcgcttctggtgaaaacttgacagctgctgagtctcgtatccgtgacgttgacatggctaaagagatgagcgaattcacaaagaacaacattctttctcaggcttctcaagctatgcttgctcaagcaaaccaacagccgcaaaacgtacttcaattattacgttaattttaaaaaagaccttggcgttgccagggtcttttaatttaaatttctatctcctaatcattcctcatcctgtcactaactcatgatataataaccggattctccactaactttttataaatgtatttccatacaagaaatctaaaacagaagatttttttccaaaaatatgtgtaatcttatctcgacttagtcgatataaacgatagattggggcataggggatgatcaattgaacattgaaaggctcactacgttacaacctgtttgggatcgttatgatactcaaatacataatcagaaagataatgataacgaggttcctgttcatcaagtttcatataccaatcttgctgaaatggtgggggaaatgaacaagcttttggaaccttcgcaagttcatctgaagttcgagcttcatgacaagttaaatgaatactatgtaaaggtaatagaggactctacaaatgaagtgatccgcgaaattccaccaaaacggtggcttgatttttatgcggctatgactgaatttcttgggttatttgtagatgaaaaaaagtagaataggagtggtttgagatggtcacaagaataacaggtctggcgtcaggaatggatatagatgatatcgtatcaaagctgatgcagacagaaagagcgccgcttgataagctgacacaaaaaaagcagactcttgaatggcagcgtgacagctatcgtgaagtaaactcaaaaataaaagaattgcaagattatatgtctaaaaatacgttgacatatccgagcacgtatcagagcaaaactgtgacaagctctaatgagtctgtgttaactgctacaggaagcgtaagtgcgccaaattcttcgtctactgttgaagtggcgagcttggcaactgcagcaacgtataaggcaaacaattatacgggatacacacaaggcgattacaatttggcatttaacgttgttgcgcctggcgaaacaacagcaaaaacagtgaacattagtgtgacgagtgccgatacgattgataatgtgatttctaaacttaacagctcagatctaggagtatcagcatttaaagataaaatttggaatggtacagagtacgtagaaacgattgcgttttcttctaaagcaacaggtgcaggaggaagcatacaggcagcagactctgctacagctgactttatgtccggtcagcttggtttttctttggatgctgataataagcttactgcttacaaagaaggcacaaatgccaaagtcacaatcaacggctttgaaatggagaagctgacaaacaatttcacggtgaatggtgttacttattcgattaaaaatacaactgcagccacaggccctgttaccacatctgtttctactgatgttgatgggatttataaccaaatcaaagagtttgtagataaatacaatgaactggttgacagcctgaatgaaaagctgaaagaagaaaaataccgagactatacgccactcacgagtgaacaaaaagaagccatgtccgataaagaggtagagctctgggaggagaaggcgaaaagcggattgctgagaaacgattcaagcatcagcactggcacgaaccaaatgcggactgacttttatactcaagtgaatgcggatgggaaaacctatcaattaactgaatttggcatcacaacttcaagtgcttaccaactgcgagggcacttagagattaacgaagagaaattgaaagcaaaaatagcagaagatcctcaaggagttgctaatctttttacaagtggaacaaatgatagtaactatagcgataaaggtattatgaagcggattactaatacacttagaagtactgtgaaaagtattgaagctaaagctgggaactcgacaatgggagctagtagctattccattggaaaaaatttaaactcgataagtactgaaataactgatatgcaggacagattgaataccatagaaaaccgctattattcaaaattcagtgcaatggattctgcgattcaaaaaatgaacgaacaagcgtcctatttatcacagcttcttgtacaataaatgtaatttggaggatgacacatggcgatccaaaatccatatacagcctatcagcaaaattcagtgaatacggctacacccggggagctgacgcttatgctgtataatggctgtttgaaatttataagacttgccgctcaggccattgagaatgatgatatggaacgtaaaaatgaaaatctgattaaagcgcaaaatattattcaggaattaaattttacacttaaccgtaacatagagctttccgcttctatgggtgcgatgtacgattatatgtatcgcagattggtacaggcaaatatcaaaaatgatacgggcatgctggctgaggttgaaggttatgtaacagattttcgcgatgcttggaaacaagccattcaaagtgagcggaaggaccggcacggatcaggcgggatcgcatgaataatatagatcaactatacactgagacgaagagtatgctgtcacacatacaaaatacgccggaaagcgatgaacttttaaagcaaattgaagactttgtggctacacggtctgaactgattcaggagatatctctgccgctttcagaagaagagcgaaagcagatgaaacttattttgacatgggatcagctgattgtgaaggaaatggaaagactgaagcagtcaatcgcaacagaacttcagcagatgaaaagaaaacgtgtgatgcatacgacgtatttaaacccttataacaacattacgattgacggcacatattatgacaagcgtaaataggtgagtgccttgaagagcattgaagattatacgcttttatcagcttattatcatcttctttttaccatcgaagaggggttgtgttatttgatagaggctgaagagaatttatcaaaaacagaaggggatcggatctaccaagatctgatccaagcctttttttatttggattcaacacattcaacacttctcttcattatggattcgcggtgtgctgaaatttgtgtgaaagcatttgaccaaatttttgcggagtttgatcaattggtctctttctcttttccctctcatgagttctgtgagtatttaaaggaacattttctgattcattatagaaaatggatgctgtctattcatcaatgtatggaaccctttttaatcaattaggcgtgtgtgaggtatttgtttcgttcaatcagcatatacatatacctccgaaccgccaataacagagcaaatacaaacaaaattcgacaaagttcactgaattttcacaaaagatttatgtttcagcaggaattgtaaagggtaaaagagaaatagatacatatccttaataaaagggaggcgttctttgatgaactataacatcagaggagaaaatattgaagtgacacccgcgttaaaggatcatgtcgagaggaagatcggcaagctggagcgctattttgaccatagcgtggatgctgatgtgaacgtcaacttgaagttttacaatgacaaggagtctaaggttgaggttacgattccgatgacagatctggcgcttcggtccgaggtgcataacgaggatatgtacaacgcaattgatctcgcaacaaacaaactggaacgtcaaatccgtaagcataaaacgaaagtaaaccgtaaattccgtgagcagggctctccaaaatatttattggcaaacggtcttggctctgatacagatattgcggttcaggatgacatagaagaggaggagagcttggacatcgtccgtcagaaacgctttaatttaaagccgatggatagtgaagaagcgatcttgcaaatgaatatgctcggccataatttctttgttttcacaaatgcggaaacaaaccttacaaatgtcgtgtaccgcagaaatgacgggaaatatggcttaattgaaccgactgaataatgaagagaagccttccgtgatgtccgcggaaggtttttgtttttcttatttgcaaattctttggaaataacaaaaggtatgatatgataatgagaggtatacatggactagtaaattatttatacatgcctctaaaataggcgtgtgatgatagaggagcgttataaatgcttggaattttaaataaaatgtttgatccaacaaaacgtacgctgaatagatacgaaaaaattgctaacgatattgatgcgattcgcggagactatgaaaatctctctgacgacgcattgaaacataaaacaattgaatttaaagagcgtcttgaaaaaggggcgacaacggatgatcttcttgttgaagctttcgctgttgttcgagaagcttcacgccgcgtaacaggcatgtttccgtttaaagtccagctcatggggggcgtggcgcttcatgacggaaatatagcggaaatgaaaacaggggaagggaaaacattaacgtctaccctgcctgtttatttaaatgcgttaaccggtaaaggcgtacacgtcgtgactgtcaacgaatacttggcaagccgtgacgctgagcaaatggggaaaattttcgagtttctcggtttgactgtcggtttgaatttaaactcaatgtcaaaagacgaaaaacgggaagcttatgccgctgatattacttactccacaaacaacgagcttggcttcgactatttgcgtgacaatatggttctttataaagagcagatggttcagcgcccgcttcattttgcggtaatagatgaagttgactctattttaattgatgaagcaagaacaccgcttatcatttctggacaagctgcaaaatccactaagctgtacgtacaggcaaatgcttttgtccgcacgttaaaagcggagaaggattacacgtacgatatcaaaacaaaagctgtacagcttactgaagaaggaatgacgaaggcggaaaaagcattcggcatcgataacctctttgatgtgaagcatgtcgcgctcaaccaccatatcaaccaggccttaaaagctcacgttgcgatgcaaaaggacgttgactatgtagtggaagacggacaggttgttattgttgattccttcacgggacgtctgatgaaaggccgccgctacagtgaggggcttcaccaagcgattgaagcaaaggaagggcttgagattcaaaacgaaagcatgaccttggcgacgattacgttccaaaactacttccgaatgtacgaaaaacttgccggtatgacgggtacagctaagacagaggaagaagaattccgcaacatctacaacatgcaggttgtcacgatccctaccaacaggcctgttgtccgtgatgaccgcccggatttaatttaccgcacgatggaaggaaagtttaaggcagttgcggaggatgtcgcacagcgttacatgacgggacagcctgttctagtcggtacggttgccgttgaaacatctgaattgatttctaagctgcttaaaaacaaaggaattccgcatcaagtgttaaatgccaaaaaccatgaacgtgaagcgcagatcattgaagaggccggccaaaaaggcgcagttacgattgcgactaacatggcggggcgcggaacggacattaagcttggcgaaggtgtaaaagagcttggcgggctcgctgtagtcggaacagaacgacatgaatcacgccggattgacaatcagcttcgaggtcgttccggacgtcagggagacccggggattactcaattttatctttctatggaagatgaattgatgcgcagattcggagctgagcggacaatggcgatgcttgaccgcttcggcatggacgactctactccaatccaaagcaaaatggtatctcgcgcggttgaatcgtctcaaaaacgcgtcgaaggcaataacttcgattcgcgtaaacagcttctgcaatatgatgatgttctccgccagcagcgtgaggtcatttataagcagcgctttgaagtcattgactctgaaaacctgcgtgaaatcgttgaaaatatgatcaagtcttctctcgaacgcgcaattgcagcctatacgccaagagaagagcttcctgaggagtggaagcttgacggtctagttgatcttatcaacacaacttatcttgatgaaggtgcacttgagaagagcgatatcttcggcaaagaaccggatgaaatgcttgagctcattatggatcgcatcatcacaaaatataatgagaaggaagagcaattcggcaaagagcaaatgcgcgaattcgaaaaagttatcgttcttcgtgccgttgattctaaatggatggatcatattgatgcgatggatcagctccgccaagggattcaccttcgtgcttacgcgcagacgaacccgcttcgtgagtatcaaatggaaggttttgcgatgtttgagcatatgattgaatcaattgaggacgaagtcgcaaaatttgtgatgaaagctgagattgaaaacaatctggagcgtgaagaggttgtacaaggtcaaacaacagctcatcagccgcaagaaggcgacgataacaaaaaagcaaagaaagcaccggttcgcaaagtggttgatatcggacgaaatgccccatgccactgcggaagcgggaaaaaatataaaaattgctgcggccgtactgaatagttcgccccggcaagtttactgaccgcggcgcctgcaggcgcctgcggatcttttaatgaggtgaatgaaatggaattatcagaaattagagcagagctcgaaaatatggcttctcgtttagcggactttagggggtctctttgacctcgaatcaaaggaggcccgcattgctgagctagatgaacaaatggctgatccggaattctggaatgatcagcaaaaagctcaaacggttataaatgaagcaaacggtttaaaggattatgtcaattcgtataaaaaattgaatgaatcccacgaagaattacaaatgactcatgatcttttgaaagaagagccggacactgatctccagcttgagcttgaaaaagaactaaagtcattaacaaaagagttcaatgagtttgagcttcagcttcttctcagcgagccgtatgataaaaataacgcgattttagaactgcaccctggtgctggcggtacagagtcacaggactggggctctatgcttcttagaatgtatacaagatggggagagcgccgcggctttaaagtagagactctcgattaccttccaggtgacgaggcgggaatcaagtcagtgacattgctcatcaaaggacacaacgcttacgggtatctcaaagcagaaaaaggtgttcatcgtcttgtgcggatctcaccatttgattcatcaggccgccgccacacatctttcgtttcatgtgaagtcatgcctgaatttaacgatgaaattgatattgatattcgtacggaggatattaaagttgacacgtaccgtgcaagcggcgcgggcggacagcacgtcaatacgacggattcagccgttcggattactcacttgccgacgaacgtagttgtgacatgccaaacggagcgctcacaaattaaaaaccgtgaaagagccatgaaaatgctgaaggccaagctgtatcagcgcagaattgaagagcagcaggcagagctggatgaaattcgcggtgaacaaaaagaaatcggctggggcagccaaatccgttcttatgtattccatccgtattccatggtaaaagaccatcggaccaatacagaaatggggaacgttcaagctgtaatggatggtgacattgatacgtttattgatgcctacctgcgttctaagctttcataagctgaaaaacacacctgatgcatacgggtgtgtttttttatttcttatatccttgatttcactgctgctttagcatattaccactgtatttgggtgttatttacatctaatcagggaaggattaaaatgctatcggagagcattggaagaaacggaggatatatgatggacgtacggaataaaacattgtggattttgcgggattatgtatacatattgataggagcagcgattacggccgtgtcctttaatgtatttttgcttccgaataagattgccgccggcggggtcagcgggatcagtacgattttacaatcatatggttttgaagcagcgtatgtacagtggattattaatatccctttatttattgctggcgtcattttgctcggcgggaaatttggactaaagacgcttgcaggttctgtgtttttgccgctagtagtgtttctgacaagggatattcagcccgccactcatcatgaactcctggcggcgatttttggcggtgtcgggataggtatcggaattggtattgtgtacttagggaaaggttcgacgggaggtacagccttggctgcacagatcattcataagtactccggtctgtcattggggaagtgtctcgccatcattgacggaatgatcgttgttacggctatgattgtatttaatattgagcaaggcttatatgccatgcttggcgtctatgtgtccagcaaaaccattgatgttgtgcaagtcggctttaatcgttcaaaaatggcgctcatcattacaaagcaggagcaggctgtcaaggaggctgtcttacagaagattgacagaggcgtgacaaaaatttctgcagtcggcggatatactgacgatgaccgtccgattttaatgtgcgtggttgggcaaactgaattcaccaaattgaaacaaatcgtcaaacagattgatgagtcagcttttgtaattgtagcagacgcgagcgaggtgctgggcgagggtttcaaacgcgcttaaacgaggttataatatggaagagatcgtaaaggagttgtgcttctcaacatgaaatcaaagttatcgatactaatgattggatttgcgctttctgttctgttggctgcctgcggatcaaacgatgcaaaagaagagaagacagacactggcagcaagacggaagccactgcatctgaaggggaagaattatatcagcaaagctgcgtaggctgccacggcaaggatttagaaggtgtgtcagggcctaatctccaagaggtcggaggcaaatacgatgaacacaaaattgaaagcattattaaaaacggccgcggcaatatgccaaaggggcttgtagatgataacgaagccgctgttattgccaaatggctgtcagaaaaaaagtaagataaaaacatccttgccgagtgctggcaaggatgtttttatgccttgacaatatgaatgaaaagaaactgtaatagtattatgtctaaatttgacgtataatgaagtgtattgaaaaagggaactttcagatttttcatctttttacaaatgaatgggtcataaattgtcgaatgcattcgaagagtatgaccgtgtgatagataaaatgatataaaagattaggtgatttcatgatagagatgaaggaagtatataaagcctatccgaacggcgtaaaagcactcaatgggatttctgttaccattcatcccggcgagtttgtgtatgttgttggtccgagcggagcaggtaaatctacttttattaaaatgatttacagagaagaaaaaccgacaaaaggacaaattttaatcaatcataaagatctcgcgacaattaaagaaaaagagattcctttcgtgcgccgcaaaataggtgttgtctttcaggatttcaagcttcttccgaaacttactgtttttgaaaatgtggcatttgcccttgaagtgattggagaacagccgtctgtcattaagaaacgggtgcttgaagtgcttgatctcgtgcagctgaagcataaagcgcgacaatttcctgaccagctttcaggcggggagcagcagcgtgtatctattgccagatcaattgtgaacaaccctgatgttgtcattgctgatgaaccgacaggaaaccttgatccggatacgtcctgggaagtcatgaagacgctggaggaaattaacaaccgcgggacaacagtcgtgatggcgacacataataaagaaatcgtaaacaccatgaagaaacgtgtcattgcaatcgaagatggtatcattgtgcgtgatgagtcaagaggggagtatggttcatatgattaaaattctcgggcgccacttgcgtgagagttttaaatctctcgggagaaacacatggatgacatttgcatccattagtgctgtaaccgttacgctgattttagtcggcgtgtttttagtgattatgctgaatttgaataacatggccacgaatgcagaaaaacaagtcgaaatcaaagtgctgattgatctgactgcagatcagaaggcacaggacaagcttcagaacgatattaaggaactgaagggcattcagagtgtcactttttcatctaaagaaaaagagcttgaccagctggttgacagttttggtgacagcggaaaatccctgacaatgaaggatcaggaaaacccgcttaatgatgcgtttgtcgtcaaaacgacagatccgcatgatacgccgaacgtggcgaaaaagatcgaaaaaatggatcatgtttataaagtcacttatggaaaagaagaggtcagccgtttgtttaaagtggtcggcgtttcccgcaacatcggaatcgcgttaattatcggcctggtatttacggcgatgttcttaatttccaacaccattaaaattacaattttcgcaagaagaaaagaaattgaaatcatgaagcttgtcggcgcgacaaactggtttatccgctggccgtttttccttgaaggattgctgctaggcgtattcggttctgtgattccgattgcactggtgctgagcacttaccaatacgtcatcggatgggtcgttccaaaggttcaaggatcatttgtctctcttcttccttataatccatttgtattccaagtttcgctagtgctgattgcaatcggcgcagtaattggagtatggggaagtctgacttccatccgcaagtttctgcgagtataaagtgaaaaagccgttccgttttcgggacggcttttcatttgccttctttttcttctatgattacatgaaatctccatcctttacatatactatctctaggttttggtaaagacagtctggcatacaggaggagtaaaggatgaatcaaaaaataatggctgtgatagcagcagggagcatgctgttcggaggcgccggtgtatatgcgggaatcaacctgcttgagatggataagccccagactgcagcagttcccgcgacggcacaagctgactctgaacgggataaagctatggacaaaatcgaaaaagcgtatgagttaatttcgaatgagtacgtagaaaaagtagatagagaaaagctgctcgagggagccatccagggaatgctgtctacgctaaatgatccttattctgtttacatggacaagcagacagctaagcaattttctgattctcttgattcctcatttgaaggcatcggggctgaggttggaatggaagacggcaaaattattattgtttctccattcaagaaatcgccagcggaaaaagccgggttgaagcctaatgatgaaattatcagcatcaatggagaatcgatggccggcaaggatttaaaccacgctgtgttaaaaataagaggaaaaaaagggtccagcgtttcaatgaagattcagcggcctggaacgaagaagcagttgtcattccggatcaagagagctgagattccgctcgaaacggtttttgcatcagagaaaaaagtacaggggcattctgtcggatatattgccatctctactttttctgagcacaccgcagaggattttgcaaaagcgctgagggagcttgagaaaaaagaaatagaaggacttgtcattgatgtacgcggcaacccgggtggatatcttcaaagtgtggaagaaattcttaagcatttcgttacaaaggatcagccgtatattcagattgctgaacgcaatggagataaaaaacgttatttttcaacattgacccataaaaaagcgtaccctgtcaatgtgattacggataaaggaagtgcctctgcatcagaaattcttgccggcgcattaaaggaagctggccattatgatgttgtaggcgatacgtcttttggaaagggaacggttcaacaggctgtgccaatgggggacggcagcaacatcaaattaacgctttacaagtggctgacgccaaatggaaactggattcataagaaaggaattgaaccgaccattgcgattaagcagcccgattatttttccgccgggcccttacagctgaaagagccgcttaaagtggacatgaacaatgaagacgtcaagcatgcgcaggtattgttaaaaggtctcagctttgatccgggacgtgaggatggctatttcagcaaagacatgaaaaaagcggttatggcttttcaggatcaaaacaagctgaataaaaccggtgtgatcgacactcgcactgcagagacattaaatcagcagatagaaaagaaaaaatcagatgaaaaaaatgatttgcagcttcaaacagcattgaaatcattatttgtcaattaaaggagatggtatttcatctcctgtttctttgtgcttaaagagattatggatcataagtcacataaaaaatgagtttttgacaagaaattaaaaaaattttcacaaataaacatttataaaggactgttattacccgatatcaatatatgagagagactttctaacgagttaatatgcatttaaaatgaaacttttgcaagttgcctagtctttgtttacttcatacaatataagaaggttctaaaaagaacagtaatcaggttaatggcagctgaacgacaggtatttaaagagtaacgttagcgagaatgcttgttagcactccagtactgctgcttatactggcccgtgcttatctgtttaaagaaaatgggggttcacaattgaagagggcaagtattgtgcgtgaaaaaaaatattatgaattagtggaacaattaaaagacagaacacaagacgtaacattttcagctacaaaagcactaagtcttcttatgctgttcagcagatatttggtcaattacaccaatgtcgaatcagtaaatgacattaatgaggaatgcgccaaacattattttaactacttaatgaaaaaccataagcgattaggaattaatctgacagatataaaaaggtcgatgcatctaatcagcgggttattggatgtggatgtaaaccactatttaaaggatttttcactatcgaatgtcacgctgtggatgacgcaagagagataaactctcctgaggatatccaagccatttaatatttgatagaatatgagtaacatgtttggcttgaggcggtgagagatagtgtctgttcaatggggaattgaactgttaaaaagcgcgggcttgttcttcttacacccgcttttctggttttttatcatcataaccttggctttcggctatgtaagaatcaaacgggaacgaaaaacctttcatacaagaatagcagatatttatgatgatctgaaatttacatatacaaagggactgattccaggtcttcttttgtcagttattttaggtggactcggaatatcgattcctctcggtttacttgcgattattgccgttatcactgcagcggcagcgttcactcttcgcgcaaactggatgtctgctgcatatatcgtcagtgtgagtatgctgataggttttggactgcaaatatatcaggcggagccctttctggagagatttccgcaaggatttgcagttgtttggccggctgtggctgtgtttctaggtttgctgattatcactgaaggagcggttgcttatcgttctgcgcatgtgagaacatcaccggcacttgtcgtaagcagccgcggtttgccgatcggacagcagctggcaaaccgggtttggcttttgccgctgttccttctcgtgcccggtaatggtttagaatcgcaccttagctggtggcccgtgtttacggttcccggcggctcattccattttctatggattccttactttgtcggatttggacaaagggtacagggatcgctgcctgaaacgagtataaggatcacagcgaaacgcgtttgtattctcggtcttgccgtcgcagttctcggtgcagcgagcttactgtggacgccgcttgcgggtgcagcggtctgtaccgctttgttagggcgtatttttctgtccataaagcaaagagtgaatgataacgcggctccgttttatttctcgaaaagggatcagggcttaatggtgcttgggattatccccaatacgccggctgaggatctggaattgaaaatcggggaaatcataacgaaagtcaatggcataccggttaagaacgtttctgatttctatgaagcgcttcagcataaccgtgcatatgtaaagcttgaaattatcggtttgaatggagaaattcgttttgaccagcgagcttcttatgaaggagaacatcatgaattgggcatcctcttcgtaaaggatgaccgtgaagacgaagcagtcgcttcgggatcataaaaggcagcccggcaccgcaggatgatgcgatgccgggctgttttgtgttacgctgagtttttttctatccgtgccgtttcatcagatttgatgcccaatgaaacaaaaacgccgatgatggatacagcaaagagaatcataaatagggtgtgatatcccgaaatcaggccaattaaggctgatgaaatgatgcttccgaaataacggaaggtcgagaaaatcccagatgccactcctgacataccggggtctactgtggcaagggatgaaacctgcatgctggtcagaccgactccggaagcgagcccgccaaggataagagagagcatgaggaacaagacagaatgcgagctgcttaacagcaaaaataatagattcgcaccagccatcatggcaaatgaaagaaaaatgatttttttggctccccatttgtgatggagctgcgcgcccacccagttgctggctgacatgaagatcgaaaatacagaaagcgccatcccgctgttagatgtattaagcccaaattggttcgtcataaataacggcataatcaataagacggcatacatcatcaaattgcttaacaagactgatagattcgcatttgtaaaggttgagcttttaaacagtgcaaagtcaatgatggggtgctgggtacgtttttctcttctgaaaaaaagcggaacaaaaagaagtatcaatacactgtatacagtatatccccatggagcctcatttttcgtcagcaggataatggaaacgatgctgcctgcaagcaagagagagccgatgatatccagcggcgcgtcagatttattttctttatattgaggaaacatcgttaatgccgtaaataaagcaatggcgaggaacgggatgttgacccaaaaaatcgaatgccagctgaagctgtcaatcagtatagagccgataaaaggcccgagtgctgcaccaagtcccgcgcccagtccgaaaaatccaaacactttcggtaggcgtttttcagaaacaacatgccggataatggcaatgctgtttggcgtaagcaatgccccgccgacagcctgcaatgcccgaaagacaattaacaggagcagactcggtgaaagggcgcagcctagagatgcgattagaaaaaggccgactccccataagtacattgttttattgccgtacatgtcaccgagctttcctgcaatcggctgtgtgactgccatcacgattaaataaacggtaaccacccaagtgatgcttgcgatggactcgttatacgtatgggaaatagatgagagcgcgaccgcgatcatcgttgagttaatgggaaccagaatggcccccaataatagcgagacgatcagcgcccattcttttcttgagctcattgggatcctcctttttattatgccaaggagttaatcagcagaaattcctttgacaaatagagctgtgctatgctccagcattttttcctggggcattgatatgacccggtctcctaagtggagacggtgaatgaaataaccgaagataatcgacatgaacacgtcggcatgttccgcttcatttcctgtctgaataacccctttctcacccatcgttttgagataatcaaccaatagctgtttcatagattggggatattcagtgacgtggttaatgacatcctgaaacatggccggttcacgaaagctgattttaatgatatcttttctatgttcgagctcctccaagagacaggttccgatatgaagcaggtctttgtacaaatccccttctgtttgttccaaaatgctgcctctgtttgaagaatgctgagaaagcaaagcctcaactagtccttgtttgtttttaaagttcctgaaaatcgtcgcttcacttacatttgctttttctgcaatttcttttgtagtcgttgcgcgatatccttttttgacgagcagctgcatggcagcatcaaggattctcttgtttgtcggtctcaatacgtttcacctcacgaatatactggcaggacaagtatacacccgccccgcttgtataagaaagagggggacgcatcaggaccggctgacaactgtgattttgccgctgcttccgtcaacagtgatgatgtcaccgtctcgcagtctttcggttgccgtgcgtgtgccgagaacggctggaatgccgtattcacgggcaataatcgcagcgtgagacaaaatgccgcctgtgtctgtaataatcgctttggcgtcttgaaacaggctggtccatagcggtgtggtcatcttgcaaacgagtacgtctccaggcgcgaattgagaaaattcattggcgtcccgaatgattttcaccggacctgtcgcaatgccgcttgatgccgcaatgccaaaaatatgattctctgtgtttttttcatcctctatcacagcgccgacaatttcttcagctgctttgagctgttcttttgtcggggtgccgaggtaggccggggcttgggccagctcatactcatgaaaaatctgtctgcgtttttcagccttttcttgcagggatacagggtgaagaagcgcttgttccacttcgtcgtcatataagaaccaaaggtcctcccgatcttgaatgacaccgttttccgccagcaattcacctatcttcagcagaaagattctcgccttggcatccagcatggcgtcaatataaaagtggtgatcatcttttatatttgcagagttcagtgtccattgataatagcggtcaaattcggtgcgtaaaccgggatcttctatgctttccaagaattcattgtataatttctctcgtttttcttttgttttctgaaattcattgtcaaaatgatagccattacggacataattttgaatattggccagagcgaaatacggattttccacccagatttgttcaatcagatcatgacttttaacagatctccatccgtattcttgcaagaattcatggacgttcttcaggaagtgtcttccctcatctgtttgttccaatttctcctggagctgttcaggcttgttgttttcaaaaatggccagaaggttcgggttctcctgaacttccacagaaaatagccataagcaacggtccgtttccagtgatttgttcatttttcctgtcagcatctcgtaaaaatgagcgttttcggactctccttgaatgtcctgatacatcgcttgcagtttgtttgttaaaaggatttgcgggaaaacgatattaaagtgctcttcataagccgtgagataaaaggcctttagtttttgaaaagcttccagtgcgctttctgcggtatgctcagtttgtgcgagctggtccagtgtccggtaaaaagggaggtatgtgtgattgatgatgtcatacatatgctccgataaaatcgggaaaagctctttgccgcagtcttcagaaggaggctgctgtccgccttggtttttggaataaatatgtccgcgataaagttttacttcatcaacaactacaccaatcggaaacttttgcatgctcttcttcaagccatattccaatgccggcacgatgaaggatgaaaataacggactcaccggaccttcaatattagactccatgttaagccagaaatcattcatatcagtgtcggtaatcatgaagctgcgtttttcttctgccgcttttttgtcctgatcaatggttgtaatcgggcgagcttgcagaaggtatatttgatgatcagcaattccaaattctatatcaacaggatatccgtacaggtcttcggtttttttgtgatttcagccaattcaatcacttgttcatctgtaaggcaaaaacggctgcgcatgtcttcactcgtttctttttcagcaattccttctgccgcagactccatgtagatttcctttgcacctatttctttctgaatctcaaacgaagatttattaacaatgaacgtgtctggggtaacatttcctgaaacaacagcttcacccaacccgtagctggcgctgattaaaagctctctatcatcatgggtaacagggttgcggctgaagataacacctgacatttctgaatcgatcagcccctgaacgactattcccattaacggctctgcgatttgattgttcatttttttcttatagctgctgacccgcccagaaaaaaatgaggcccagcattctttcactttagccagaaactcttcctctgttttgatatttaagtaggtttcatattgacccgcgaatgaggcgccttctaaatcttccgaagcagacgaagaacgcacggctacggatcgatatgattctctaagcttataaaaggaactagtcagctcatctttcagctcatccgaaaatgttccggaaatgatcccgccttcgacgttttcactagtctcttgaagctggttgtcctccataaaacgtgcgagcgcattcgtttgaataataaacccgtccggaacaggaagaccgtgtttggtcaatttaatcaaattcattccttttgctccagccagctggctggactcttctgcctggcgaaataaaacagaatacatatttgaaacccctcttttcttcattcattttgtttttctctctagtctttttattgcggagcctgtgtttaaaaaatgatagtaaacactatcatttaattgtaggttttcaggaaaatgctgtcaaacgcagaaagtcctaaataaaatgaatagttaagttggttatattatcctgaaaaatgcggccgtactggtactgtatgcctattttcttttattctcggaatctggcggcggacttgatgatgtaataaaaaaagtgccgctgattagaacagcggcaccatggaataagttttgaccggcaccaaaatgcaaatatggtgattgattttggctgaaaaggggtatggtgtaagtagagggagcgaatgcacgattgtccgattcttcattttttactataatcagatcagatgaagaatccctgaggagggtttttgttgattacaaaagccgtttttgcattgtttttcccttttatgcttgttgttctatttactagagtcacctttaatcattatgtggcgatcgctttaacagctgcattgctgtttgcctcttatttaaaaggctatacagaaacgtattttattgtaggattggatgttgtgtctcttgtggctggcggactgtatatggccaaaaaagctgcagagaaaaaagaagaataaatcggacataatgaatataaagactgaatacctgcttttacgttttaaaagcaggttttttatacacaaaaacagctggaaataaaaaaccaccgaactttagttcgtatttttagtgattttgctttccattgtgttactatatctataggaagatttcgttaaagaaacggaggcttatttttgtgaaagatcgctttgagttagtctcgaaatatcagccccagggagatcagccgaaagccattgaaaagcttgtgaaaggaattcaggagggcaagaagcatcagactctgctgggtgcaacaggaactgggaaaacatttacggtgtccaatttgattaaagaagtcaataagccgactctcgtgattgcccataacaaaacccttgctggacagctttacagtgagttcaaggaattttttccgaacaatgctgtcgagtattttgtcagctactatgattattatcagccggaggcgtatgtgcctcaaacggatacatttatagagaaagacgctagtattaatgatgaaattgataaactgagacactccgccacatcagctttgtttgagcgcagagatgtcattattattgcgagtgtgtcttgtatatacggcctcggttcgcctgaggaataccgggaaatggtcgtgtcactgcggactgaaatggaaattgagcgcaacgagctgctcagaaaacttgtagacatccaatatgcccgcaacgatatcgactttcagcgcggtacatttcgtgtgcgcggggatgtagtggaaatctttccggcatcccgtgatgagcattgtgtcagagttgaatttttcggtgacgaaatcgaacggattcgggaagtagatgcgctgacaggagaaattctcggcgaccgagatcatgttgcgattttcccggcatcccacttcgtaacgcgggccgagaaaatggagaaggcgattcaaaatatcgagaaggagcttgaggagcagctgaaggtcatgcatgaaaacggaaagctccttgaagcgcagcgtttagagcagcggacaagatatgatcttgaaatgatgcgtgaaatgggtttctgctccggcatcgagaactattcaagacatttgactctgcggcctccaggttcaacgccgtatacgcttcttgattatttcccagacgattttatgatcgtggtggatgagtcgcatgtgacaattcctcaggtgcgcggcatgtttaacggagaccaggcgcggaaacaggtgctcgtggatcacggcttccggcttccatcagcgcttgataaccgtccgcttcgttttgaggaatttgaaaagcatatgcacaatatcgtgtatgtatcagcaacaccagggccgtacgagattgaacatacagatgaaatggtcgaacagatcattcgtccgacggggcttcttgacccgcttattgacgtccgtccaatcgaaggtcagattgacgacttgatcggcgaaattcaagcaagaatcgagcggaatgaacgggtgcttgtgacaactttgacgaagaagatgtcagaggatctgaccgattatttaaaggaaatcggcattaaagtaaactatctgcattctgagatcaagacgcttgaacggattgaaattatccgcgacctgcgccttggcaagtacgatgtgcttgtcggcatcaacctgctgagggaaggtttggacattcccgaagtatcccttgttgcgattttggatgcggataaggaaggtttccttcgttcggagcggtcgctgatccagaccatcggacgggcagcgagaaatgcggaaggccgcgtcattatgtacgccgataaaataacgaagtctatggaaattgcgattaatgaaacaaaacgccgccgcgagcagcaggagcggtttaacgaagagcacggcattacgccgaaaacgataaataaagaaattcgcgatgtcattcgtgccacagtagcagctgaggataaagcggaatacaaaacaaaagccgcgccgaagctgtcgaaaatgacgaagaaagaacgccagaaagtcgttgaacagatggagcatgaaatgaaggaagccgccaaggcgcttgactttgagagagccgcggagcttcgcgatttacttttagagctaaaagcggaaggatgatgaacaaatggctatggatcggatagaggtgaagggagccagggcgcataacctgaaaaatatagatgtaacgattccgagagatcagcttgtcgttgtcacgggtttgtccggatcaggtaaatcctcccttgcctttgacacgatatatgctgaaggacagagacggtatgtcgagtcgctgtctgcctatgcccgccagtttttagggcaaatggataagccggatgtggatgcaattgaggggctctctcccgccatcagcattgatcagaaaacaacgagccgcaatccgaggtctactgtcggtacggtaactgagatttatgattatctgcgtcttttatatgcgagagtagggaagcctcattgtccggaacacggaattgagattacatcccagaccatcgagcaaatggtggacagaattctggaatacccggaacggacgaagcttcaggtgctggcgccgattgtctcgggccgaaaaggcgctcatgtcaaagtgcttgaacagattaggaaacaaggctatgtcagagtcagaattgacggcgagatggctgagctttccgacgatatcgaattagaaaagaacaagaagcattccattgaggtagtcattgaccggattgtcgtgaaagaaggcgtggcagcccggctgtcagattcattggaaacggcgcttcgtttaggtgaaggacgggttatgatcgatgtcatcggtgaggaagagctgatgttcagcgagcatcatgcctgtccgcactgcggattttcaattggtgagcttgagccgcgtctgttttcgtttaacagtccgttcggggcgtgtccgacgtgtgacggtctcggaatgaagcttgaagtggatgccgatcttgtcatccccaatcaagatttgtcattgaaggagaatgcggtcgccccttggacaccgatcagctcacaatattatcctcagctgcttgaggcagtctgcacccactacgggattgatatggatgtgccggtcaaagatttgccgaagcatcaactggataaagtgctgtacggcagcggggatgacctgatttatttccgatatgaaaatgattttggacaaatccgcgaaggtgaaattcaatttgaaggcgtattgcgcaacattgaaagacgctataaggagacaggctccgatttcatacgtgagcaaatggagcagtatatgtctcagaagtcttgtccgacgtgcaaaggctatcggttaaagaaagaggcgcttgccgtactgattgacggccgccacattgggaaaattaccgagctgtctgtcgccgacgcacttgccttctttaaagatcttaccctttctgagaaggatatgcagatcgccaatttgattttgcgcgaaattgtggagcgcttaagctttctggacaaagtcggcctcgattacctgacattgagcagggcagcgggtacattgtccggaggagaggcgcagcgcatcaggctggcgactcaaattggctcgcgtttatccggtgtgctttatattttagatgagccgtctatcggtctgcatcagcgtgataacgaccgcttgatcagcgctctgaaaaatatgagagacctcgggaacacgctgattgttgtcgaacatgatgaggacacgatgatggcagcagattatttaatagatattggaccgggagccggcattcacggcggacaggtgatatctgcgggtacgccggaagaagtgatggaagatccaaattcattaacgggcagctatttatcagggaaaaagtttatcccattgcctcctgaaagaagaaagccggacggacgttacattgaaattaaaggtgcatcagaaaacaacctgaaaaaagtgaatgccaagttcccgcttgggacgtttacagcagttacaggtgtttccggttcaggaaagagtacactcgttaatgaaattttgcataaggcgctggcgcaaaagcttcataaagcgaaagcgaagcccggcagccataaagagattaaaggtttggatcatttagataaagtcattgacattgaccaggcgccaatcggaagaacgccgagatccaaccctgcgacatacaccggtgtatttgatgacattcgtgatgtattcgcgcagacaaatgaagcgaaggtccgcggctataaaaaaggccgtttcagcttcaacgtgaagggcggacgatgtgaagcctgccgcggagacgggattattaaaattgaaatgcacttccttcctgacgtatacgttccatgcgaggtgtgtcacggcaaacgctataaccgtgaaacgcttgaagtgacgtacaaaggaaaaagcatctctgatgtgcttgatatgacggttgaagatgctctttctttctttgaaaatatcccgaaaatcaaacgcaagctccaaaccctttatgatgttggtttaggttatattacgctcggccagccggcgacgaccttgtcaggcggagaagcgcagcgcgtgaagctcgcgtcagagctgcacaaacgctcaaccggacgtacgctctacattttagatgagccgacgacaggtttgcatgtcgacgatatcgccaggcttcttgtcgtgctgcaacggttggtagacaacggagacactgtactggttattgagcacaatcttgatatcattaagacggccgattacattgtggatttgggcccggaaggcggagccggaggcggaaccattgtcgcgtctggaacgcctgaggaaatcactgaagttgaagaatcgtatacaggccgttatttaaagcctgttatcgaacgtgacaaaacacgcatgaaatcgctcttgaaagcaaaagaaacagctacatcttaaaaccctctgttaagaggggacagcttgtcggcaagtccatccttgggcttagcaggcaagctttttctttacggcataataggtttagaagtgaacttactgttcaagcaggaaacacaggtacacaacaagcagaagatcttggtgcaattaaagatgaaatggatgcgcttattgaggaagttgatggcatttcaaatcgtactgaattcaacggcaaaaagttattagatggtactgaaactgatggtttcactttccaaattggagcaaatgctggccagcagcttacagttaacattgacagcatgtcatcaactgctttaggagtaaacgcacttaatgtaacagattttgctaatactccttttgatacacaacttgaaagtattgatactgcaatcaacaatgtctcaaaccaacgtgctaaacttggtgcggtacaaaaccgtctagagcacacaatcaacaaccttggtgcttcttctgaaaacctgacagctgctgagtcccgtatccgtgacgttgacatggcgaaagaaatgagcgagttcacaaagaacaacattccttctcaagcttctcaagcgatgcttgctcaagcaaaccaacagccgcaaaacgtgcttcaattgttacgttaattttgaacggctatctctttctgatagttacagcttgccgacagagtccattaactggatgtgccggcaggctttttttgttacaatcattttgtgacagccagggaatcacttgttttttcaaaacaaaaaaggcaagatattgtcatctaacctttagctttgtttcagttataatgaatgatatgttttccgcaattacaaagtcttcttatacagctgcttacttacactcattaaatcttgaacaatatgtgtgttgctgctgtcgagcagcacttttatatattggatatcgtgagagatcgggaagggtccgtgaatctgctcaagctcggtgatcatttcacgattcattcttttttgttcctgaatcagctttaacactgattcttgtgttactgtatagtcactgggatctttctccattgcttgtccagcctccttggttgccgtaagctttttacatattgtaatcggtatagccggaagattctacttctaaaactttttaaaatccaatttccgtaaatcggagcatgtctaaagaatgaatttgaaacctgaagagattttaaacgtataaataagtaaaacgtccctgatcttttgtcatggacaattcacaataggagtgtggaatgaattgaaccgtaatcaagctattattgcatcactttgttatttcagtgtgttcattgcgccaatcattgtgccgattgtcgcatattttgttgtaaatgagaaagaaacaaaacgccatgcgatacgctctcttatttctcacattgttccgtttgtcggctggctgttcctttttattgctttacttggcggagccgttgcgattgatggagacagcttgcttcctgtatttgtaatcatcgggggagcggttatttatttcttagttgtcattggcattatcatttggaatgtgattcagggcattaaggtcctgcgtgcagcataagtagacaatggggaggagatcgtaatgaagcaagaaaaggaacgaatccttaagcttgttgaggaaggaaagcttacagcacaagaagctttgacactgattgaaaagcttgacagcgactacaaggaaaaagaagagaaaatcacagcgctctcagttcacgttcatgacgaggaagagccatttacaacggcaaaaaaagaaagcggcaaaccgtctttaggagccaagctgtttgactggattgattctgctgtgaaaaaggtcaaggaagttgaccttgatttaaactttggccatgcgtatgatgttcagcacatttttcaatttaaagatactgacttttccagtgttgagctgcaaattgccaatggcagcgtaaatatcgtcccttgggaagatgacgatatcagagcggaatgccaggcgaaggtatatcgcgctgacagccaggatgcggcgagacacgcatttcttcagcatattgaatgtgaaatcaaaggtaataagttttttatccgtactgagaaaaagacgatgaaaacgaatgtcactttgtatattcctcagaaggagtatgataagattcgggtgaagctgtttaacggtccagtcagaggggaacatttacatgtaaaagagttctcagcgaaaacgacaaacggcgtgctgtcgttctcgtatttaacagccgaaaaagccatagctgaaacggccaacgggcaaattaagctcgcaagccacagctgcggtacgatagaagcggaaaccattaacggattgatcgatctccgagggaaaagcgaatccattgacgttcaaagctttaacggaaatattgcgattaacgtaacagaatcagactgccgctccatttatgcaaaaacaacgactggaaatgtagagcttgcaattccggacgatctcgcagtgaaggcagagctgaaaagcaatcttggtacgctgtcccatgaattaatggatgtagagatgctgaaggaaaaaaatgatacgattcaaaaagaaatgatgttcacttcaaatcaggcacatgatcaaaacatcaccgtcttctcagaatcactaacaggcgccatcaaactaaagtactcacagaggtgatcgaatgaataagctttatcgctcagaaaaaaataagaaaatcgccggtgttatcggaggtctcgcggaatatttcaattgggacgcatcactcctcagagtcataactgtcatcttagccattatgacaagtgtcttgccggttttgctcatttatatcatttggatttttatcgtcccgtcagaaagggatatgaaatgacatggtaaaatgggcagtcagcattttagtcaatgcattgttattaatcgtcattgatggatatattgactccatccatatcagcagcattggggcagcgattatcgccagcctcattttatcgatcttaaacgtgctgattaaaccgcttttaattatatttacactgccggtcaccatggtgacgcttggactcttcttgtttgtgattaacgccatcacgcttatgatgaccgcgtccattatgggtgacagctttcaaatcgacggcttcggcacagcgatatgggcatccgttatcctgtcggtcttccatttgctgattcaaaaaggcattttagagccgcttagaaaaaataaaaaagctgcccgcaaaggcagcttttttacatgtggtgctttttttgtttcgtgcgcttctgcggcgaaaacattggcggaagaaggcaaaagctcaatgcggcaaatccaaggcctaggaggctaaaggacatggcagacggcatcattgtgagcaagtaggcagataccatcggacctgctgccatgcctgtatatcggataaagttaaacattccgattgcactccctctgttgtgctcaaattcattagtaatcattgtagagtacaagggaggaataacccccatcgagatgccaaacagtgccagcgtcagagccatgagaacgagagaaacggaatgtgtaacagcaaataaaatgatgctgcaggcggcaatcacattgcttccgataaacaaggtgtgcagcccgatttttgcctgtattcttttaaacagaaacgtacctgcaatcgtgctcagcgccagcggcaaatataacagtcctgctatacccacatctatatggtaatgctctgtcagcaatattgggaggtagacaattactgcaaaataaatgaaaaagagaacaaaacttaaagtcaaaatgacgttccctgttcgatttgtaaatattgatttataatgagcgaacacattgcctttggcttgctgcatagattcagttggagaatctttaggaaaggtgatgctgtttgtcaccagcaaaacgatagagatggccgcaagtatccaaaaaatcccttcgtatccggctgctccgcctatgaatcctcctagaactggagcaatagccggtgcgacagacaggagcatttgatacgttcccattgcactcccgcgttcatttcctgtaaacagctgtccgatcgttgtggcagcaataagaggcagtgctgcggaaccggctgcctgtatcattctgaatatcagaaacaaggtaaagtcagtagtcaccgcacagccgatgctggctgctgccgttgccagaataccggtaatcaagacgatccgagcgcctttaaaatcaatgatcgctcctaatataatttgcattattgctgtcacaatcataaaaactgagactgacaggttcaccatagctgtggaaacatggaatgattctttaatgatcggaagaataggtgaataaatgttctggcttaaagatgcaaaaaatgcactgaagcaaacagtgtataagatcaatactgcctttgattttgtatgagccaaagtgtacaccgcctttttgtttactttacaggtttgtctggagtcccatcggtttgttctgcttcaagtgttgacgtcaactgctctagaaacttcaatacagccttttgttcttcttgtgaaaatgaatcgaggaattggtaaaaagccagctcctttttttatgcagtttctcatgtaagtcgaaaatccgtctgcctttacgggttaatttaaaataaacttcttttttgttatctgtcagctgatagctgttaatgaattcttccttgatcagttttgtgctgattttcgttacattcgctttcgataagttcatttttctggcaattccggcattattaatgggttcatgctggccgatgcagtcaatgacgtgaatgcttgtcatatttttgggaatttcagctacatcctcttctgcggcctccttaaaaaattgctgaagtgaagtgttcgctttttgttcattaaggtgcagcagtctcacgtatatgtcgtatatcatctgttttgtcaaatcagacataggctaccttctttcttaggaataatagtttacgatgaaacaataaaacaaatcgtttactggtgaacaattttattttatcttttcttgttttcgttgtcaattgttggtgtttagactatttgttgatatgtcatgctgaatatgcgtgtaaaaagtgtgtggaaaatgtgatgtttacatttattttcaaatatttgggcacagatcatattgacgtttggaaggaaaagggataaaatgactaatgtttactagtaaacatttatcatgatatgggtattgaaaatgattattaaaatcttaaaaaacatttggaaactttaagtgatgcctgccattcgtcttgttcagttgttctagctattccatcttgtatttgagggtgatgacttaaagcgggataagttttaggggtgaatgagatgaccggaatggtaacggaaagaaggtctgtgcattttattgctgaggcattaacagaaaactgcagagaaatatttgaacggcgcaggcatgttttggtggggatcagcccatttaacagcaggttttcagaggattatatttacagattaattggatgggcgaaagctcaatttaaaagcgtttcagttttacttgcagggcatgaggcggctaatcttctagaagcgcttggaactccgagaggaaaggctgaacgaaaagtaaggaaagaggtatcacgaaacaggagatttgcagaaagagcccttgtggctcatggcggggatccgaaggcgattcatacattttctgattttatagataacaaagcctaccagctgttgagacaagaagttgaacatgcattttttgagcagcctcattttcgacatgcttgtttggacatgtctcgtgaagcgataatcgggcgtgcgcggggcgtcagtttgatgatggaagaagtcagtgaggatatgctgaatttggctgtggaatatgtcatagctgagctgccgttttttatcggagctccggatattttagaggtggaagagacactccttgcttatcatcgtccgtggaagctgggtgagaagatcagtaaccatgaattttctatttgtatgcggccgaatcaagggtatctcattgtacaggaaatggcgcagatgctttctgagaaacggatcacatctgaaggatgatagggggagtaaaacatgagccaatcgattaaattgtttagtgtgctttctgatcaatttcaaaacaatccatatgcttatttttcacaactgcgggaggaagatccggttcattatgaagagtcgatagacagttattttatcagccgctatcatgatgtccgctatatccttcagcatccggatatcttcacgacgaaatcacttgttgagcgtgccgaaccagtcatgcgaggccctgtgctggcccaaatgcatggaaaagaacactctgccaaaagaagaattgtagtgagaagctttatcggtgacgcactggatcatctgtctccattgattaaacaaaatgcagaaaacttgttagcgccttatcttgaaagagggaaaagtgatctcgtcaatgattttggaaagacgtttgcggtgtgcgtcacgatggacatgctcgggctggataaaagagaccatgaaaaaatctctgagtggcacagcggagttgccgattttatcacgagtatctctcaatctcctgaagcgcgggcacattcgttatggtgcagcgaacagctttcccaatacttgatgccggtcattaaagaacgtcgcgtcaatccgggatcagatttaatttcgatcctatgtacttctgaatatgaaggcatggcgctgtcggacaaggatatactcgcactgattcttaatgtgctgttagccgcaacggaaccggctgataagacgctggcactgatgatctaccatttgctcaacaatcctgagcagatgaatgatgttttggctgaccgttcgttagttccgagagccattgcggagacattgcgttataaaccgccggttcagctgattccgcggcagctgtcccaagatacagtggtcggcggtatggaaatcaaaaaagatacgattgttttttgtatgatcggtgcggctaaccgggaccctgaagcatttgaacagcctgacgtgtttaatattcatcgggaagatcttggtatcaagagcgcttttagcggcgccgcccggcatctcgctttcggatccggcattcataactgtgtaggagcagcttttgccaaaaacgaaatcgaaattgtagctaatattgtgctggataagatgcggaatatcagattagaggaagatttttgttatgctgagtccggtctgtatacacgcggacctgtttcacttctcgttgcgtttgacggggcataatagaattccaaaggtctctcccatgcgggtgagactctttttacatatatttgatccacaagttgaaaaacgcagtcactgtttttaaatcatcaattgaaaattcattgaaaagctgtttatattgctcctttgctttctcatgaagctgttcatgtaatgccgccaattttctgccgctatcagttagcgtataaaaaatttcttttttgttgccaggcttttttgtcactgtaatgatattgtgtttcaacaaagcatgaaccgcttttgaaacagcggcttttgagatgtgtaaacgggatgctaagaagctgttgttcacattttggctggtatgtatgcaggaaacaatgtgaagctgggtcaaagtccagtcttttttgaggtgatcgtgatgttgtgaggatatgccaatggatggtatctgcaccttttgccagacgcgtttatccctttttaatgcgaattgttgtatagcttgaaataattcatcatgaatgctgttgtccatcaatttgcctctctgatttaattgttaactggttaactatccttagtttactgggtaatagtggaattttcaagagacagacgtttttttgttctttatgcacaaaaatgaactcataagcttccctgttcagacgcaaaatacatgaaaagggaggtgctttgatgaggaaatacacggttattgcttctatattactgtcttttctttccgttttgtctggcggccatcatgaatcgaaagcttttcctgttgtacagcaggaactatttcaaacgcctcattacatacccttgcttgaaaatcctcctcaaattgatgtgaaagctgaaatgagaagcaatctaatgattgaggctcaagttcgcgataattcgtatcaagcattttccgcctttcttttttataaacaaagtaatgagctgggctacaaaatggtgccgatggacccgacccccggagcggtccgcaagtttttggcacaaattccgaaacgtttgatttggaacagcgagcttgagtattacattgtgatgtcgaatgggaagcagcgggttgagtcggagacgaagaaactgaagcttgaaggataccaggctgaccttgcccatattccggagcttctgatcacagagctggcggttgatacgaagaatataggacgcgcagacggttatgaatttattgagatttttaatacgactgacagaacgattgattttaaagactaccatatccgttaccgctacccaaaagaagggcctgactccgatctgatttggagacctgatgaaaggatcttgataccatccggcgaaacgtttgtcgtctggctgaagcctgccgggcatccagaattgacgtcagcggatttcaatcgttattatcagacacaactaaaagaaggaaaaaatcttgcggtgatagacgagacagagggtatggccaatacgaggccgcgggccgttgtgatatcaacgaatacaggaaaggacatttcggttgcgcattatcggaaacatgcgctgcgccggctgtcatcagtgctttataagtatccactgaacggaacagcagaacttctgaacatttcaatcggggaaaagaatccgtctcccggaaccgtattacaggcacaggtgcccgaccagaaacggaaaatcaagctcgataaagaaaagccggtcattgaggatttgactgaccgcaagcctgtccgccctgctgaaagcattgagctgcgggctgacatacgggaccgaagcctagtgaaaacagtggccttttactaccggacggatgagaacaaaccgtttaagcgaattcttgctgaaaaagaccgcaacgataatctcttccattatattgtgtattcgcctgaattgatcgggaaggatcagctagagtattatgtggcggccggggacgggatcaatgaagcgagaacgccggtcaaaatgattgatattaaacaaacaagcaaggcgcacggtctgcggatgaatattgaaaacagagacacgctgtcgggaactcaatttctcaaagccacgacagaagggcgagctgacagcattaagctatggattgacgggaaaaaacaagtgacagagcccgcgatggaaaaagaagtatattttgcattcgatacgaggaaaacgaacctttattttaaaaacgcggtaacgatggaaggcaaagtgctgaaggtgttcgatgatacaacaaataaataccgcacctattctgttccattgccagagacactgcttcggaaagggaagcagctgcagcgtattacgatacgttcaggttcgaaggtgtctccgtttgatacggctgaaaaccgtgatgacttcttagtcaaaaacgcccgattggtgttatcggatggaacggtgatcagagatcagagggtgtctcctgagaaggaactctttattggcgataatcagcgctcgaataaaagctggcaatttcagttcaatctgcctgacggactatttacatcacagctgctggagtgggatacatcaaagctttctgaaggcgctcaccatattcaagcaagcgacgggaaggaaaatgtcagcctggttgtacgggtagataattcaggacctcacattgagccgaatatcaccgaggggcaaacgtataaaggaaaccttatcctgcaggcggatatgtatgataaatggagcagaattgaggaagcggaggcgtcgttagatggagaaagcattacactcccatatcatacgtcatcttctgaccttttgccgggaaaacattctctaaaagtgacagcaacggatctcgcgggcaataaaacagtgattgagaggatatttaaaaccgaacgagagcatccggaccagccggaggttatagacagcgaagccgacacgcataaggccaagctttctgtacgggtgaaagatccgacgaatgatgccatggatgttggtttttataggggatttcaatatacagcgcgcaatcatgtgaaaatatttaagcacgcgtcactgactgaaccgccgaaaagctttgtgccggaaagggagaccccatttacgaataaagaattggagcgggtatcagctgctgatggaaaaacagtatcgacagaaaacaaagagcttttcccttatcatcgctttgaagtgacggttgatccatcaattgatgagaatgatctggcagaatcagtctggaagggcagttctttgccggggagaaaggtgacgatgtatgcttggaattatcggacaaacgaatggcagcctgttgacagcttcgtcgcgaaggatgacaaaccgtttacgctgaaagcgtctgtgattgccgccgattttgtacgggagtcgaaaatgaatgtgattgtacaggatgaaattcctcctgcgaaggatatgtacacatttgtctggatgtctgatacacagtattacgccgaaagctatccgcatatttttgataaacagaccgaatggataaaagataatcaaaagcagctcaatatcaaatatgtgttccacacgggtgatattgtagatgattccgccgatatcagacagtggaaaaacgctgatcggtcaatgtccgttctggataagagcggaattccttacggcgtgctggccggcaatcacgatgtcggacataaggacggctcctacagggcgtttggcaaatattttggcagcgatcgttttgataaaaaatttcattatggcggttcctataaaaataaccgcggacattatgacctgatttctagcaacggcaatgattatatcatgctgtacatgggatggggcattacggatgaagacatcgcgtggatgaatcaggtgctgaagaagcatcctgaccggatggccattttagcttttcatgagtatttgctggtcagcggaaacagaagcccaatcggagagaaaatattcaaagaaatcgtaaagccgaacccgaatgtcgtgatggtgttgagcgggcattatcatagtgcgatgagaaaaacagatgagctggatgatgatggtgatgggaaaccggatcgtcttgtgcatcaaatgctggccgattatcagggcgggccagaaggcggccaagggtatttgcgtttgcttcaatttgaccaagccaatgacatggtgcacgtatcgacgtactctccgtatgtaaaggataagaactactatgatacggatacctatggcaacaaggatgaattttccctttcgcttgatttgaagccaagaatcaaaaaggtggaaaccgattattttgaatgtaacgtatataccaatgaagagctcggaaaacgggagcaagtgaagagcggggacacagctgaattccgctgggatcatcttgaaccgcagtctgtttattattggtacattatagtggaagacagttttaacggcaaaacgaaatcaccgatctggaagttcaagacgaaaaaagaaacatatcgtccggcaccagaccagtttgattttcgccatgtctccaatccttaaaaagggttggaggctttttttatgaaagacgatccatatagtggacaaatgtataacggtcgcctctgtatacggattttgcatgctcaaaagcagttccgttctgcagatatgttgttcgtttaattaataggacaggcgctcccttttgaataccaagaatattcgcttcttccgtggtggcagcgcttggctcaagctcctgttttgcacgggaaatcggtatgctgttgtacctttcaatatgatcatagatcgacgactgaaaatgcgattcgttcaattcacccgcaagctcaaacggaatatgtgaggactcaatcgccatcggaatatcatttgccagccgcacccgagtgattttatggatagaggaggggtgcccgcagcctaatatagccgcgagctcctcagttgaatcaataagctgataatcaatgagcctgctgcccggtgtcatcccgcggcttttcatatcctcggtaaagcttgtcagcccttgaagtgcttgttccatttttggcttgctgacaaaggtgccccgccctttcaggcgatagagcaagccttcattaactaaattagaaagcgcctggcgaactgtcatccggctgatcccgaattgttcggcatattcgcgctcagaaggaagaggcatatccggctgcagctctccgttcttaatttgggtttttaattgctccataatctgatagtaaatcggaataggcgattgtttattgatattcataagtcagcatgttcctttcaaggtcttaatgacgcggcttcacgatcaatcaaaaccgtaacatcggaatgcaggtgcaaagcagatgcgggaaaatcttcgcttatgtttccttctaacagcttacgaacagcttccgctttgctttttccagaaataagcagcagaatgcgcttgcttgagagtatcgtttgaattcccattgtcagtgcttttttcggcacgctgtctatggagggaaaatatctggcattcgcttggcgggtttgctcatttaatgtcacaacatgagttcgcgacttgaaagacgttcccggttcgttaaagccgatgtgtccgtttcggccgatgccgagaagctgaatgtcagtgtcgccgagggaatcgactagctgttcataccgtctgcattcggcctccaaatcgtctgcatttccattcggaataaaatgccggctaggcttgctgtcgatatgctgaaaaaaacggtcgttcatatagaagtgatagctgttcgggtcatcgcttgaaagtccggcgtactcatccaaattaactgtagtgatgttttgaaatgagagattctcagtttggtgcaggcggatcagctggcgatacgtgccttccggtgtgccgcccgtcgctaaaccgagaacagcatcaggtttttctttgattgtatctgccgttattctggctgctatttggcttagctcttcatacgtttgacattccattactttcatatctggtcagcctccttggatataaatgcaatgtttccgcggcaaatggtgagaatcacctcgcaatcactgctgacaatcaccaaatctgcatcttttcccacagtcacactgccttttcggtcaaagatgcccagctgtttggccgcgttttcagaagttatattagctatatccgtccaagagcaatttgtaaactcacgcatatgccgtgcgccttcgttcattttgaggatcgaaccggcaagggttccgtctgaaagaagtgctgttcgtcctcttaccgtcacactttggccgccgaactcatatacgccgtctttcagtccttttgccctcatggaatcggtaattaaaatgagcttgctgctgcctttcgccaaaaaagcaagctttgcagctaaaggatgggagtgaatgccatcggcgataagctctgtcacaaacccatcatgggccagcgccgttccgatcactccgggctctcggtgatgaaacgggctcatcgcgttgtacagatgagtcatatggctcgcccctgcttttgcggcatccgacagcaatgcggaatcggcatccgtgtgccccatggatgcgataatcgattcgtctttcaaatggcggatcagttcaaaatgctgatcctcctccggcgcaagtgtaacaattttgatcagtccgcccgcctcctgctgccactttttgaaaagctcaacatccgaaggcctaatccactcctttggctgcgctccggctcttttaggcgaaacaaaggggccctctaaatgaatgccgagcagttctgcacctaataaagaggactcttcagccgctttccactctcttgcgttcaccaaagcttgagaaatgttcccatgctcttgggtaatcgttgtggctaaaaagctcgtcgtgccttcttcgggcagtcttgacgacatgatgtcgagcgtggaaaagctagcatccattgtatctgcgccatagccgccgtggatatgaatgtcaatcatgccgggaagcaaaacggaatccgcaggtgcttgaatctcttttgaatatggctccttgggccgttctgttgaaactgtgctgatttttccgtcattgattccgacatagccgtttttgattacttcattttctgtcacgatcgcaatgtctttgataagaagactctctgccatagatgatccgcctttctggaatttgaatacctttattttactctttttcagactagtgatctagaccagctgaggtgttttccccccttttataaaatctgttttaggttcaagcccgaaagtgataaaatgaaagtattgtgagcaagctcggggcagcccggaacaggaggaacatatcgtggcaaaggttcgcacaaaagacgtaatggaacagttcaatttggaattaatcagcggagaagaaggaattaaccgcccgattacaatgagtgacctatcaagaccaggtattgaaattgccggatattttacatattacccgagggagcgcgtgcagcttctcggaaaaacagagctttctttctttgaacagcttcctgaagaggagaaaaagcagcgaatggattctctgtgcactgatgtaacaccagctattattctttctagagatatgcccatcccgcaggagctgattgacgcctccgagaaaaatggggtgcctgtcctcagatcgccgctgaaaacgacaagactgtcaagccgtttaaccaacttccttgagagcaggctggcgcctaccacagcaattcatggcgttcttgtcgatatatatggtgtcggcgtgctgatcacaggaaaaagcggcgtcggaaaaagcgaaacagcgctagagcttgtgaaaagagggcatcgccttgttgccgatgattgcgttgaaatacggcaggaggatcaggatactcttgtgggaaacgctccggaattaattgagcaccttcttgagatcaggggccttggcattatcaatgtgatgacgctatttggcgctggcgcggtcagaagcaataaacgaatcacgattgtcatgaatcttgaactctgggagcagggcaagcaatacgaccggctcggacttgaggaagagaccatgaaaatcattgatacagaaattacaaaactgacgattcccgtccgcccaggccgaaatcttgcagtcatcatcgaagtggcagcaatgaacttcagattgaagcggatggggctgaatgccgctgaacaatttaccaacaagctggcggacgtcattgaagacggtgaacaagaagaataggagttggcgttaaatgaatgaagcgatagaaccactcaatccgatagcatttcagctggggccgttagccgtccactggtacggaatcattatcggtctcggcgctttgctcgggctgtggatagcgatgagggaaagtgaaaaacgggggctgcagaaagatacgtttattgatcttgtcctgtttgccattccaattgcgattatttgcgcacgaatttattatgttgcctttgaatgggactattatgcggcacatccgggagaaatcattaagatttggaagggcggcattgccattcatggcggattaatcggcgccattttaacgggttatgtgttttcgagagtgaaaaacctttcgttctggaagcttgcggatattgccgcgcccagcattttgctcggccaggcgatcggccgctgggggaacttcatgaatcaggaagcgcacggcgaggctgtcagcagagcctttttagaaaacctgcacctgcctgaatttatcatcaatcaaatgtatatcaatgggcaatattatcatcctacttttttatatgaatcactatggagctttgtcggcgtcattgttttactgctgctgcgcagagcgaatttgcgtagaggcgagatgttcttgatctatatcatttggtattcaatcggaagatactttattgaaggaatgcggactgacagcttaatgctgactgattcacttcgcatcgctcaggtgatttcaatcgtattgattgttttggctgtggcagccatcatcttcagacgcgtcaagggatactcgaaggagcggtacgcggagtagacgtcaacaaagggggatgagggatgaagaagatctttctggccggtcttgcagcaggttttcaaacaacatggacgctgggtaaagtgattttcccggtaacgctattggtcactttgctccagcatacccctgtcatggattggcttgtacggctgatcacaccggtaatgggtctcttcgggctttctggtgaagcggccattccgcttgtactgggaaatatgctgaatctgtatgcgggaattgccgggattttaacattggatttatctgtgaaagaagtctttattttagctgttatgctttctttctgtcataacttgattatcgaatcgacagttgccgcaaaggttggtatcagaattggcgtcatattggccgtgcgcatcggtttggccgctgtgtcagccatcgtcatcaacctcatttggcatggcggaaaggaaacggcgcagtacggttttatcgctgcgaagagcgcggcgccagacagctggctaggaatgttggcagaagcattaacgaaagccggacttggtgttttgcagctggcggcaatagtgatcccgctgatgattatcatccagtttttaagagatttaggctggctttatcggttttccaggtggctgtcgccgtttacgcagctgcttggcatgaataaaaatacgtctatgacgatggtgacgggactgacgattggtctggcctacggagcgggtgtcatgatcaaagctgtcgaggatgacggcgtgagcaagcgggacatgacattggcatttatatttctcgttgcctgccacgcggtcgtggaagatacacttgtctttattccgcttggcataccggtctggccgcttcttttgattcgtgtcaccacagcagttctgctgacaatggctattgcgcacacgtggaaaaaatggaaaccctcagcggttggaaaggaagcaatatgagtgacaaacaagtaacgacgattctgtttgatttagacggaacgcttattaatacgaatgaattaattatcgcgtcctttttgcatacactggagcattattatccgagcaagtataaacgagaagatgtccttgcatttatcgggccgtctctttttgatacgttctcttcgatggaccctgataaatgcgaggatatgatcgctatgtacagagcgtacaatcatgacatgcatgattcactcgtcactgaatatgaaacggtatatgagaccctggatgcattaaaaaaagccggctttacattaggaattgtgacaacaaaattaagagatactgtcaatatgggcctcaagctcacgggaatcggcgaattctttgaaacagttgtcacccttgatgatgtgacgaatgcaaagcctgatcccgagcctgtgctgttagcgctgaaacagctaggaagcgagccggcggaagccattatggtcggtgataattaccatgatgtgctggcagggaaaaacgccggtacaaaaacggcaggagtcgcatggacgattaaagggccggaaatgctggcgaagcatgagccggattttatgcttgagaaaatgagtgatctattacaaatcgttggagtgaagtaatctgtgagaaaaacagatcgtcatccggtctcgggggccaactcactgtggcatgtctatcaaacggtaccttttttaaaggtcgtcaaaaatttcattgtcattcaaattgcgagatatacgccgtttatagggatgaaaaactggctgtaccgcacatttctgcggatgaaggttggaaaacagacatcctttgccctcatggtgatgccagatatcatgtttccggaaaagatctcagtcggaacaaatacaatcatcgggtacaatacgaccattctggcccatgagtatttgattcacgaataccggatcggcaaagttctgatcggggacgaagtgatgattggtgccaacacgaccattctgcccggggtgaaaataggagatggcgcagttgtgtccgccggaacgcttgtccataaggatgtgcctgacggggcatttgtcggcggaaatccgatgaggatcatctatacgaaggaagaaatgcaagaaagattgaaaaagtccgctgaataacatcagcggactttttttgttaaaattgagtgttgttgttttcgtaaatatgctgaacaccaatccatttttgaccgacattagagtagcgtgtatttgtcattctgaccgtgcttgttttgctgtccgtccggaatatcgcttccttcatgtttgtgatggtgcacttgtcgatgatcacatcaacgtggaaggttgaaccaccaagctgtctaatgaacttcccgccattatccgccgtgaaatttttcactgtgaaggtactggctttattgatttggaatatcttatctgacgctttttgagcagaaccgccgtcgatcgtcacttttccttccttcttcaccgttaacgcatcctcaccaacatcttcccatttcacattctgaatgttaacgtttccataagtgtgcacgccatcagctgcaggtgcaccaagcaccacatttttcagggttgctccatcctccacacgaaaaacagggtcttggttttctgactggcttccgtcacctaattctttccctgccacaaaccgctgtcctttcccgtcatatgttgtattttttggtacgataattgtttcgtgcaccactttgtcagctgcaaaaacggttgatggctgaaactggctgaaacccataaccaaaccgaacataaataggatagacacgatttttttcaatgataaatcctccccggatatctttcattttttgcaagagaagcgtcagcgacttgcaccggcttctctcgcatagatcggggcaaggctgaatctgctttaatcataaaaacagacagcctgaaagtaaagacaattttgggtgaaaaatggaaaatgaatcgatcttaccgattgatacaaaaagcatgaatattgtcgtatttgctcagaatagagcatagtgaggcttcaggtgtttacttttgaataaccacggcctggctgcccatttgtttccacgctttttcaaagcttgttctatcggtttttctgtttttatagccatacggatcattgagatacacatatttatcatcatatcccgtaacggcgacgctgtgttcgctgtacgtaatttctatcgttccgtttggcgttttccatgtctgcatgttgtcaactggcgtaaagttggctgtcgtaataacccaaactggattgcctttttcaagctgctgataaacagcggaaatactttttccagtcagatcagacactttgtctcccgcataggttttcgccagctgatagatcggtcgatggtagacaccgagaccagggccattcgccatatccccgacaaatccgtcattcggatcaccctttaatccgctgctgtatgtcaaaggcactgtggcaacctgatttgccagggtattttttgtcacgtcgtatcccgcataattcagcaccatcgcaaggcttgttacttcacagccgttatagagccggggtgcgtccatttgattgtaaaggatgacatccagcggttttgcgcttcccttcagctcctttttgctattcgcagctgagtctgtatcgctatcagaaaccacttttttaaggctgttcaaaaaaggaatatctatatcttttgcatctattttaagtccgaaaaaaataacgcctgaaagaatcatcaggacacatagagttcgcagtgttttcatctttatctccttgttctctatttgatttgtattatagcatgccaaacataaagaatttgagatattacgtacctttaatacattattcatgattttttcataatgaggagaaggatatttgaactaaaaatatccttactgaagttaagcgttgattttcattctttcatctgctaacatattatcatattagcgaactaaaggattcggaattttccttcataagataacagcggaggtgctcgggttgatgtttatgtttgaaaaaccgcacggcatgagagatacactgcccggtttatacgaaacgaaaaaaaggtgagacgatcgttaaccgatttgattgataaatggggatatcaatttatggaaacgccgacactggagttttacgataccgttggcgtccagtcagcaattgaagagcagcagctgtttaagctacttgatcaggacggcaagacattggtgcttcgcccggatatgacggggccgattgcaagggtggcggcatcgaagcttctgaaacacggtcatccgctaagagtcggctatgcggcaaatgtattcagggctcaggagcgtgaaggcggacgtccggctgagttcgagcaggtcggagtggagttaatcggtgacggcacgacgagcgcggatgcggaggtcattgctttagtcgtcggggcattaaaaaacgctgggctggcatcctttaaaattgcaattggccatgccggcattgcggatgctttgtttgttgaggtgctcggaaacgttgaacgagctgatgtgctgcggaggttcttatatgaaaagaactacgtcggctacagagagcatgtcaagtctctcccgctttcctccattgataaaagcaggctgcttgagctccttgaactgcggggcggtatagaagtatgcggacgtgccgaggaaatcgtcgattctgcgcaaggaaaaagcgtggttgatgagctgaaggcgctgtgggacattcttgaggattacggatgtacggaaaatgtccgcctggatctgaatatggtcagccacatgagctattacacagggattttatttgaagtgtacgccgagaatgtcggttttgtcattggaagcggcggccgttacaacaagctgctgggccattttgattcacctgcaccggcaacaggcttcgggcttcggatcgaccggctgattgaagcccttcatatgaaggacgaaccttgtgaaatagacgctgttattttcagcaaagagcagcgggcgcaagccatcgcttatgcgaatgaagaacgcatgaaagggaacaaagtggttcttcaagatttatcgggaatagaaaatatcgaccagatgacaaaatcttttgcaaacgtcacttattttatcggtgccagaaaggaagagcaaaatgggtaagttactcacaatggcgatgccaaagggccggatatttgaagaagcggcagggctgctgaggcaggcaggctacaggctccctgaggagtttgaagattcgagaaaactgatcatcgatgtgccggaggaaaatcttcggtttatattagcgaagccgatggacgtaaccacgtatgtggagcatggcgtggcagacgtcggaattgcgggcaaggatgtcatgctggaggaggaacgcgatgtgtatgaggtactggatttaaacatcagcaaatgccacttagctgtcgccggacttccgaatacagactggagcggagtagcgccaagaatcgcgacaaagtatccgaatgtggcttccagttatttcagagagcagggagaacaagtcgagattattaagctcaacggttcaattgaactggctccgctcattgggcttgcagatcggatagtggacattgtttccacaggacagacgctgaaagaaaatgggcttgttgaaacggagcacatttgtgacattacctctcgctttattgtcaacccggtaagctatcgcatgaaagacgatgtgattgacgaaatggcatcccgcctatctctcgttgtggaaggagagacggcaaaatgaagatcaaaaccatcagcggagcggaacggctttctctcaagcgttccatcgatgccggaacggaagagcaaagaaagacggtccggtccattattgaagatgttaaagcaaacggtgatcaggcggttcgcagctacacggcgaaatttgactgcatcgaaatagacagcccgctggtcacaaaagaagaatttgaggaggcatacacctcactggattcacgtcttcttcaggtgattaggcaggcaatcgaaaatattagggaatatcacgaaagacagctgcaatcctcctggttttatcacagaaaggacggcacaatgctggggcagaaagtgacggcgctggattccgccggtgtatatgtgccggggggaacggccgcatatccttcatctgttttgatgaatgtgattccggcgctcgtagcgggcgttgaaagaatcgttctcgtcacgcctccgggaaaagacggtctgctgtctcctggagttttggttgctgcagccgagctgggcataaaagacatttacaaaatgggcggcgctcaggcgattgcggcgttagcatacggaacagaaaccattgagccggtggataaaatcacgggtccgggcaacatttatgtcgcgcttgccaaacgagaagtgttcggcgatgtcgatatcgatatgattgccggaccgagtgaaatcgtcgtgctggctgatgaaacagcgattccgagcgaaattgcagccgatctgctgtcacaggcggaacacgataagcttagctcatgtgtgtttgtcacagattccatggcgctggccgagacggtttcagccgaggtgaataagcagctggaaaccttgccgcgaagagaaatagcggaagcttcagtgagagattacggttgtatatatgtggcggaaacaatggtagaagcgattgagactgtcaatacactcgcgccagagcatttagaaatcataacacagtctccggaagctttgcttggcagtatcaaacatgcgggtgcaattttcttaggcagatacagccctgagcctgtcggtgattattttgccggaccgaaccatgtgcttccgacaaacggaacagccagattttcaagtccattaaacgtaactgattttcaaaagaaatcgagcattatttcttacagtcaatcagcctttgaagaacatgccgaaagcatcgcggcttttgccagactggaagggttagaagcccatgccagatcaattgaagcgagagaacggaggatttctaaatgagaaaagcggaacgcgtcaggaaaacaaacgaaacagatattgagctggcatttacaatagacggcggaggacaagcggatattaaaacagatgtgccgtttatgacacatatgttggatttattcacgaaacacggccaatttgatctttccattaacgcaaaaggcgatgttgatatagatgatcaccacacgactgaagatatcggcatctgcttagggcaggcgctgctcgaagcgttgggcgataaaaaaggaatcaaacgctacggatcggcgtttgtgccgatggatgaggcacttgctcaagttgtgattgatttaagcaaccggccgcacttagaaatgcgcgctgatttcccggctgctaaagtcggaactttcgatacggagcttgtacatgaatttttgtggaagctggcgctcgaagctcgaatgaacctgcacgtcatcgttcattatggaacaaatacccaccacatgattgaagccgtttttaaagcactgggacgtgcgcttgatgaagcgacaacgatcgatccgcgagttaaaggaataccgtcaacgaaagggatgctgtaaatgatcggcgtgatagattacggaatggggaatttatacagtgtctcaaaggcgcttgaacgtgtcggcgtgccgtattttgtttctgaaaagccggaggagctgaaagaagctgatgctttcattttgccgggagtcggttcatttggagacgcgatggacaatttgggctacacgaagcttgatcaattgattcacgatatggtctcagagggaaggctgcttctcgggatctgcctcggcatgcagcttttatttgaagaaagcgaagaaaacggcaccgcttcaggactcgggctgttaaaaggaaaagcagtcaggctgaaagcagaagatgaaaaaggaaacaagctgaaggttccgcatatgggctggaatcgtctttcttttcataatgaatctccgctgctgactaaaacagaacaaggctacgcttacttcgttcattcctattacattgacgggatggaggagaacgcgcttctggcaagcgccgattatggtgtacgagtgcctgctgtagtcggaaaaagaaacgtcttcggcgcccaatttcatccggaaaaaagcagcacggtcggaatgtctattttaacccaatttacgaaaatggcagcagaacagaaggtgaaaaaatgagtgcttttacattatatccggcaattgatatgagaaacggcaaatgtgttcgccttgttcaaggggattataataaggaaacgatatatggcgattcaccgtacgacatggctgagttatttgagaaagagggtgccgaatggatccatctcgttgatctcgacggggccaaagaagggaaaagagtgaatgaccgccatgtgattgagattgcgcaaaagctgaacctgaaagtcgaaatcggcggtgggatccgttctgaaaatgacgtctatgaatatttatcagcaggagtcgagcgggtgatcctgggaagctcagcagtttctaaccctccgtttgtcaaaaaaatgctgaaacaatatggcgagaaaattgcaatcggactggatgcgagaaacggttttgtttcaacagagggatggcttgaaacatcaacccttaaggcaactgaactgggcaaagagctagccaatgaaggtgcggaagtctttatttttactgacatcgcgacagatggaatgctgtcaggccccaatgttaaaagcacggtcgagcttgctaaggaaacggggaaatcggtgatcgcttccggcggagtcagctccgtcgcggatctcgaagctctcgcccgcaatgaggcggacggcgtctctggagcgatcatcggaaaagcgctgtataccaatcagtttacgctgagtgaggcgcttgaaagggtgaagcgcaaatgatcacaaaacggattatcccatgccttgatgtcaaagaaggacgcgttgtcaaaggaattcaatttctcgaattgaaggatgccggtgacccagttgaactcgccgaagtgtacgaccgggaaggtgcggatgaacttgtttttcttgatatctccgcctcgcacgaaggacgaaagacgatggttgacgttgtggagcaggttgccgcgaagcttgccattccgtttacagtcggcggcggcatcaatcagctcagcgatatgaaaacgatactgcgtgccggagcggacaaagtgtcggtgaacacggcagctgttctccgccctgagctgattacagaaggagccgagtttttcggttctcaatgcatcgtacttgccattgatgccaagtatgacaaagaatctgacacatataaggtctacacgcacggcggcagaaagaaaacagattgggaggtcaccgcgtgggcaaaagaaggcgtcaaacgcggggcaggagaaatattgctgacaagcatggactccgacggtgagaaaaaaggtttcgaccacacgctgacaaagcttgtttccgaagctgtccccgtccctgttatcgcttcgggaggcgcgggaaacgcacagcatatgcttgaggcttttacaaaaggagaagccgacgccgcgctggccgcctcaatttttcattataaagaaacatcgattaaagaagtgaaatcatacttgaaagagtacggggtgaatgtgagatgaaacaggcagatgaactgcgttttaacgaggacggattaattcctgctatcgtgcaggatgcggcaagcaaagaagtgctgacacttgcgtatatgaacaaggaatcgtacgaaaaaacgctggaaacgaaggaaacatggttttacagccgctcacgccaagcgttatggcataaaggagaaacctcagggaacacgcaagccgtcaaaggtatccggtatgactgcgatcaagacgcgctgctcgtactcgtagaaccgtcaggcccggcatgccacactggcagctacagctgttttacaaaggaacaaacagaagaacaggccgcggaccgattcggcatcatgaacgaactggagcgggtgatcgcggaacgccaagcggaaatgcctgaaggagcttacaccacgtacctcttccgtgaaggcgtcgataagattttgaaaaaagtcggagaagaagcatccgaagtcatcatcgccgcgaaaaaccgggatcatgaggaactcaaatgggaagcggcagacctgctgtatcacctgcttgtcctgctcagagaacaatccctgccgctggatgatgtgcttgacgtattgaaaaaacgccattctgagattgaagagtaaagagccggatgatacggctctttttgttttgtgaaaaaagtaataggtatttagatttatattgggtgttatatatgattagttaataaaaggagatcaaaaccgagtctcatttcctatttatccaaattccgccatgatgtaacatgaaaaaggatgaaataatcatctcttaaccaggtcaatagaattatttttgatataaaaatagaatactattctcacaaaacccgtggaggttcgtaatgaaaaagatcatctttatttgcttcagcttattacttgccctgacaggaggatgcagtatgaatgacaatgataaaaacagcacaaatgacaataaaacagaagcggtaaaaccaaaagacatggatcccaaggatctgcctcaagtacctgcgtttcaggacgagaaaacgagagagtacatggtgtcaacaaaagaagaggaaccaggatattatttgctggaatctaagctgaaagggtttaggatgttgtttccggaggatggaaagtatctatcaagaagatcatcgttaaccgggaaaaacaaagaaagtattggatttaatagttatgataaagacaccaatgtaatgtttgatggccatgtaacatattacaaagaagaaagttttgcgaatgaacctaagacaatgctagatattgttagtggaaaaaatgattataaaggcgaatacaaaaaaagcagcaaaaagaaaacggatatttacactgccaagaaaaaagacatctttgacgatattgatagaaaatataattattcatacagttattttggatatgttaagtctacagaggaagataacctaggagtagaatacgcctttacccttggatgcaaaaatgaaaatcaaccatgctccttagatgaagaaaaggctaaaaataaagttgagaaattaattaattctatcacctttttaatagataaaaaggagaaataagatgggaaataaaaatgtatttgagaatgagaacgtaaagttaaggttaattgatttagaatatgactataaacaaaagtttgcctcaactattgcgagtgaagttaagaaagctaagaaggatttcgaagcagatatacgcagaatttataaagaggaaacccaccacgatcttcctgagaatatgaaaattgaaatttacacctccaatgaacttgtaaatcagaatacaagtatacaaagttcgaccagagaatcaggttacgatggaacggcaatccatataatagatgagaaaaaacatattgatcagcttcagattatttcagaaggtagtgccgataataaggattggtcatataacttttttggtctttttttaggaattgatcatagtcagtatgaggctacaaaggagtttactaacaaagcaaagaaagcagcaggtaactctgaggatttaaaaacattcgccttaggacattcacttgcaaataataaccaagttatggtgcaattgattgatggagaatatgatgaagtttatggggtaaatggagctcaagtcaatattgatcaattacttgaaactgatgaaagtttatatagatatgttattaggaaatttagttataaatatgaagatatagattccatcccgccagaaaagttaaaaaagaaatccaaaaatattatgaagacaaaggcgtaacaacaaacatcactcagcgcatctcaaaagatgacccgctgtatggagtcagcggcaaggccgattttattacattcggtgatgtgaagatggcagatacaaatacaagtgtaaaaggcatccgaaacattatggatggggttcctgacgaagatgtgaggtcaattcaaaaattccttcaaaaatataaggatgactatgaaaaagacggcttgaacggttttataaaggcagccagcgggatagacatagacctgattgaaaaagtgaaaaacacagacggcgctttaaagaaagtaagtgtcctatatgagcattttgatgatgttaagcaaatgtatggccgaataaaagaggaactgccgtcgtttttaggttttcttcataccttgttgagaaacagcggaccggtcgtagatcagttagctgaaaatggttatattgatgaaacgcaaaagaaagtcatcaaaaaagaattaacgaatattaatgcgagtatgcgaggcatagagtcacggtacgaacatttcatagaccatctaaaacatggccaatttatgcaagctttaaaagacgttggtgaaatagtggactatgtaaaatcaattctgtcctcattgaaaacactcgacacagaaacaaaagacgcactaaaacttatcgtcgacggccacagcatcgttcaaatgctcaacgccttgtcaaaggaaaaaggcttcagctataaaggctccgatatttattttacagggaagagtggctcgggagaaacgattcaagtcaatctctcatccgctgtcagaatctatcaaaacggtatgaaaatcgttgaagatatggaagatgcgatttctaagtaccagaaggtttacagtcaggaaatcgatgaagacttcatagacaaaaagcaggcgatcatcacggctattcatcatatggaagaaaacccttcgcattatgccttcgatcttcaattccggcttgcagctggtttcagccacacattcgataaattggagaaaatctcagttcatgaatcattccacacaggtgcgcttcctgcaaatgatggaattgttgctgaattaaaaaaacagacaacagaaaaaagagattttatcaaaaatatccgcgagagtattgaaaagctgtttgaaaaagaagaaatgatttctcagttatttgattttcagtcttaggaggaatatgaagagtgacttccttattttcagaaagtgaaacagaaattgtatcaacgacctatatgtttcttacccaagatgaaatgaaggggaaagcgggcaccctcaatcaaccgatcaacgactttctcagcctgacaaagaaatttgagtcttcattaaaagaggaaatcaaagggcaaaaagggttgattgtaaaaaaataaaaaagagcttgagtctaatagcgaaaaacgaaaagctgcccttcagatgataaaagaagaacataccgcaaaagttgatcggtacaaaatgataatagaagacctgcgacagcaggatgtaacattgacttacagaaaaaagaagccagtgaaagatgtctaacacaaaaatctcctattcaaacaatgagtgggagatttttattttgatcacggcaaaaatatactgaaaaagtctttctccattgatatgattgagaaagagtaaaaatcatccttttgctatgacttttcacctttctgaacgctgaaacaggaggaaaatatatgccaaccaagaaacaaaaatctaaaagtaaattgaaacccttttttgccttagtaagacggaccaatccttcttatggaaagctcgcctttgcgcttgccctcagtgtagtaaccacgctggtcagcctgctcattccattattaacgaagcagcttgtcgatggtttttctatgtcaaatctgtcaggcacgcaaatcggtttgatcgcgctggtgtttttcgttcaggcgggtttaagcgcttatgccacctatgcgcttaactataatggacaaaaaatcatttccgggctgcgggagttattatggaagaaattaattaagctgcctgtctcttatttcgatacaaatgcttccggagaaacagtcagccgtgtaacgaacgatacgatggtggtcaaagaattgattacaacccatatcagcggatttattacaggcatcatttctgtcattggatcattgacaatcttgtttattatgaactggaagctgacactgcttgtgttagtggtcgttccgctggccgctcttattttggtgccgattggacggaaaatgttctccatttcacgggaaacgcaagatgaaacggctcgttttacaggcctgcttaatcaaattctcccggaaatcagacttgttaaggcttcaaatgcggaggatgtcgaatatgggcgcgggaagatggggatttcctcattatttaagcttggcgttcgtgaagccaaggttcaatcgcttgtcggcccgcttatttcactcgtgttaatggcagcgcttgtcgcagtgatcggatatggcggcatgcaggtctcatcaggcgagctcacagccggagcgctcgtggcttttattttatatttgtttcaaattattatgccgatgggccagattacaacgtttttcacacagctgcaaaaatcaatcggtgcaacagaacgaatgattgagattttggcagaggaagaggaagatacagtgacaggaaaacaaattgaaaatgcacatctgcctatccagcttgatcgcgtgtcttttggatataagcctgatcagctgatcttaaaagaggtcagcgccgtcattgaagcagggaaagtgacagcgatcgtcggtccgagcggcgggggaaaaacgacgctgtttaagctgcttgaacgcttttattctccgactgcagggaccattcggctgggggacgagccggtcgatacttactcgcttgaatcgtggagggagcatatcgggtatgtatcacaggaaagcccgttaatgtccgggacaatcagagaaaatatttgctacgggttagaacgagatgtgacggatgctgagatcgaaaaagccgcggagatggcatatgcgctcaattttataaaggagctgccgaatcagtttgatacagaagtgggcgaacgcggcattatgctgtcaggcggacaaaggcaaagaatcgcgattgcgagagcgcttctccgtaacccaagcattcttatgctcgatgaagctacctcaagtctcgacagccaatctgaaaaatcagttcagcaggcgctggaggtgctgatggagggccgcacaacgattgttatcgctcaccgcctatctaccgttgtagatgcggaccagcttttgtttgttgaaaaaggggaaattaccggtcgtggaacacaccatgagttaatggcttcccatggcctttaccgggattttgctgaacagcagctgaaaatgaatgcggacttagaaaacaaagccgggtaaattttggtcgaatcagccaataaaaaagaggagggattttcccaatccttccttttgaactattgaggggcttacgatttatggtatactactgacggtaatattgtataaaacggagggtagttgtgggaaaacacacttctgaacataaaaatcacgcacaaattgtccagctgcttcaagatggacaatatttttttcataaaggcttgaaagcgtataaagagcgcaatctaaaacgggcaagcaaactgattcagcgcgcggttcatttggagccggaggattcagagatgctttcacagcttgcggtcatttattcggaaatgggccagtatcaagagtcgaacgatcttcttgactatatcatggcaaatctggaggccgaaatgccggagtgccattactttaaagcgaataactttgcccatctggggctcttccaggaagcttataaagaagcggccgcttattctgatgcggacccggatggtgaattcgccgaagaaaacgatagtctgcttgatttgctcgatttaggagacgacggcattgaggattcgttgtatgatcaggatgaactgctggtgaaacaggatcgggcaaagtcattgctggaaagcggccagcttgctgaagcggttgcggcgcttgaggaaatcacaactgaatatccggagctttggtcagcatacaacaatctcgcgcttgcctatttctattcaggaaacgttgtaaaagcgaagcaaaccgcttatgaagtgctttctcataatgaaggaaatcttcacgccttatgcaatcttctcgttttctactattatgaaagagaagacgaaaaagtggcggaattgagtgatcagctctccaatgtctatccgatgctattggagcagcgttataaattgggtgctactttggcgcttgtcggccgctacgagatcggatataaatggctcaaatcattatataaaaccggctttgagggtgacgacaccttcttttactggctttcctgctctgcttattttacgggacataccgactttgccgagacgatctggagaaaagtcgagtcgcaatatcccggcgaagaccgcccggcgccttggattgagcggagggaagctcttccttcatctgtggagcagcgactcgcagcctattatatcagcagcacaaagggagaaacagagcatcttgaagcggtgatacgctcaaagagaattaccgctccttttgaaactcattttgtaaagctgcttctgaatggagattctgcggctgctgacgtttcagaggatgcacttttcgcttatcaaacggtcaaactattagagcaagctgaaaaagaagagatgaaaacagaagtcatgagctgctgggtttttcatgtcatccagcaaattcgtgcagctgctccgttgaagaatgagaaaggctgggcagcagccatctgttatatttggaaagaagcccatggcaagcaagacacgaaaaaagacacagcggcccgattcggcatctctccggcaactttgacgaaatatatgaaatatattgatgatattctagaatagtaaattttaaagagttgatttatttaatcgactctttttttgttagatagattatattaagaaaataatatcgacagtttttttacacgcttaagaaaaatgacaaatgatgtgtgacttgacatctgtttgaaacataaatgtaataaaatttatcgctaatttgtcgaaacttgatggtataatgattctcgtacataaggaattagtgttttttacatatgatgtgaaataaacgctatacaaccagaataagagatgcacagaataattaaccataaacaaccatcattcctcgtagagtatgaggaacgaaacttgatgttcaaaatacgattccaaatgaggacaggttcacagtaaaagggaggatataaaaagtgagaaagagtttaattacacttggtttggcttccgtcatcgggacaagcagttttttgatcccatttacaagtaaaactgcatcggcggaaacattagatgaaaagaaacaaaaaatcgaaagcaagcaatctgaggttgcttccagcattgaagcgaaggaaaaagaattaaccgagcttcaggaaaatcaatcaaagattgaaaaagaactgaaagacattaacgataaggcgcttgatacaagcaacaagattgaagataaaaaagaagaaaacgataaaacaaaagaagaaatcaaaaaactgaaaaaagagattaaagaaactgaagcacgcatcgaaaaacgcaatgaaatcctgaaaaaacgcgttcgttctttacaggaaagcggcggatctcaaggatacatagatgttcttttaggatcaacaagctttggtgactttatctctcgtgcgactgcggtttcatctattgtggacgcagacaaagatttaatcaaacagcaagagcaggataaagcgaagctcgaagattctgaagcggatttgaatgacaagctgaaagaagttcaagctgccttggctaaattagaaacaatgcaaaaagaccttgataaacagcttaatgaaaaagacaagcttttcgacgaagcaaaagcaagccaaaagaaaacggctaaagcgatttctgaattaaaatcagaggcgtctgaacttgcaaatcaaaaagcaaatactgaagctgaacaagcacgcatcaaaaaagaacaagaagcagcggctgctttgatcaaaaagcaggaagaagcacaaaaagcatctgatgaaacacaaacagatgacagtcaaacggcgacaactgaatcatcaaaagcaagctcatctgatgattcttcagacaattcttcagacaattcttctaacggttcatcaaacagttcgtcaaacggctcatcttctaagaagagcagcggctcaaacagcaattcaggcggcactgttatcagcaactctggcggaattgaaggcgcgatcagcgttggttcaagcattgtaggacaatctccgtacaagtttggcggcggacgcactcagtctgatatcaacaaccgtatttttgactgctcatcattcgtacgctgggcatacgcttctgcaggtgttaaccttggacctgtaggcggaacaacaactgatacgttagttggcagaggacaagctgtcagcgcgtctgaaatgaaacgcggagaccttgtgttctttgacacttacaaaacaaatggacacgtaggaatctacttaggaaacggtactttcctaaacgacaatacatctcatggcgtatctgttgactctatgagcaatccttactggaaagcagcatttaaaggtgttgtaagacgtgttgttcaataataaatatgacaagggccttctataaacagaaggctctttctttattaacatatacccttttcgaatacatttaatcgtgttgagcaaaaaaatagcgtatcaccatgagattttataggatatgggtaaggaatacgtttgatggggattcttatcttataagaaagagcccaaacttgaaaagatggtttaaggagtgaatagtgtgtcagaagaaaaaatttatgacgtgattataatcggcgcgggccctgctgggatgacggccgctgtatacacatcaagagcgaatttatcgacattaatgattgaaagaggaattcctggcggacaaatggccaatacggaagatgtagaaaactatcctggattcgaaagtatccttgggcctgagctttctaacaaaatgtttgaacacgcgaaaaaattcggcgctgaatacgcttatggcgatattaaagaggtcattgacggcaaagagtacaaagtagtcaaagctggttcaaaggaatataaagcccgtgctgtcatcattgctgcaggtgcggaatataaaaaaatcggcgtgcctggcgaaaaagaattgggcggacgcggtgtatcttattgtgcagtatgtgacggcgctttctttaaaggcaaagaacttgtcgttgttggcggcggagattccgcggttgaagaaggcgtatatctgactcgtttcgcttcaaaagtaacgattgttcacagacgtgataaactccgtgctcaaagtattcttcaagcgagagcatttgataatgaaaaagttgacttcctatggaacaaaactgtgaaggaaattcatgaggaaaacggcaaagtcggtaacgtaacgcttgtcgatacggtaaccggtgaagaaagtgaattcaaaacagacggcgtattcatttacatcggcatgcttcctctgtctaaaccgtttgaaaacctgggcattacgaatgaagaaggctatatcgaaacaaacgaccgcatggaaactaaggttgaagggattttcgctgccggagacatccgcgaaaaatcactgcgccaaatcgtaacggctacaggagacggaagcattgcggcacaaagcgtacaacattatgtcgaagagctccaagaaacgctgaaaaccttaaaataaaaagggctgtcatacgagtttcacattacgttactgggttttaattccgctgtaacacatgtgtaatgcttttcggttatgattaataaagtaattgaccccctttttataatgaatacacttttttggcacggattctccagttatccgtgtcctttttttgtccataaataaaagagaattccagttacagcaaaatcatctgaattaaggaatgaatatgctgtaaaatagaagaaaagattgtcaatgtctcttcattgtgggaggcatcttgaagcggtataataaagagacgatgacaggacgaaggttaggtgacgtacttgcaaagagtgacaaattgtgtgcttcagacggatgacaaagttcttctgcttcaaaagccgagacgcggatggtgggtcgcgccgggaggcaagatggagagcggagaatcagtcagagactccgtcatcagagagtacagagaagagactggtatctatatcataaatcctcaattaaaaggcgtttttacctttattattaaagacggtgaccacattgtctccgagtggatgatgtttacgtttgtcgctgattcatatacaggacaaaatgtatcagaatcagaggaaggcaaactgcagtggcacgatgtcaatgacattcagaacctgcctatggcccctggagacggccatatccttgattttatgatgaagggacaagggctgctgcacggcacatttacgtatacaccggaatttgagctgctcagttatcgtttagacccgcagcacatcaaatagaaagacaagtcaggggggagaaagatgagtgttagtgaatcacatgatattcagcttgtcattataactggaatgtcgggagcggggaaaactgtcgcgatccaaagctttgaagatctcggctatttctgcgtcgataatcttccgccttcattgcttccgaagtttttagagctgatgaaggaatcaaattcgaaaatgagcaaagttgcgctcgtgatggatttgcgcggccgcgaattttttgaccggctgattgaagcgctggatgaaatggccgaaaatccgtggatcacaccgcgaattttattcctggacgcgaaggattccattctcgtcacaagatataaagaaacgagacgctcgcatccgctggcagcgactggcctgccgcttgaaggcatcgcgctagaacgagagctgcttgaggaattaaaaggccgctctcaaatcatttacgatacgtctgacatgaagccgcgtgatttgcgtgaaaaaatcgtgaagcactttgcgacaaaccaaggagagacatttaccgtaaatgtgatgtcatttggttttaaatacggtattccaattgatgcagatctcgtctttgatgtcagatttttgccgaatccgtactatatcgaaagcatgcggccgctgactggcaaggataaagaggtttcctcttacgtcatgaagtggaatgaaacgcaaaagttcaatgagaaattaattgatctgctgagctttatgcttccatcttacaaaagagaaggaaaaagccaggttgtcattgcgatcggctgcacagggggccagcaccgctctgtgacattagccgagaatttagctgattatttcaaaaaggattactatactcatgttactcaccgggacattgaaaagagaagccggaaataagatgggacaaaagccgaaaatcgcaatctttggcggcggtacaggtctttctgtattgcttcggggcctaaagcataaacccgttgacatcacggccattgtaacagttgccgatgatggggggagctctggccgtctgcggaatgaactgaaaattccgcctcccggagacatcagaaatgtgcttgccgctttatccgatgtggagccgcttgttgaagatctttttcagcaccgcttcaataaagggaatgacttaacaggccattctctcgggaatttgattttggcagcgatgacaaatataaccggtgatttttttcacgctgtcacagaaatgagcaaggtgctgaatgtaagaggaaaggttttgccggctgccaatgccagtgtcgttttgcatgctgagatggaagatggccgcgtggtctcaggcgagtcaacgatcccagaatacggacagcgcattaagcgtgtttttctcacgcctgaacagattgatccgctgccggaaacaatagacgtaatcagggaagcggatttgattattatcggcccgggaagcctctataccagcattcttcccaatttgctcgtcccaaaaatcggggaagaagtgataaaggcgccggcgaaaaaagtatacatttgcaacgtgatgactcagcccggcgaaacgctccattacaccgctgctgatcatgtgaaagcgctcaatcagcatatgggctgtggttttattgatacgatattagtgaacagtgaagacattcccgacgaaataaaacgtaagtacgaaatggaatcggcgcgtcctgttgattttgatatcgaagagctgaaagcgatggggcttgaagtcatcagagatcaaattgtaacgtataaaaatgacgtaatacgtcacgatacacataaagtggcctctcttcttgttgatttactgaaagaatgaagccttgaaatgaggtggctatatgtcatttgcatcagaaacaaaaaaagaattaacgaatctggaagtgaaggactgctgcattaatgccgagctgtctgcactcattcggatgaatggagctttatcatttacaaaccgccatctcgtactcgatgttcaaaccgaaaacgcggcgattgcccgccgcatctatacattgctgaaaaaacaatatgatgtgtcggtcgagctgctggtcagaaagaaaatgcggctgaaaaagaataacgtctatattgtgcgtttttcagaaaatgcaaaagcgatcttagaggatttaaaaatactcggggagaattttgtgtttgaacgaagtatttcgaaagagctggtcaaaaagagatgctgcaagcgttcttatatgagaggagcatttttggcaggaggttcggtcaataacccggaaacctcctcgtatcatttagaaatcttctctctttataaggagcataacgattcattatgtgacctgttaaatgagtttcagttaaacagcaaaacgcttgaacggaaaaaaggctatattacctatttaaaagaggctgaaaagattacagagtttctgaacgtaattggcgctcacaattcgcttctgcgatttgaggatgtcagaatcgttcgggacatgagaaattcggtcaaccgcctcgtcaattgtgaaacagccaacttaaacaaaacgatcggcgcatcgctgagacaggtggaaaatattaaatacatcgatgaaagaatcggcctggaggcgctgcctgaaaaacttcgggaaattgcgcagctgcggattgattatcaggaagtgacgctgaaagagctaggggaaatggtagcaagcgggaaaatcagcaaatcagggatcaatcacaggctgagaaaacttgacgaaatcgcagaacagctgcggacagggcaaaccgtcactttaaaataaccgtaaagaaaaggggagatcttatggttcaacagaaagtggaagttcgattaaagacaggactgcaagcacgtcctgctgctttgtttgtacaagaagcaaaccggtttacgtcagatgtgtttcttgagaaggatgggaaaaaagtaaacgccaaaagcatcatggggctgatgagccttgcggtaagcacaggcactgaggttaccttgattgcccagggagaagatgaacaagaggcgctggagaagctggctgcttacgttcaagaagaagtttaggtgataaaaatgagtgactttctaaaagactgctttcagaaaatcggctgggagaaagaccatgtcagcttcggcgatcttcccctttttcttaaagcaatggcataccgttttccattcgaaaaccgtgccgtacttgcaaaagagaattataagatcacaaaagaagagctatggcgacgtctgctcaaagatcagcacggcggcctatgctacgatctaaatggtttcctttattttgtcttgcgtgaggccgggtttcatgtgaagctcattcgaggaacggtttatgcaggcgatcaagagggatgggcactagaagggacgcatgctgctgtatggctgtctgcggaaaacggcgattacctcgttgatatcggcttcggcatcaacctggcgctccagccgataccgctttccggagaaacggtacagtcaccagtcgggtcattccgaatcaaaaaggaagagacagaaaagggcagctatgttctgctgatggacaaaggagaaggctggcaaattgggtacgcctttacccttgaagagagtgatctcggtgatttagataacatgaaggacatcattcactctcatgaaaaatctccttttaacaaatccctgcttgcctcaaagctgacgccgagcggaaggatggtcatgtcagagcgccattttacgatttatgaaaacggcggtaacattcaaaaaagcgacatcggcccttcaggatttgaagagaaattaaatactcattttttgtaacgtgaaaagcttgcaggttatctgcaagctttttcttatgaacaagtgtagattgctgtatcaaatgcgtcttctgggatatacagttttcccttttcgtatttataaggaatttcattctctttaaagcactctttggtatagtcagttagtgtatccccaatttctatgtatttcccggtatagttgggctgacatgctgaaagaattgacgtcattgccagaaacagcatgattttcttcatcacgacacctgcctattatgaaaattttacctttatcattctatcataacaaaaagaaaaagaccgatttactattccgcacatgctataataattttggaatcttctagaaaaatcatcgtgatgtacatataagggggatcaacgtgtatcggattttgcttgtggaagatgatgagcggattgcttctttgctgggcggtcatcttcaaaaatacggatatgaagtgaaaattgctgaacagctgaatgatataaaattggaatttgcagaaatgaagcctgatcttgtgctgcttgatatcaacctgcctttttttgacgggttttattggtgcaggcaaatccgtaccatttccaatgcgccgattatctttatatcggcacggaccgatgagctgaatcaggtaatggcgattgaaaatggcggcgatgattatatcacaaagccgttccatctagaggtagtgatggccaaaatcaaaagcgtcctgcgccgcacatatggtgaatattcgccctctttgccgcaggaatctagaatagtggagcttggcgggctgacgatttatcctgatcagaatgaggccgaatggaacagcgtccggattttgttttcccaaaaagaattccagcttctctcgatttttgtgagggagcataaaaaaattgtctctcgtgatgaactattggaggcgttatgggatgacgttgattttgtcgatgacaatacgttaacggtcaatgtcaatcggctgcggagaaaactggagaatgcaggactgacagattgcatttccacaatcagaggacaaggttatcaatttcaagtcaatcggaaggatgaagcggaatgttaaagacttatctcatcgaccgcttagccattattctattttcattattagggatagggtccgccatgctgattgcgtatttaagcattgtagagagcggcgcagaaccttccaaagaaaatatgatgtacatatggattttgcccggtactcttttagccgcaggttttgctgctgattatgttcggcaattttcctttctcacatatgttaaaaagcttgcagaacaagcctcttcttcgaatgacatcggacagtctttgaaagccagaaagccaagaacaggagagcaagcgctttggacgaagatgatcaacgcactcgggcagcaatacgaaagcaggctctcacaatatatcaatcagcaaaaacagcattacaccttcaccaaccaatgggtccaccatatgaaaacaccggtatctgtcatatccttaatgattcaggaaggaaaaaacggaacctcatcctcttttccgacgtttttagaggagctggaggatgagaatgagagatttcgccacggtcttgatatgatgctgcaaacggcccggctggaggaatttgcatttgatgtaaagccgcaaacctttgatttggcagaaatggttcgttcactgatcaatcaggaaaaacgtcagtttatcaagcggcgcctttttccaacattacatgtgccgccaaatgccgttcagatttccagtgatcaaaagtggctttcctttgttgttgagcaaatccttttcaacgccttaaaatattcaaagcaaggtgtgggagaccctattacaatccggattgaaacacagggacatgagacgcgcttgtcggttgccgacgaaggaatcggcataccgccgcaggatctgccgcggatttttgacgcgttttttaccggagaaaacggacgaaccatgaaagaggcaactggaatgggcctttatttagcaaaacaggtgtgcagccgtctcggccataagctgtatgcggaatcaaaagaaggggctggcactgtgatgaccatcgtgttttcaagtgacaccctcgtgaatgtgacagcattgtaagattggggagcggaattgcaagaaagttcgatgggaggatgctgacttcctttttataataaagaaaaaggaggagcagaacatgaacgtgttgcaaacaacgaacctatcgaaaacatactattcaaataaaggaacaatatcataccaagcgctcagcgcctttgatctcagtgtgtcaaaaggagaatttgtcgggattatggggccgtcgggaagcggaaaaaccacgcttttgaatttgctggctaccattgataagccgacccagggcgagatgatgatcaacggcattcagccgaaaacgttaaaggaccaagagctggctttgtttcgcagaagagaactcggcttcgtctttcaggattttaatctgcttgatacgctgacgattcgtgaaaatattctcttgccgctcgcattggataaggtaaagctgagagaaatggaagctcgattggatgaactggcggatacgctgcaaataaagcatattctcgatcaccgcacatatgaggtgtcgggcggacagcagcagcgggcagcttgtgccagagcgattattcacaatccggcgctcattcttgccgatgaaccgacaggaaacctcgactcaaaatcggcaaagcaagtgatgaacacactggctcagctgaatgaggaaaaggaagcgacgattttgttggttacgcatgatgccacagcagcaagtttctgtaaacggattgtttttattaaagacggacgtttcttttcagagattcacagaggaacaaacaggcaggtgttttatcaaagtatattggataccttgagtgtgttgggaggcgattttcatgaatttgagaactatcgcccgtaaaaacattcttgggaatctgcaacggtatgtggcctactttttaagctgtgtgtttgccgtttcggtgttttttgtcttcacatcatttatttttcatcctgatgtcaatgaagacaatatatatggaggaagccttgtcaaaacatgcttgagcgcagctcttgtcgtcatcattgtgttttgtatatttttcatcacatattccaattcagcgtttttgcaggcaagaaagaaagagtttgggctgctgacactgtttggcacatcaaagcagcagcttcgcaagatgatttattatgagcagtcacttatttctcttgcggcgattgcggccggcattggagcaggcctgttattttcaaaactgttttttatgatcatgacatggatgctcagcgtgaaggtgccgatttcgtttgccattgtgccgaaagcgtttgtgatgacaattgccggctttctcatcctgtttcagacgctgctcattttatcactgggacggattcggaagctggaaatcattgaactgattaaatcagccaaaaagccgaaaagtttgccagtttattcgaaatggctcactgtattgtctttgctatgtcttggcagcggttattatctatctgcaacagccaatgcaattgacatgatgtttcgggtttttccaattttgattttagtgttaattggcacgtatttcttttttacccaaagcagtgtggcatttttccgcatgctgtaccgaaagaaacacagcttctacaaaggcacaaatatcattgtgcgttccaacatgatattcaggctgaaggatcatgcacgcatgctgtttttaacctctgtcattacagcggtcatactaacagctacaggtgtcatctatatgttttattccgatttacaaaggcaggaggagcaaagcattcctcagtctgtttcctgggtggaaaaggatgcttcccgctttcaggtcatgaagcctgagacggctgagaatacattgaaaaaagctcatgctgttatcacgtataaggtggatgccacagggattcctgtcacttttcagtcagacttgccgtatggaaataagaagatggaagctgaagctttgctgatttcagaaaaagtctataatcaagtcgcaaaggaaaaagggttcccagttattcatttacaagaaaatgaagcatttattaatgtttcttttcaaatgatggtgaaagacacatttggagaaggggaaacagcagcatttcatatgaagtcaggaaaaaccctttcctatgtcatgaaaaagcagcaaaacaaagggatattgatgtctgtcgatggagtcagccgtttattggttgtcagcgaaaagagctttgacagtctgtcacaggatgtgccgctgaaggaacagatgagaatggtaggttatgagcttgagcattggcaggagacggtggatgtctctgaaaagcttgaaaacatggtgccgaaagaacatacatctgattttcaaacacgtgctcctagttatcaaattgtgaagcagggagttgcattaatgctgtttattggtctgtttgtcagcgtgctgttttttatcgtgcaaggaagcatgctgtatttgcggatgtttacggaaatagaagatacgggagtgcaggtgttagcgttaaagaggataggggttacggacaaagagattcactcgatccttggaaagcaaataggatttttattcttcatcccatttatcgcaggtacgattcacgcgggctttgcgtatgcagcgttaagtaatatgctgaattccaatttatttcttgaggccgtaattgtcatcttcatttattttgtattccaggctctttattatatcgtcacccgtcatatttataagcgtgctgttcttcagcgtatgtaatatgaaatccggtctgttatcagaccggatttttgatttattgaaattctcttgtaagatttttcggtgtttgcccttggatcgctgcgagcatattttcggcggcctgtttgcacatgttgaagcgcactttagctgttgctgaaccgatatgaggaagcagcgtgacattatccagctgcaggagcggattatcttgggtgacaggctctttttcgtatacatctaagccggctcccctgatccagccttcctgaagagcgcgaatcagtgctttttcatcaactgtctttccccgggaaatattgacgaaaattgctgaattcttcatcaacttaaattcgcgttctcctatcatgtgataggtttcatcagtcagcggcgtaatgagaagaataaaatcagattgctccagcaatgtatcaagctctgcatacttaacgccgatgctgtcttctgtttcttgtttgcgatgtcggttatgataaagcacttccatatcaaaaccaaatttggcgcgtctcgctgcttgttctccaattctgcccatgccgataatgcctaacgtttgatgatgaacatcaattccgaaaagcgcttcctcttccacggttccccattttcctgctctgacaaaacggtccagttcggcaacacgtctggcggaagacagaatcagtgaaaaagccagatctgcaactgtgtcatccagtgtataaggtgtatgagtcccgacgactcctctttctttcattgcttctatatcgaagttatcgtagcctactgattggttgctgaccactttgagcttaggcgcgtgttccagcaactcacgattgattgacggtccggacgtccctgatgttaaaagcccctccgcttcttttaatttttcaaatagcacgtcactcggaagcgtatcctcctgccatacttcataacggcaatgttcaccgatgaatgcttcaatctcttcaggaatcggttttgtgataaatacaaatggtttcaacaaggctccccctttatggctgttgtctaattcattatatcgaaaataaatagatgttaaaaatatagctgcgtttttttaatttctggttcttttgaacttaaaatgaagatcgaacagctaaatctgcttaaaaaagttttttaattatcagaattcacccatattttttgtcagacaaatcatcgatatacgaactgcagccggattataggatgcattaaatataaattttattatctttgaaagatataaatgtttatgttttgattctacagtccaattatagtgtctttttttgaaaaccttttcttggcttattcctatgctataattccttactgtaagctgggtaagaaggcttgcaaaatcatatggatgggagatgaatcaaatggtttctttaacatcaattttggaacacaatcagcggtttgtcagtgagaagaagtatgaaccgtacaaaacgacaaagtttccttcgaaaaagctcgtcattgtcacctgtatggatacaaggcttacagaacttcttccgcaagcaatggggcttaaaaacggtgatgctaaaattgtaaaaaacgcgggagccatcgtttctcacccatttggaagcgtgatgcgaagcatactggtcgcgatttatgaattgcaggctgaagaggtatgcattgtcggccatcatgaatgcggaatgtcagggctgaatgcgtcctcgattcttgagaaagcaaaggaacgcggggtggaggatagctgcctgaatttgctgacgagtgccggactcgatttgaaaacgtggctgactggttttcacagcgtggaagaaagcgtttcccacagtgtgaacatgattaagaaccatccgctgcttccgaaaaaagtgccggttcacgggcttgtcattcaccctgaaacaggaaaacttgatgtggtcattaacggttatgaaactgagcttataaacaatcactcataagggaggttataacaaaatatgcgattctcagggagattcaagggatacaatttgcagaaatttcagaaagacttgattgcaggtatcgtagtaggtgtcgtggcaattcctttaggaatggcgtttgccattgcctcgggagtcgagcctgaatatgggctatacactgttgttatagcagggatttgtatttctttgtttggaggatcaaaatatcagattggcggtccgacgggcgcctttgtcccgattttattcggcattatcatgcagtacggcttggaaaatctgctgattgcggggtttatggcaggagtgatgctggtactgtttgggctgtttaagctcggaaaaataatgaaattcgtgcccaaacccgttatcgtcggttttacagccggaattgccgtgctgatctttacggaacaaatcgctaattttctcggattgagaaatgttgaaaaacatgagaactttcatcacaacatgtttgaaattgtgcagcagctcggcacctttaacgtgtatgccattttgacagctgtgatcgggctcgtcattttgcttgtatccgccaaggtgatgcctaaagtgccgggcgctttgttggcgcttcttatttccacagtggtcgcggttgtctttttccctgaccgcatggcaacgatcgggtcaacttatggagaaatcccccgccatttgccggaatttcagtttcctgagcttactttggataaaatggttatgctgtttccggctgcgcttgtcatcgcgcttcttggaggacttgagtcgattttgtccgcaatggtcgctgataacatgaagggctcaaagcatgacagcaacaaggagcttgtcggccaggggattgcgaatatggcagcgcccctgtttggcggaatcccggctacaggagcgattgcgagaacggcgaccaatataaaaaacggagcggtttccccagtttccggcgtcgttcacggcgtagtcgttctccttgtcctgcttgtatttgcgccttatgcgtcccatgtgccgctcgccagtatggcaccgattctcatggtggtcgcatggaatatgagtgagcgcaaggaagtcgcaaacatgctgagactgaaaaatgctgattcctttattttggcggcgaccttcgcccttacggttctgtttgacttaatcatcggtgtggcaaccggattgctgcttgcattcgtgttctttatcagaagaatgagcgaagcgacccgcatccacaatcaggaaacgcatcctgttctggcgaagagagaagatccatctgtcagcatgtatgccatagaagggccgctgtttttcggatcaattgattcccttgaatcgtcattgctggagcatgtacagaaaaaaccgaaaacccttattctgctcatgaataaggtgcactatatggatacgtcagctgaagcggtgcttgggaacattatgaatcgaattaaacgccacaatggaaagctgatgattgtaggattgcaatcgcagccgaaggagctactgcataaaacaggcctttttcacaaaataggaaagcagcatttctttgatcaccatgatgaaatcacaggttaaaaaaagcggccatcgcggccgcttttttatgcatgctcaaatcgttttgtcagtttttcttggtgggccttcatgacgtcttctaaagagacaccatacatatcagcaagaatggcgatatttccgatgacatctcccatttcttcaatcaattcttgtttttgctcagcgcgtgacgattctttctcatccggccggtctctgccgatttcatacgccctgacagcccgggccagttctccggcttcctccattaaaaagccgacgcgaataaaaggtccgtattctgtccagcctcttttttcgtaaaactctttcatccatttttctgcatcagccagctgcaacctcatcactcctgcattctttatgtatttcatattgatattatcacatgaagatgggacaatatatagtgtgtttttgaatgtttaacacgatatatagatgcggagatgacaagatgaaaaccatttgtgtatttgcgggatcaaaccctgggggaaatgaagcgtataaaagaaaagcggcagagcttggcgtgtatatggctgagcagggaatcggccttgtctatgggggctcccgcgtaggcttgatgggcacgattgctgacgcgattatggaaaacggcggaactgcaatcggggtcatgccgagcggtttgttcagcggggaggttgtccatcagaatctgactgagctgattgaagtaaacgggatgcatgaacgaaaggctaaaatgagcgagctggcggacggctttatctcgatgccgggcggcttcggtacatatgaagaattatttgaagtgctgtgctgggcacagatcggcatccaccaaaagccaattggactgtacaatgtaaacggatattttgaaccaatgatgaaaatggtgaaatacagcattcaagaagggttttctaacgaatcgcacctaaaactgattcacagctcgtcacggccggatgagttaattgagcaaatgcaaaattattcttatccgattttagaaaaaaagtggacagaaatttaaaaaagagattttctgatggaagtggagagaatgagtctgccacctagcgtatgaatccatgaaaaatcgagtgtttttaacaaagtgaggtttccttaagggaaatctcttttttatttctctttggcctgcatcgtatatttagcagtaatagaggactttatcactagtttggataataagcacagataaggaggggatgaaaatggcaacattgtcagatgtggcgaaaaaagcaaatgtttcgaaaatgacggtatcacgagtgatcaatcaccctgagacggtgacggatgaattgaaaaagcttgttcattctgcgatgaaagagctgaattacatccctaattatgcggcgagagcgctcgtgcaaaacagaacacaggttgtgaaactattgatacttgaggaaatggatacgacagaaccatattacatgaacctgctgacaggaatcagcagggagctggatcgcaatcactatgctctccagcttgtgacaagaaattctcttaatattggccaatgtgacggcattattgccaccggcttgagaaagaacgattttgaaggtgtaataaaagcttttgagaagccgctcgtcgtatttggacaaaatgaaatgggctatgactttatcgatgtgaataacgagaaaggcacttttatggcaacccgccatgttatggggctgggggagcgggaagttgtcttttttggcattgatttagatgagcctttcgaacgtgcaagagaacaggggtatatacgggcgatgaataaaagctttaaaaaatcgaatatgtttcggatcgacaacagttctaagaaaagtgaatgccttgcaagagaactgctgaaatccatggacaatcaggccgcatttgtctgcgcatctgatcgaatcgcgctcggcgtcattcgtgcggcgcaatcccttggaaagcgaattccagaagacgttgcggttaccgggaatgacggtgtgtttcttgatcgcatctcctcgccgcgcttgactacggtcagacagcctgttgttgaaatgggggaagcctgtgcgaaaatgttgctgaaaaaaatgaatgaagacggcgctgcacaaggaagtctattttttgaaccagagttaattgtacgagaatcaacgctgtaagcgccttattctgttatcggtaacagggtgaaaaggattgttcccacaatttcatcatgatactttcaaactatgagccggcttcaataaaacggaaatcaaagggggaaacatgatggaatatgcagcgattcatcaccagccattcagcacagatgcttattcttatgatgggcggactgtgcatatcaagattcggacgaaaaaaggtgatgcagatcacattcgattcatttggggtgatccctatgagtacaacgacggcaaatggtcggcaaacgagcagccgatgaggaaaattgctgctacagaaatgcatgactattggtttgctgaagtggtgccgccatttaggcgtttacaatatgcgtttgttgtaacagacgatcatgaagacatctttttcggaagttcgggtgtatgcccttataacgaaaaaacactggaaacgattcattattactttaaatttccgtttgttcacgaggctgatacatttcaagcgcctgaatgggtcaagtcaacggtttggtatcaaatttttccggagcgttttgcaaatggaagagaagacttgtcaccgaagaatgcattgccgtgggggagcaaggacccggacgtcaatgatttttttggaggggatttacaaggaattgttgacaagcttgattatttagaggatttaggggtgaacggcatttatctgacaccgatcttttccgcgccttctaatcataaatacgacacgctggattacttttctattgatccgcatttcggggatcctgagctttttcgtacattggtcagccagctgcatcagcgggggatgagaattatgcttgatgcggtttttaaccatataggaagcgcgtctccgcaatggcaggatgtcgtcaaaaacggagatcaatcccgctataaggactggttccatattcactcttttcccgtcacagacgacaattatgacagatttgcttttacagctgatatgccgaagctaaacacggctaatcccgaggtgcagaaatatttgcttgatattgctttgtactggattcgcgaatttgacattgacggctggcgtttggatgtcgcaaatgaagtggatcacgttttttggaagacatttaggcaggctgtatctactgaaaagcctgatgtttatattttaggtgagatctggcattctgccgaaccctggcttagaggggatgaatttcatgcggcgatgaattacccttttacagagcctatgattgaatactttgctgaccagacgatctcagcttcacgtatggctcaccgtgtcaatgcacatttgatgaatggaatgaagcaggccaatgaggtgatgtttaatttactggatagccatgatacaaagcgccttttgaccagatgccgcaatgatgagaagaaagcacgcgcgttgctggcctttatgtttgcccagacaggctcaccatgcatttattacggaacggaaatcgggctgaacggcgaaaatgatccattatgccggaaatgtatggtttgggaaaaagagaagcaaaaccaagacatgctgcaatttatgaaacggttaattgctttacgcaagcaggaaaacactttattgactgaaggacatcttgagtggaatctgctggacgacaaaaatgatttcattagcttttcgcggactcttgatgaaaaaatactgatttatttctttaatcaagggaatgtggttcaacacgtcagtttacgagagttgaatattgataggaataagaaaatctgtgatgcatggacagagcagccgctacagcatcacgatgtcattgccgttcagccgggagaatttttgattttgagtgctgccgcccctgtataacattctgttatcggtaacaaatcgaaagttgttgtaaccgctttctataggacaatacaattgttatagtttcgtaaatagaaggaggaaaagagatggttcttttaaaaaaaggggttcgccatattggcggcatcattcctggcaatcggccttgccgcctgctcaagttcaaaaaatccagcaagctctgatggcaaaaaggtgctgactgtgtctgtcgaagaaacgtataaagaatacattgaaagcataaaaacaaagttcgaaaaagaaaatgatgtcacagtaaaaattgttgaaaagcaaatgttcgaacagttagaagcgcttcctcttgatggcccggcgggtaatgcgcctgatgttatgcttgctgcatatgaccggatcggcggtttgggacaacaaggacatttacttgatattaagccatctaacacaaaaagctttggtgataaagaaatgcagcaggtgacagttgacggcaaagtgtacggaatgccgctagtcattgagacacttattttgtattacaacaaagatcttttaaaaacagcgccaaaaacatttaaagaccttgaaaagttaacggaagatcctcgattcgcgtttgcttcggaaaaaggaaaatcaaccggatttttagcaaaatggactgacttttatatgtcgtacggcttattggctggatacggcggatatgtgtttggaaaaaacggcacagattccggggacatcggcctgaacaataaaggggctgtagaagcggtgaaatatgcggagaaatggtttgagacatattggccgaaaggaatgcaagacaattcaagcgcagacgactttattcagcagatgtttttagaaggcaaagcggctgcgatcattggcggtccttggtcagctgccaactataaagaggctaaattgaactacggagcggctcccattccgacattgccaaatggagaagaatacgccccttttgctggcgggaagggctgggttgcctcgaaatatacaaaagagcccgagctggctgaaaaatggcttgagtatgctgcaaatgatgccaatgcttacgctttttatgaggatacaaacgaagttccggccaacacggctgcaaggaagaaagccgatgagcaaaagaatgaactgacgtcagctgtgattaaacaatatgaaacagcaacgccgactccaaatattccggaaatggctgaagtatggacaggagcggaaagtttaatttttgatgcagcttcaggaaaaaaatcgacacaaacatcagcgaatgatgctgtaaacgtcataaaggaaaatattaaagaaaagtatgtgaaataaaacggcgggatagcgtccggaagaatagagggcggaaaaatgaataaacatcacacacttacaaagcaaaaacgaaaggcagggcttttatcgatcattccaggacttgggcagattgcgaatcagcagttgtcaaaggggctcttatttcttgccatcacaggcttgtttgcttttgaattatgcgttttcggtatacaggcgctaaccggattgatgacattgggaagtgttcccggtgaagatcactcgctgtttatgctgattgaaggcacgctgcaattgatcgtgacaatgattttcctcatgttctatatctttaatattcatgattcacgtaagaccgccgctatgaaagcggcgggtttggaagtcaatacaacagccaaggatatgatctgtcatgcgggcgataaaggttttccgtatctatttacactgccggcatatatcatgatggtgtttgtgattatttttccggttttggtgactctgtttgttgcattaacaaactatgatttttatcatattccgcctaatcgtctgattgactgggtcgggtttaaaaatttcttaaatatttttttccttggctcctatcgtgaaacatttgtgaatgtactgggctggacggttatctggacaatctgtgcaacaacgctgcaaatcattttaggtattgtgacggcacttttcgtcaatcaggattttataaaaggcaagcggatatttcgaatgattttcttatttccatgggctgttccggcgtttattacaatcatgagtttttccaacatgtttaacgacagcataggagcggtgaatgcacaggtgataccattattcaatcacctgccgtttgtcgagctgcctgcgatcgcgtggaagaccgatcctttctggacaaagacagccctcattatgattcaaacgtggctcggctttccatatatatatgtcatggtaacgggagtgcttcaggcgattccaggtgaattgtatgaagcggcaaagattgacggggccacttttattcagcgttttcggcatattacattcccgatgattttatttgccacagcacccgtgatgattactcagtatacgtttaatttcaataatttctcgatcatctatttatttaatgagggagggccaggcagtgcgggagccggggccggatcgaccgatatcttaatttcgtggatttataaactgacaacaggcacatcaccccaatattccgttgcggcggctgtgacactgttaatttctttcattgtcattggaatttcactgattgctttcaaaaaatcgaatgcttttggcaatgaggaggttatgtaggtgaacgcgagcactgccagaatgcttaataaaatctgtacgtatttatttttgacgcttttaagtattgtcattatatatccgttgctgattacggcatcatcagccttccgtgtggggaattcggcggcttttcagctcgatttttcgggttcttggacattggatcattttaagcggctatttgacgaaacgctttatctcaattggtacagcaatacacttgtcatcgcgctatcggtcatggttttgcaggttacgattgtgacacttgccgggtactcgtacagccgctatcggtttgcaggcagaaaaaagagcctgatattctttttaatcattcaaatggtgccgacaatggcggcgctgactgctttttatgtcttggcgatgctaataggcgcactcgatcaatactggtttttaacagcgatctatatcggcggcggaattccgatgaacacgtggctgatgaaaggttattttgatactgtgccgagagaaattgatgaagccgcgcgaattgacggagcgggacatctgaggattttcgcttcaattgttctaccgcttgttaagccaatgctcgcggtacaagcgctttgggcgtttatggcaccgtttggcgactatttgctgacgaaatttctgcttcgctcaccggaaaggctgaccatcgctgtaggattacaatcctttatttctaatccgcagcagcaaaaagtagctctatttgcagccggtgccatactagccgcactgccgatatgcgttctattcttttttctccaaaagaactttgtgtccggtttgacagccggcggaacaaaggggtaatgccaatgaagaatctggagaataaaagctttatcatccgctgcctgaaggcggctgcatccccatcaggtgtttgccgctatgggaataccttcagctggctgcagctctcttttctctttctgtttttaacggcctgcttaatggcgccgttagcggtttcgtttgtgaaaatggatcgcttcagcgtttcatctttcatgccgtcagcgattcaaggagttaatgatcaatttgctgatcaattgcagggttttcaaatcaggaacggaaaactaacaggcgggaagagctctgagaggattgaagatgggcagaatgtgatggcagtcgatatgaagcatgaatatgagacaagcggtgaaaatgggcgattgaaagtaactggatttgaaaacgccatcatatttcaacctgatcaactggtgatcaccgatcaaaacgaaacggggttttctgttggctatgcgaaaatggacgttaagctcgagaaaccaaacgtccatgatgtagaggtcttgatcgatacattgtggttggcacagtataagccgatgatcatgatgctggcatatacggtggtttctatgatccagcttttgttaacgtttgttcttgcaggtggcctctggatcacaaaaatatcaaacatggtctctattgcatcattcaaggaagcggcctctatagcgatttgcgcatcagcactgccggcatttgcggcagctgctatcggcatggttcattttgatttgattactgtattgatgatccattcgtgtggcgttactttgatgatctcttttgcatttagatatttgaccaaaacccgccgtgataatggaaacttacattcgggaggaaatgatgataaatcagcggttatttgagattgatgaatggaaaatcaaaacaaatacatttaataaggagcatacacggctgctggaaagcctgacgtctcttgccaatggctatatgggggtcagagggaattttgaagaaggctattcaggcgacagtcaccaaggcacatatattgcaggcgtgtggttccccgacaaaacgcgagtaggctggtggaaaaacgggtatccagaatatttcggaaaagtgatcaatgcgatgaactttatgggcataggcctatatgttgacggtgaaaaaatcgatctccatcaaaacccaatcgaattatttgaggtagaactcaatatgaaagaggggattctgcggcgaagcgctgttgtccgcattcaagataaaaccgtcagaatcaggtcagagcggtttcttagccttgctgtaaaagaactctgtgcgattcattatgaagcggagtgcttgacgggagatgctgtcattacgcttgttccttacctggatggaaatgtggcaaatgaagattctaactaccaagaacagttttggcaggaggaagcgaaaggtgctgattctcacagcggccatttagcggcaaaaacgatcgaaaatccatttggaacaccgcgcttcacggtattagccgcaatggcaaacgagacggagggttttgtccatgaaagctttaaaacgactgaaatgtatgtcgagaatcgctacagttatcaaacgaaggcatcattgaaaaagtttgtgattgtcacgacttcccgtgattttcgggaggaagagcttttatcgaaagccaaggagcttttggcggatgtggtagagaacggctatgaagatgcaaaacggaggcacactgatcgatggaaggaaagatgggcaaaagcggacattgagattaaaggagatgaggagcttcaacaaggaatccgctacaatatctttcagttattctcgacatattacgggggcgatgcccgtttgaatatcgggccgaaaggatttactggcgagaaatatggaggtgccgcatattgggatactgaggcgtacgccgttccgatgtatttggcgacagccgagccggaggtgacgaaaaacctgcttttgtatcgctatcatcagttggaggctgccaaacgaaacgctgcaaaattggggatgaagggggcactttatccgatggtgacgttcacaggtgatgaatgccacaacgaatgggaaatcacctttgaagaaattcaccgcaatggcgcgatctgttatgcgatctacaattatatcaattatacaggcgaccgtaactatatggaagaatacgggatagacgtacttgtggcagtcagcagattttgggccgaccgtgttcacttctcgaaacgaaaaaataagtatatgatccatggcgtcacagggccgaatgaatacgaaaacaacgttaacaacaattggtatacgaatgtcattgcggcttggacgttggagtatactctacaaagtctcgaaagtatctcagcggagaaacgccgccatctggatgtgcaggaagtagaattggaagtctggagagaaatcatccagcacatgtactatccatttagtgaagaactgcaaattttcgttcagcatgacacgttcttggacaaagacctgcaaacagttgacgaattagatccagcggaacggcctctttaccagaattggtcatgggacaagattctccgctccaattttattaagcaggcagatgttctccaaggcatttatctttttaatgaccgttttacaatggaagaaaaacggcgaaattttgaattttatgagccgatgactgttcatgaatcaagcctatcgccctctgtccatgcgattctcgcagccgaactcaagctggaaaagaaagcgctcgaattatataagcgcacagcaaggcttgatcttgataattacaatcatgatacggaagaaggcttgcatattacttcaatgacgggtagctggctggcaatcgttcatggctttgcaggcatgcgcaccgcgaatgagacgctgtcatttgctccgtttttgccgaaagaatgggacgaatattcattcaacatcaattatcgaaatcgattaatcaatgtgacggttgacgaaaagcgcgttatttttgagcttgtaaaaggcgagccgctgcacatgaacgtttatgaggaaccggttgtcctacagggacgatgtgaaaggagaacgcctaatgagtgaatggtggaaagaagctgtcgtttatcaaatttacccgcgcagtttttatgatgccaatggagatggattcggagatttgcaaggtgtgattcaaaagctggattacatcaaaaacctcggggcggatgtcatctggctctccccggtatttgattccccgcaggatgacaacggatatgatatcagcgattacaaaaacatgtacgaaaagtttgggacaaatgaagatatgtttcagctgattgatgaagtccataaacgcggaatgaaaatcgtcatggatttggtcgtgaaccacacatcagatgagcatgcttggtttgctgaaagccgcaagtcgaaggacaatccttaccgggattattatctttggaaagatcctaaaccggacggctcagagccgaataattggggatcgatcttttcaggctcagcgtggacatacgatgaaggaacagggcagtattatttgcactacttttcgaaaaaacagcctgatttaaattgggaaaacgaagccgttcgccgggaagtttatgatgtaatgagattctggatggatagaggcgttgacggctggcggatggatgtgattggctctatttctaaatacaccgattttccggactacgaaacggatcacagccgcagctatattgtcggccgttatcactctaacggcccacgtcttcatgagtttattcaagagatgaacagggaagtgctttctcattacgactgcatgacagtcggagaggcaaacggctctgatattgaagaggcgaaaaagtacacagatgcaagcaggcaagagctgaatatgatctttacatttgaacatatggatattgataaagaacaaaactcgccaaatgggaaatggcagatcaagccgtttgatttgattgctttaaaaaagacgatgacaaggtggcagaccgggttaatgaatgtcggctggaataccctttattttgagaaccatgaccagccgagggttatttcccgctggggcaatgacaggaaactgcgtaaggaatgtgcgaaggcatttgcaacggttctgcacggcatgaaaggaacgccgtttatttaccagggagaagaaatcggcatggtcaacagcgatatgccgctggagatgtatgatgatcttgaaataaagaatgcatatcgtgaactagtcgtcgaaaacaaaacgatgtcagaaaaagagtttgtcaaagccgtgatgataaaaggaagggatcatgcgagaacaccgatgcagtgggatgccggaaaacatgcgggattcacagccggagacccgtggataccggtaaattcccgctatcaagatatcaatgtgaaagagtctttggaagatcaagattcgattttcttttactatcagaagctcattcaattacgaaagcaatataagattatgatatatggcgattatcagctgttgcaggagaatgatccgcaggtcttttcttaccttcgagaatatcgaggggaaaagcttcttgtcgttgtgaatttatcggaagaaaaggctctgttcgaagcgcctccagaactgattcatgagcgttggaaagtgctaatttcaaactatccgcaggagcgggctgacttaaagagtattagcctcaaaccttatgaagctgtgatgggcattagtatatgaaagcggtcatttttgatttagacggagtgataacagatactgctgaatatcattttctcgcttggaagcacatcgcagaacaaatcgatatcccttttgacagagacatgaatgaaaggctaaaaggaatcagcagagaagagtcacttgaaagcatattgatctttggcggggcggaaacaaagtatacaaatgcggagaaacaagagcttatgcatcggaaaaatcgcgattatcaaatgctgatcagcaaattgacgccggaagatcttttaccggggattggcaggcttctatgtcaattgaaaaacgaaaatataaaaatcgggttagcatcttcaagtcgcaatgctcctaagattttaagacgcttggcaattatcgatgattttcatgccattgttgatccgacgactcttgcgaaggggaagcctgatcctgacatctttttaacagctgcagcgatgctcgatgtttcccctgctgattgcgcggcaatagaagacgcagaagcaggcatttctgcaatcaaatctgcggggatgtttgcggttggtgtcggtcaaggacagccgatgcttggtgctgatctggttgtgaggcagacgagtgatttgacgcttgagctgttacatgaggaatgggagcagtatagaataagggagtcaattccttgaaatgaaaaaaacctgcaagagacgcagctcttgcaggttgtgttattactttttgtcttctgtgtgagtcaaaattttgtcaatcaggccgtattcaagcgcttcttcagcagacttgaagttatcacggtctgtgtcgcgttcgatcacttcaagcggctggccagtacgttcagctaggactttgtttaatttgtcgcgaagcaagagaatgcgtttcgcagcaatttcaatttctgtcgcttgaccttgcgcaccgccaagaggctggtgaatcatgacttcactgtttggaagcgcatagcgtttgcctttttcgccggctgcaagcaggaacgcgcccattgacgcagccataccgatacaaattgtagataccttcggcttaataaactgcatggtatcatagatcgccataccggctgtaatagagccgcccgggctgttgatgtaaagagaaatttctttttcagggtcttctgctgctaagaataaaagctgtgacacgatggagttcgcaacgttgtcatcaatcgcagatccaagcatgatgatacgatcctttaatagacgagaataaatgtcatacgctctttccccgcggttcgtttgttcaatgactgtaggtattaaattcataatgctcctccttcaccttttaggtaagtatgtagttacatgatacatttttggtcaataaaggtcaaacaaaaagctggcctgatatgcaaagtcgtctctttttcccattttccccaaaaatacaggggttcaaaccatcgtatgtcagattgccaattaagatgctttgtctatttaaaaaacggcctctcgaaatagagggttgttatttgaaaggaattatcgtataattagttgtgctgacgttctcataacgcagtctatatgcgctcgtagctcagttggatagagcggtggtttccggtaccacgtctgtcgggggttcgaatccctccgagcgcgtccaatagaacaacaggaaagacaagggtttggcgatttgccgctcttgtctttttttgtgtgaaaaagggaattgcataccttagagtaacatttcaattacattctttagtttgaaccctcactttcaaaagaagaagtatgaattgattttttcattcatcttattagcttgtgattaacaaacctttaaaaaaatccggttctacccattgcctgtatttattttgagaatcttctctcggacaaaattgtataagcgagaattgatttaaaataaataattatttgctcccccagttcttctctataaattgattcgcaggctgtaagtttgttttgttcgcaatttcaatgacagcgggaacgacggcagggtccgttttggagaagttcggaatccgcggatctaaccggaaaaaacgatctcccagaagattcgcactgaccatggattcatagtacccattaccgccagcaatcatctgaagaaatggcagtaaaggttcattaggcgacctgtccaaaaggactccccaatttggaggaaggttcttcagattttcgggacgtatgttatctgcacttaccattccccatcccctcgtatctcttcttaaccgagtcggggcttcacctgttccgatggacaataccgcaatttgatccaatggcacgttggctttaccaactgcaaacgcgatactggctgtactgggattcgttgctactacatatccgtccacatagttttgataggcgcgttgcgtcgcgggagcaccgctgctccgcagtatgacatcactcactttttcatttaaatagggagagccgggaaaattgtgaaataagacaggagtccaacggtccagtttttgagagtataatttgaatgatgggacaacaattcgttttcttaaatctataagttgaagatctgctgggaaaaaatttcttaccgctttaataaaaccggaatagggtaattgttggttgaaaacaggtccgcctggccgggaaatgctgaatgcgggtaggatttcatcctcaaaatactgaagtgtttccctcggagatcttccgcttgctaatgcaagggcagtaaatgaaccgattgaatttcccgaaaatacatgggttcgactaattaacttcgggttttgcctagccaatctgtttaatagttgtaaacttaaagcacctaaggtaccgccgccgtcaaaggtcataatccgatattttgccaaagctgatgtctcctttctacatacattcagtatatgatgatctagagtctgttgtatggatgtatacctctggtactaaacacttcttcatctctcttttcttttggcctaaacgaatattcactccgaaaaaaactggacactgctcctaaaaacgataagaaaaaacgcttgttggaggattggacaggaagtttgctcaaaattgtttgaaaaatgtttctcagcagacctcaccgacgaaaaaggccttagcgtattatatttatagttcgtagatcatttgtctatgcgattatccagctcctgcatattttagtatctgaatcgaatttctttgggagtgaaataatatatgggatcaacacagttgacagggcgtgtaatcttcaaaggagaccccggctatacagaggctattaagaattggaacccttatgtggatgtctatcctcttgtctttgtttttgcgcaaaattcatacgatgtaagtaatgccattaaatgggctcgtgagaataaagtgcccttacgtgtcagaagcggtcgccatgctttagataagaacctttcagtagtaagtggaggaattgttattgatgtgagtgacatgaataaagttttcttagatgaagaaaacgctattgcaaccgttcaaactggtattcccgttggcccgcttgtaaagggattagctcgagacggttttatggctccgtttggagatagcccaacagttggaatcgggggaattacgatgggcggcggatttggtgtactctcacgatcgattggccttataagtgataaccttctcgcgctgaaaacggtagatgcaaaaggaaggattattcacgcagatcaatctcacaatgaggatttgctatgggcttctagaggcggaggaggaggtaactttggatataatacccaatatacattcaaagttcatcgtgcccctaaaactgcaaccgtcttcaatattatctggccgtgggaacaattagaaacggtatttaaagcttggcagaaatgggctccgtttgtagatgaacgattaggatgctaccttgaaatttacagcaaaataaatggtttgtgtcatgcagaaggaattttcctcggttcgaaaactgaattgattcgattattaaaacctttattacatgcgggaactccaacagaagcagatatcaaaacattatactatccagatgctatagatttcttagaccctgacgaacccatccctggcagaaatgatcagagtgttaaattctcctcggcatggggtcatgatttttggtctgacgaacccatttcaatcatgagaaaatttttggaagatgctactggaacagaagccaatttcttttttatcaattggggtggtgctataagcagagtccctaaagacgaaactgcctttttttggcgccatccattattttatacggaatggacggctagttggaaaaataaatcacaagaagattcaaatcttgcatcagttgaaagagtgcgtcagctgatgcaaccatatgtagcaggttcatatgttaatgttccagatcaaaacattgaaaacttcggaaaagaatattatggcgcaaactttgcgcggcttcgagaaataaaggcgaaatatgaccccgaaaatgtatttcgttttccgcaaagcatcccgccatctcgttaaagtttattaaagacagaatcaatgactcatactaaaaagcacttgaatggtttccggtatcttgtctgtcggggtgcgaatcccttcagtgcgtccaatcaaacaacaggaaagacaatggtttggcaacttgccactcttgtcttttttgttttgtttcatttcataaatcttttccgctgaaacataaatgttcctccgcttgggcacgttatgaaatgtgcaatattgaatatgggaggagaatgagcatgggtattttaagcggaaatccgcaggatgaaccgatgcattacggtgaggtattcggcttgtggagttatgtgatggcgggcaataaaatggtcggcaattaccaaatgctattgaatcatgtcggtgatgacgacctgaagaagctgcttcgtgagtctattgagaaatgccaagatgaaatcaaacaggtcagcacgatcctgaaagaaaacggggtggcgctgccgccggcttctcctgaaccgccgacagcagatcttaacgatattccgcctggtgcacggtttctcgatccggatgtggcggcttccgcggcagcagaaaatgctgcaggtcttgtgacatgcagcaaaatgatggggcaatcgattcgtgaggatattgccatgatgtttgggcaatttcatatgtcgaaagcggcaaccggcgcaaaatacttaaggctgctaaaaaacaaaggctggctcatcccgccgccgcttcatcttcaaaaacatcacgaagcttaatggcaaaggcatatacagctgtatatgccttgattttatgaagatgacgtaagacgcaggccgatgacgccggctaggataaggcaaagtgaaatcacctgtgaaagctgaaaccgctccttaaaccagatgagcccgaccgccgaaacaccaatgcttccaatgccagtccagacggcatatgcgactccggcaggcaggacgatcatcgcttgggacaggcagtaaaaggataagccgaatccaacagtcatcacaatgatcggccatttttttcttgttccgtctatatatttcatggcaatggcagctataatttcttctatgccggcaatcactaataaaaaccatgccattatttttcacctcccggctgagatttgctttctttcgtaaataatttcattcctaaaatgccagccagcaataaagctaaaaagaacatttgggctgctgagaaggattcgcccagaacaattccagtcagatatgttccgacggttccgattcccacaaacacagtgtacgccgcggccatcgggattttttgataagagcggatcaacaggataaagctgaccgcgattaagataaaaatgatgatccaatccaaaagcgaatcggcatgtttgagggaagaggcccaaacaacctctaaaagccctgcaataaaaacaagaacccaattcaaatgaaacacctctctattttatgaatgaacgtcagtcatttttagggcattaaaaaatgagcggtgttacccagtcattttttaagcagtacctaagctccgttttaagaaagtgaaaatttcctttttatacacttcaacattttcatcttgttcaaatccgatatagaatcgttccgcagtattctcgaccaagttgataatcgttctggccgtccattttgaattgattccttccgttacctcatggtttgcaatggccttgttgatgattttttcaagccaggaataataaggctgatagatcgtctcccatttttccatggagtggtcgatcgcaagcccggaataacagaggacaataatatccttatggcgttctgtaatgagaaatgtctcatcaattaatatatctaaaacggtccaaaaatcctcgtccccatggagcctacctttgatttgatcaagtgtatgggtgaggagattttctgcaatggccggtatgagggcatttttagatgaaaaatacaaatagaatgttccttgggcagtgccggcctttttgacaatatcagaaatagaagctttgtcgaggcctttttcagaaatgacttctatggccgcctgcaatattttttcgtatttacccgatgtttgttttggcatgaggaacacctccagtaatgactgactctcattcattttatcgcgtgtatgtttgtttgtaaagaataaagaagcaagaaaacctcttgcttctttatttatcataatcaatggcggcttttgggagcccggtatactttgcccagtaataaatcgcaagtgagccgatcgcgactaaaatgaggtcgacgggattgctgataatccctaaaccatgtccgaaagaaccgatgtaggaaaagatcagcatcataatataaaacccgataagccaccaggctgatttcagctgctgagcaaggctgacatcttctttaggcgtatatttgctgaaacagagatagatcaaaaacatcacgagttgtgaaccgagcagccaggagactgttttccatcctgaccagtacacgataaacgctgtaaatataaaggaaagcggcccgataatgctcattccctttaaataaaacggcctgtttaagtccttcgcgttgaccctcagcgcagctgaagaaatgggtgcaatcgcatatgaaagaatgagcgcgactgaacagacattgacgagcgcgttccacgaaggaaagggaagtgtccagaaaatggacagggcaaacgaaagccaaagcgaagcgcggggtgtccccgtatctttattgacctttgagaatatgccaaataatgtgccgttacgcgcccaggcgtaaacaaggcgggatgtcgtattcataaagatattcccgtttcctccgggagacagaatggcgtctaaaatgacaagcgttgcaagccagcctaacccgagcatgaccgcaatatccttaaacggcaatgagaactcccggccaattgccggccagccatgtttcagtgtttctgtcgggattgcaccaataaaggtgacctgcaaaacagtataaatgatggttgaaacgatgatgcaaatgattaaagcgatcgggatattgcgttttggattttggacttcacctgctacagatacaatcggatgcaggccgagatacgcaaacatgacgccgcctgtcgagatggcagcctgaatacctgtaaatccaaacggtgcaaatccttgaacggataaattctccggctgaaaatgaaagatcagcacaataatgatggtaatcggcacaatatatttaaaaatcgatatgatgaaattcgccttagcgaaggttttgacgctccaataattcagcaggaaaaacaagcataatagggcaaactgcaagatccagccggaaatggtaggcgaatcagaccctttaatggtcaggccgggaaaccaataggccacatactggcgcacagctgtcacttcaattgaaatcaagcttgtataagcgacaatcgtgacaaacgaaattaagtagccgacaaggtggccatgtgaataaacggggtatcgaatgatgcctccggtacggggcagagcggctccgagctccgcatatacaagcccgattaacaaaataatggctcctccgaggatccaggaaaaagcgccggagggccctgcttttgaagcgacattactgacagcgaacagccacgctgatccaaagatggctcccatcccaatcaaaatcagatcaaacagcgacattgatttttgaaaatttccttgtttagacattcgcttcctcctttgaaaccagccttatattccttacaatgcccaatatgtaacagagaataccgctcctaataaaaaaacaggggcagcctgcgccgcccctgtttttattcatgaatcgaatcaaagtgtttcactgttatatttttgaaggaggctgtgccgccgtcagaataaagggtaattcctttatcttcaggctttgggaagacttcatttgaaaaaacggttttcccgtcgccaacaaatacttctatcgttgttttatcgacaagtattttcaaatgcaccttacgtttgtttacatcataaggagctttgctttcgacataggtattgcttttgtcaggctgatttgtggctgctctattgacataagcatagccgccttcagcgaaaatgccgacatcaatatggcgtttttggtcttctgattctctgagcctgacgcctgcattctttagctctgaccaagaaagatccgtatcaagctggtacgtatcacctgttatcgacaatgtttttgatccgttcacatcctgatcctctatttcgtcagttgaaacagtcagctgctccaaagcttcaatcggctgtgagacgaggctgtatgttccatcctgctccttcagccggagttcgcgtatgacagaatctgtgccgttaaagccgttcttcattgtcggggtgttgttggcataatcccaattgttcatccaggcaagcgcataccgcttttctaatggatctgtgcttttgctgtcttcgaacgtcacaccgccataccagtcgaagccatagtcaagccattgggcttcagtctgatccgctttgaattcttttccgtcgaagcttccggtccagtaggcgtacgtatttggtttgccccacggtttgccattcgcgctggcaccgagaacccacttattcgttccgtcgcttgcccgcatcatgtagaggtcgggacattccaccattcccgcctgttctgggaagaatccgcttgtgtaatgccagtccttaagattatcggattcataaaagccgatttttgatccttcagccatgaccatgacccatttgttatcttggtcatcccatatgactttcggatctctgaaatcgtctgtgcccggattaggcataacggggttgccactgtagaatttgaatgattttcccttatctgtgctgtaccacaaatattgttcctgttttttgtctttggctgagggctgtgtcacaatcgcgacaagcgcatttttcccgaagccggctgtgttctctttatccaccacgacggaaccggtccaaatatcaccgtccgggtttgtatatttcggaatcgccacgccttcatcggtccagtgcaccaaatcctctgagacggcatggcgccattctgtgccgttgccttttgggtaatcccggttatatagatagaaataatgatacttgccatcaaaatagatcggtttttgagggtcatttttccatttatccggcgtcgtaaaatgatatgccgcccggtagtccggcttctgttttgattttgttttttggtcatgttcttcttttggaaataagtcgataaacagcaatattcctaaaaaggttaggaatacggttagccatttgcctgcttttatatagttcatatgggattcacctttatgttgataagaaataaaagaaaatgccaataggatatcggcattttcttttgcgtttttatttgttaactgttaattgtccttgttcaaggatgctgtctttgacaacagatgttttcttgcctttgatgttcagcaggaagcttggcgcaaacgttgattgtttgtctgcgtagaatcctctgtttgtcatatagcttgtaatcacgacattgtttcctttcgcttgaggtacagcgaagtgtgagtaagtaaaggttacatcgttaggatcaagatccatttttaacacaaggccagttttgttcagcggcttgtatgggccagttaaagaattagaaacataaccaagcatgtaaatatcgttagacgtaatgccgtcaatcgtcatttttgatccgcgggagtcagtgaacaggtaccatttgccgttcattttaaagacgttcgcgcgttcaatttcatctgttactgtgttagatgcaatcagcggtttcatcacttttttcagtgtgtaatcatcgtttagctcaatcataccgagagcgccgtttgctaactcagccgtgcgttttttatcgctttgcagaagtttttgactttcttgacggaagaatgatgtgcttttgccatagtatgctttgttaaataaagattcttcgccttggtagccatcttcagttccagtgtttgcttcaaatactaagtatttgtggcctttatcttctacgtagtgaggatctctcagcgtatggttgtcgcctgagctgtagttgccttcatcgatgaactgctgtacattttgatacgtttttccgtcaccgtcaaagattgatttataatcctctacaccgttgatgttcaaagagctgtctgatgctgatacgttaacttgtgcagttgtcagtgtttgtttgccgtaatgtttaccggagaaatcagtgtagaataaacggatttttccgtcagatgtaaatgtggctgaacctgaccattcttgtgtttggtcttttaggatagaatcatttgcatcgaatttgtcgctgtctttaaagacgcggccagcgtttttccagctgtcaatagaagtttcgccgactttttgatagaacatgtaaatcgatgtgtcatccgcatttttaggatctccggctaatgcaaagacgatgtggtagccgtgatagtttgcgacagtgccgtcagcgttttgtaatggccagctgtcccaaacgtccaggccttttgcagaagagatatttttaattgtggacgaatcgaattcaggaacttgatatttttcatttttttgctgttcagggatttgcagcatatcatggcgtgtaatatgggaaatgccgtatgtttccttatatggcttttggttcgtttctttcgcaaacgcttgagttgcgcctcctgccagcagtgcggtagtaaaggttaatactgttgcttgttttgcaaactttttgatgttcatcgttcatgtctccttttttatgtactgtgttagcggtctgcttcttccagccctcctgtttgaagatggcaagttagttacgcacaataaaaaaagacctaaaatatgtaaggggtgacgccaaagtatacactttgccctttacacattttaggtcttgcctgctttatcagtaacaaacccgcgcgatttacttttcgacctcattctattagactctcgtttggattgcaactggtctattttcctcttttgtttgatagaaaatcataaaaggatttgcagactacgggcctaaagaactaaaaaatctatctgtttcttttcattctctgtattttttatagtttctgttgcatgggcataaagttgcctttttaatcacaattcagaaaatatcataatatctcatttcactaaataatagtgaacggcaggtatatgtgatgggttaaaaaggatctctaactgaaggatttttcaaaatatttgaaacgttagtaggttagtaacgtacagagatatgggaggtggaggaatgaagcagaataaaagaaagcatcttcagacgttatttgagacattaggcgaaaaacatcagtttaacgggacggttctggctgcggagggtggcgatattttatatcaccactcttttggctatgcggaaatgacggaaaaacgcccgttgaaaaccaactctttgtttgagttagcgtctttgtcaaagccttttacagcattgggaatcatcttgctggaggagaaggggattcttggctatgaggataaagtggatcgctggctgcccggttttccgtatcagggcgtaacgattcggcatttattgaaccatacgtcagggcttcctgattatatgggatggttttttgccaattgggattcacacaagattgcggtgaatcaggatattgtcgatatgctgatgaatgaggggctatctggttattttgaaccgaatgaaggctggatgtacagcaatacggggtatgtgctgctggcggttatcattgaaaaagcatctggcatgagctatgcggattttataaaaacaagtatttttttaccggcaggcatgaatgaaacaagagtgtataacaggaggctttcgcctgagcgaattgatcattatgcatatggatatgtgtatgatgtacattccgaaacatacgtcctccctgatgagctggaggaaacgaactatgttgtgtatctcgatggcatacagggagatgggacggttaactctgtcacaagcgatttgtttcgatttgatcaggctttatatcaggacgatttcatcagcaaggcttctaaggaatctgcgttttctccagtgcgcctcaacaatggagaaacaattgattatggctttggctgggtgctgcaaaacagtcctgaaaaagggcggattgtcagccacagcggaggatggcccggctattcgacgatgatgatccgatatatcgatcatcgtaaaacgctgatctatttgagtaataaggaagaggatactgaatatgaacaagcgattctgaaggcggcggaacatattctatttggccagccatatgatgtcccggaacgtcctgctgataaaaagaaaaaagcaattgatacggcgatatacagccgctatgttggcagctacctgttgcaggatgggacggctgcacaggtgacaaccgagaatgaacggctttatttggagatcgccggacagctgagactggagttatttccttcctcggaaacccgtttctttctgcgagcattgtctgttgaagtcgagtttacattaggtgaggatgctgcgaaaagctttatcctctatgaggatggctcagaggaagaagcggtccgtacgaagtagaaaggaatgaatttgatgatcggaatattagccggaatggggccgaaatcgacctcgccgtttattgataaggtgattgattactgtcagaagctgtatggggcttcaaacgatattgactatccgcacatgatgatctattcatgcccgacgcccttctatgcagatcgtccaattgaccatgacgagatgaaaaaagcgattatcgacggagcggtaaagctcgagaaaacaggcgtggatttcattgcgctgccttgtaatacggcgcatgtctactatgaagagattcagcaggcattgtcagttcctatgttgcatattgttgaggaaacgataaaagagattccgcatcccgcaaaaaaagcggtggttttaggaacagagccaaccatccaatccgccatctaccaaaaagttctgaagggaaatggacaagaagttattcacaaggaccattggcagcaggctgtgaaccagcttatcgccgcaatcaaacagccaaatcatatgcagcatacacaagcattgtggcagacgctatatgaagaaatcagtcagcatgcagacatcatcatttcagcctgcacggatttaaatgcggtgttagatcatattcaaagtgagattccgattatagattcctctgcctgtcttgccaaaagcactgtcagcacatatcttgcttatcaaagctagcttcagacaaggactgtcttcaaacagtccttgtttttttatgttcctattgtttgacagttaactgcaatggtgttaaagtgaacatgtaaatagttacatgattttttctgaaggtgaggtggttctcgtgaagaagccggttttaaaaccattcgcctctttagaaatcaaggttgatccgcctatcacgattggtgagacaagcctgggactgagatgattcattccgattcgttcgggaacaataaccggggaagtaaagggacgtattttgccgggcggtgccgattcacaaatgattcgcgctaacggcagaacagatttatctgccaggtatgtgattgaaacagcagatcatgaactgatttacattgaaaacaatggaatacggcaagtcagcaagccgtttcgaaaacaagcggcagccggggaaattattgaaccggagcatgtttattttcgtacggtaccgacgtttgaaacaggcagtgaagtctatcaatggctccatgaccgcttgtttatcggttccgcagaaagaacccctgattacgttctactagacatttatgaagtacagtaaaagactaaggagagtgtgtaagatggaaaactttatcggaagccacatgatttatacgtatgaaaacggatgggaatacgagatttatattaaaaacgaccatacaattgattatagaattcatagcggaatggttgccggacgctgggttcgagatcaggaagtgaatattgtcaaactgacagaaggcgtatataaagtgtcttggacagagccgactggcacggatgtttcattaaactttatgccaaatgaaaaacgcatgcatggcattattttcttcccgaaatgggtgcatgaacatcctgaaattacggtttgctaccaaaatgaccacattgatttgatgaaagaatcccgcgaaaaatatgaaacgtatccaaaatacgttgtacctgaatttgcggaaattacatttctgaaaaatgaaggagtcgacaacgaagaagtgatttcgaaggctccttatgagggaatgacagacgatattcgcgcgggaagattataataaacataaaaacccggaaaagagaattacttctcttttccgggttttctttttgctgagtatgcgggaaccatcacaattcccgcgaaaaacagtatgatgccagtccagcgcataggctggtaatagactgtgtcccgtaaacataccacggccgacaaaataatgatacaagctgccacaacaatggcagcaccaatgtatcctgttttccccatatttattctccttttgaagggaatagcttctgccttttttcagattcgggatcgttttcgatcgtaatctctgagtctaaaatcagcgtctctctcgtttcttcatgatacgcaggccaattcacagcttcggtgcttgggtttcctgttttggcgaacgtgatccacgctgattgtatcgtgtgagaaagctgtttcacctcatccgtaatctccgcttttgccattcgttccaatccgtccagatttccaaagacaaaaggaagctctaatgcgtgaaacgctttattgtacggcggcttcttcgggtgccaatcgaacctgtacatccagacaggggcgtaatgagactgtgcggatgcataggcgacggcagggcgccaaaataataaatcagtcatcatatgaatttggctttccagagaacgcggatacaaatcggcaactttctctgccagcggcttccctagtaaatactcgagcgctgcatcaagcgtttcctgagaatgaacgtctgaatccggggtgaaaaataaatatccttcatcacgggttgttccaattaatagcggaataccggaagcagccccttctgcgatcgctttttctggttcttcaggcagcgttttcggatcaagggcgggctggaagaacagctgaaagatattttctttttctgcaatccgaagctgatcagccgcttttagcaaatcttccgcagaaaccgtatgcaatttatccagttggccctcgttaatcccaaggacctgtaaaaaggctgccgaggtgctcgccgcttgttctttcgtcatcgttcgagaagcgccgctttccatgattgctttctggaacaggccttttgccgcaggcatagcaagcagcgcggcaatgctcatcccgccggcggattctccaaatactgttacgttatcgggatcaccgccaaacgctgaaatattctctcgcacccatttcagcgcggcggcttggtctaaaagcccaaggttatcagaatacgcctcattaaatgaagacaagtgcaaaaagccaaacggccccagccgatagttcaatgtaacgacaatgacttctccctgtgccgcaagttttgatccgtcatacaatggctcactgcccgctcctagataaaaagcgcctccgtgaatccacaccatgacaggaagatttttacttggggtgtcaggcgcaaatacattgacatacaagcaatcctcggactggcggggcagctcagtatacgaaagtgacagcaaatcagacggctgcgggcaaatagagccgtacgctgtggcatcaagcacatcttcccacacttcaggcggctcaggtgctttaaaacgccattgtccgacaggcggcttggcataggggatgcctttccacttatgtacgccgttttccgttgtgccttttactttgccgtattgagtcgttactatttgatgagtcattgtgttctctccctttttcccccattataaacagatttcccctatagatgcgaacgttagccctttaaccgatcatcatcttccctttgtttttaaaaaggatttgacttcatggacagacaagccgatttctcttgcctccgccatcagcgctttccattcttctatattggattccgtcagtttgcggttgcggtaagaggcagtttcaggctgttctttcttgagtctgttcgtaaaagtgaacaattcttccttttccatcccggcttgtacggcttgcactaaatgtacgcgccattcttcttcaccgccgctgattttttcatacatcattgtttctgcgtcaaataattctgttaattcaacttccagtgtggcagaaactttttttaaaaattgaacggacggattcgtgtgaacgcctctttcaatcttgcttaaataggatttggatacgcctgactcaacagccagctgattaatagaatagccttttcttttacggtacaaacggataattcttccaatcataatatgaaattctcctctattcctgtcgttatttcgttcattataaggaatttttcgttctttataaaatttaaaataataagggaagtgcagtaaattagaggaaaatcatgattttgttctctaaagagaacttattggcttattttgcaatttttaaataataacgttttcttttataatccaatcattaacagaaaggggcgcgggaagccagccgcgggaaggctgaaggctatgaatacatgaatgagaatatgagtttcaaagaattatatgcgattgtcagacacagattcgtgctgattctgctcatcacaatcggcgtcacccttattatgggttttgtgcaatttaaggtcatttcaccgacctaccaggcgtcgacacaggtgctggttcatgaatcagacggtgaagaaaactcgaatctcagtgacatccagcgaaatcttcagtatagcagcacgttccaatcgattatgaaaagcactgccttgatggaagaagttaaggcggaattgcacctatctgaatcggcttcctcgctgaaaggaaaagtggttaccagcagtgaaaatgaatcagaaataatcaacgttgccgttcaggatcacgatccggcgaaagcagctgagattgcgaacacgttagtgaacaagtttgaaaaagaagtagatgaaagaatgaatgtacaaggcgtacatatattatcagaggcgaaggcttcggaaagcccgatgatcaagccggccaggctgcgaaatatggtcatggcttttggcgctgctgtcatgggcggcattacactggcattttttctgcattttctcgatgatacatgcaaaagcgcacggcagctcagcgagagaaccggattgccatgcttaggctccgttcctgatgtccacaaagggcggaatcgcgggataaaacatttcggggagtgaagcgagtgatctttagaaaaaagaaagcaaggcgaggtttggctcaaatatctgttttacacaataaatcagttgttgcggaacaatatcgcaccattcggacaaacattgagttctcatctgtccagaccaacttgcgatctatcctcgtcacctcctctgtgcctggtgaaggtaaatcgttcagtgcagcgaatcttgcggctgtctttgcgcagcagcaggaaaagaaagtactgctggtggatgccgatttaagaaagccgaccatcaatcagacgtttcaggttgataatgtaaccgggctgacaaatgtgctggtcggcaatgcttcactcagtgagacggtgcaaaagacgccgatcgataacttatatgtactgacaagcgggccgaccccgccaaacccggcagaactgttgtcttcaaaagcaatgggagatttaatatctgagatctatgaacaattcagcctcgtcatctttgattcccctcctcttttggctgttgcagatgctcagattctagcaaatcagacagacggcagcgtgctcgtcgttttaagcggaaaaacaaaaaccgataccgttctgaaagcaaaagatgcactggaacaatccaatgcgaagctgttaggcgctcttttaaacaaaaagaaaatgaaaaaatcggaacactattcctactagtttttgtaaaggtgatgtctcctgacctgtatcaatggaggcactcggctctgctgtgggcagctgaagttgctgccttagatgctggtcgtcgctggcggggcgtgaggatgggttaaatgcccacttatctcatatatacataggacgtattgtcggtttagctgctgccgattttttggagagacgaaaaccgccgcagctaaaccgataaaagaattaggggggaaaaggttgagttaccggagaagactgtcaatgattattgcgctggatacttacctcgttttaaattcagttattgcaggatatcaatttttaaaagattcctatcaattttatgactccggagcattactgcttaccgctgtcagcttgctcctcagctatcatgtgtgtgctttcctgttcaatcagtataaacaggtgtggacatacaccgggcttggcgagctgattgtcctgcttaagggcattacgctttcagccgctgtgaccggcgtcattcagtatgctgtgtatcacacgatgttcttccgtctgttaaccgcgtgctgggtgcttcagcttttgtctattggagggacccgtattttatccagagtattaaacgaaagcatcaggaaaaaacgctgcgcctcgtcccgcgcgctgattatcggggcgggctcaggtgggactctgatggtcaggcagctgctttcgaaagatgaacctgatatcatacctgtcgcttttattgatgacgaccaaacgaagcataaattagaaattatggggctgcccgtaatcggcggaaaagaaagtatcatgcctgcggtgcaaaagctcaaaattaattatattattattgccattccttcactccgcacccatgagcttcaggtgttatataaagaatgtgtgcgaaccggagtaagcattaaaattatgcctcattttgatgaaatgctgcttggcacacgaactgccggacaaatcagagatgtaaaagctgaggacttgctcggcagaaagccggtaaccctcgacactagcgaaatttcgaaccgcatcaaaggaaaaacagttctcgtcacgggagcgggcggatcaatcggctcggaaatctgccgtcagatcagcgcgtttcagcctaaggaaatcattctgctcggccatggggaaaacagcattcattcgatttatacagagctgaacggacgattcggcaaacacattgtgttccatacggaaatcgctgatgtgcaggaccgcgataaaatgtttaccttgatgaaaaaatacgagccgcatgttgtctatcatgcagctgcccataagcatgtgcctttaatggaacacaatccagaagaggcggtcaaaaacaatattatcggaacaaaaaatgtcgcggaagcagccgatatgtcgggaactgagacattcgtgctgatttcatcggacaaagcggtgaacccagccaacgtaatgggggcgacaaaacgattcgcagagatgattattatgaatcttgggaaagtcagcagaaccaaatttgttgctgttcgcttcggcaatgtactcgggagccgcggcagcgtcattccaattttcaaaaaacagattgaaaaaggcggcccggtgacagtaacacatccggcaatgacccgctatttcatgacgattcccgaggcatcaaggcttgtgattcaggctggggcactggcgaaagggcgtcaaattttcgttctcgatatgggagagcccgtaaagattgtggatcttgccaaaaacctcattcatttgtccggctacacgactgagcaggttccaatcgaattcacaggcattcgtccgggcgaaaaaatgtatgaagaattgctgaacaaaaatgaagtccatgctgaacaaatctttccaaaaattcacatcggtaaagcggtggacggcgattggccggtgctgatgcgctttatcgaggattttcatgagctgccggaagccgacctgagagcgaggctgtttgcggcaatcaatacatcagaagaaatgacggctgccagcgttcattagggggagtgaaaatgacgaaaaagatattgttttgcgcgactgttgattatcattttaaggcctttcacctcccttattttaaatggttcaagcaaatgggctgggaggttcatgtcgccgcgaacggacaaaccaagctgccgtatgtggatgagaaattctccatcccgattcgcaggtcaccttttgaccctcagaacctggccgtttataggcagctgaagaaagtgattgacacttatgaatacgacattgtccattgccatacaccggtcggcggcgttctcgccagactggcggcgaggcaggcacggcggcacggaacaaaggtgctgtacacagcgcacggatttcacttctgcaaaggggcaccgatgaaaaattggcttctttactatccggttgagaaatggctttcagcatatacagactgcctgattacgattaatgaagaggattacatacgggcgaaaggacttcaaaggccgggcggaaggacgcagaaaattcacggcattggcgtcaataccgagcgtttccggcctgtcagtccgatagagcagcaaagactcagagaaaagcacgggttccgtgaagatgattttatattggtttatccggctgagctcaatctgaacaaaaaccagaagcagttaattgaagccgcagccttgctaaaagaaaaaattccctcactccgccttgtgtttgccggggaaggggcaatggaacatacgtatcaaacgttagctgaaaagcttggtgcctccgcccatgtctgtttttacggcttttgcagcgacatacatgagttgattcagcttgcggatgtatctgtcgcatccagcattagagaaggcctcggtatgaatgtgcttgagggaatggcggcagaacaaccggcgatcgccacagataatcgcgggcatcgggaaatcatccgcgacggagaaaacggttttctgatcaaaatcggtgacagtgctgcttttgcccgccggattgaacagctttaccataagccggagctctgccgaaagctgggacaggaaggccgaaaaacagccttgcgcttctcggaggcgcgaacggtggaagaaatggcagatatttattccgcgtacatggatatggatacaaaggagaaaagcgtatgaactcaggaccgaaagtttctgtcattatgggcatttataattgcgaacgcactttggcagaaagcatagaatccatactcagccaatcctataaaaattgggagctgattttgtgcgatgatgcgtcaacagacggcacgctccgtatcgcgaagcagtatgccgctcattacagcgaccgcatcaaactgattcaaaacaaaacaaataagcggcttgccgcatcattaaatcattgtctttcgcatgcgacaggcgattatatcgcacgtcaggacggagatgacctttcgtttccgcgccgtctggaaaagcaggtcgcgtttttagaaaagcaccgacactatcaggtggttggcaccggcatgcttgtgtttgatgaatttggcgtaagaggcgcccgcattctgccttctgttccggagccgggcatcatggcaaaagggactccattttgccacggcacgattatgatgagagcgagtgcctaccgcacgctgaaaggctaccggtcggtgcggcggacgagacgaatggaagatattgatttgtggcttcgcttttttgaagagggcttcaggggctataatcttcaggaagccttgtataaagtgagggaagacagcgatgcattcaaacggcggtcatttacgtattcaatcgacaatgccattcttgtctatcaggcgtgcagacgcttgaagcttcctttatctgattacatatatatcgcaaaaccgttaattcgcgcctttatgcctgcagctgtgatgaatcgctaccataaaaaaagagtgatgaaccaaaaggaagggcttgtcaagcatgaatagcagccaaaagcgcgtgctccatgttctcagcggcatgaacaggggcggcgcggaaaccatggtaatgaatttatatcggaagatggacaaaagcaaagtgcaatttgattttttaacgtatcgaaatgatccgtgcgcttatgatgaagagattttatctttaggcgggcggcttttttatgtcccgagcattgggcaaagcaatccccttacatttgtgaggaatgtgagaaacgcgataaaagaaaatgggccgttcagcgccgttcatgcgcacacggatttccaaacgggttttatcgcccttgcggcaaggctcgccggagtgccggtcagggtatgccactcccacaatacgtcttggaagaccggcttcaactggaaggatcgattgcagctgctcgtgttcaggcggctcattttggcaaatgcgacagcgctgtgtgcctgcggagaggatgcgggcaggtttttatttggacagtccaatatggagcgggagcgtgttcaccttcttcctaacgggattgaccttgagttgttcgccccaaatgggcaggcggctgatgaagaaaaagcagcacgcggcattgcagccgaccggctcatcattggccatgtggcccggtttcatgaagtgaaaaaccacgcgttcctgttgaagcttgccgcacatctcaaggaaagaggcattcgctttcagctcgttctggcgggagacgggccgttgtgcggggagatagaggaggaggcgcggcagcagaatttgctatcagacgtcctctttttaggcacggaagaacggatccatgaactgatgcgaacattcgatgtatttgtcatgccgtctctgtacgaaggcttgccggttgtgcttgtggaagcgcaggcgtcggggcttccatgcatcatttcagacagcattacagaaaaagtcgacgccggtctcgggcttgtcacaagattaagtctttctgagccgatcagcgtctgggctgaaaccattgcaagggcggccgccgcaggcaggccgaagcgtgagttcatcaaagaaacactcgctcaacttggctacgatgcacagcaaaatgtaggagcgctgctgaatgtatacaacatcagcacggaaaaggaccataaccgatgattgtatatgccgtcaatatggggattgtatttatttggtcttggttcgctaaaatgtgcggcggccgtgatgattcgcttgccacggggtatcggccgaataagcttttgatctggattccgctcgcttcacttgtgctcgtgtcaggtctccgctatcgagtcggcacggattttcagacgtacacgctgttgtacgaattggcgggcgattatcaaaatgtgtggcagatattcggtttcggcacagcgaaaacagcgacagatccggggtttaccgcactcctttggctgatgaatttcatcacggaagatcctcaaatcatgtattttacggtggcggtcgtgacctacagctttattatgaagacactcgccgactatggcaggccgtttgagctgagtgtctttttatttttgggaacctttcattattacgcatcttttaacggcatcaggcaatacatggtggcagctgttttgttttgggcgatccgttatatcattagcgggaactggaagcgatatttcctgattgtgctggtcagctcgctctttcattcgtcggcgctgattatgattccagtgtactttattgtcagaagaaaagcctggtcaccggcgatattcggcctatccgctttatttctcggcatgacatttttatatcaaaaatttatttctgtgtttgtcgttgtacttgaaaacagctcatacagccattatgaaaaatggctcatgacgaacacaaatggaatgaatgtgatcaaaatcgctgttttggttctgccgctgttccttgcattttgctataaagaacgactgcggagtctgtggccgcaaattgatattgtcgtcaatttgtgcctgctaggttttttgttcggccttttggccacaaaggacgtgatttttgccagattcaatatttatttcggtctgtatcaaatgatcctagtcccttatttcgtcaggatatttgatgaaaaatcgaacgctcttatctatatcgctatcgttgtttgttattttctttacagttatttgcttatgccggtcgattcatcggttctgccttacagaacgattttttcccggtaatttatgcacgaggagccggtcattatggaaacacctgcggttagtctgttagtcgctgtttataacacagaaacatatatcagaacgtgtctcgaatcactgcggaaccagacaatggacaatattgaaatcatcattgtcaatgacggttcagctgacgccagcccggatatcgcagaagaatacgccaaaatggacaacaggttcaaggtgattcatcaggaaaaccagggactcggtgcggttcggaataaaggcattgaagctgcacgcggcgaatttatcgcgtttatcgattcagacgattggattgagcctgattattgcgagcagatgctccggacagcaggcgatgaaactgatctggtcatttgcaattacgccgcagagtttgaggacactggcaaaaccatggactctgacattgcccaaacctatcaggatcagccgaaggagcactatatcaaggcgttattcgaagggaaggtcagagggttttcatggaacaaactgtacagaagaagcatgattgaagcccatcggctgtcgtttccgctccgaggcgagctggagcatgtcgaggatcagtttttcagcttcagggctcattttttcgcccgctcagtatcctacgtaaaaacgccgctctatcattatcgaattcacctttcctccattgtgcagcgctatcagaaaaaattgtttgaatcaggacttgcgctgtatgagacgaatgcggcgtttttacaggagaacaacaaactggaggagtatcgcaaggagcttgatacctttatcgttcttcacagcagcatctgtatgctgaatgaatggaaaacgagcggcagccgccggctgtttgaaaagcttagaaatgttggcgtgatatgcgcggacccggtgtttcaagaaagtctttcaaaaacgggtactgctccttttgacgcaaaacggtcatgcctgcttctgatggcgaaatacagaatgattccgttcgtcgctatggcatcggctgtgtatcagcgggtgatcgagtacaaaatgagaaacagagggtgaggacatgtcgttacaatcgttgaaaatcaattttgcagaatggctgctgctaaaggtcaaatacccgtcccaatattggctgggagcggcagatcaaccggtaaaggccgcagcacatcagaaaaaaatcatactgaccctgctgccgtcccatgacaatttgggagatcacgcaattgcttatgccagcaaggcatttcttgagcaagaatacccggactttgacatcgtcgaggtcgatatgaaggacatttacaaatcagcaaaaagcctgatccgctcgcgccatccggaggatatggtctttatcatcggcggcggaaacatgggggatttataccgttatgaggagtggacgcgccgcttcatcattaaaacattccatgactatcgggttgtccagcttccggcaacggctcatttttctgacacgaaaaaagggcgcaaagagctgaaacgggcacagaaaatttataatgcgcaccccggcctattgctgatggcgcgggatgaaacaacgtatcaatttatgaaacagcattttcaagaaaaaacaattttgaagcagccggacatggtgctgtatttagacagaagcaaggctcccgcagaacgcgaaggggtttatatgtgtttgcgcgaggatcaggaaagcgtgcttcaggaggagcagaggaaccgggtcaaggctgcgctatgtgaggaattcggcgagatcaaatcctttacgacaacgatcggccgccgggtcagccgcgatacacgcgaacatgaacttgaagcactgtggtctaagctgcaaagcgcagaagccgtcgtcactgacaggcttcatggcatgattttttgcgcgctgacaggaacgccgtgtgttgtcattcgctcctttgaccataaggtgatggagggctatcaatggcttaaagacatcccgttcatgaagctgatagaacatccggagccagagcgcgtaacagccgcagtcaatgagcttttaacaaaagaaacatcccgtgcaggctttccgagagatgtgtattttaaaggtctgcgtgacaaaatcagcggtgaagcgcaatgatcccgctcgtcagcattattgtcccgatgtataatgttgaaccatttatagaagagtgcattgattctttgcttcgtcaaacgctttctgatattgaaatcatcctcgtgaatgacggaacaccggatcgttcaggcgaaattgcagaggactatgcaaaacgggatgcgagaatccgggtcattcatcaggcaaacggcgggcttagttcagcgcgaaatacgggaataaaggccgcgcggggcacttacatcggctttgtagacggagacgattatgtatcatccgccatgttccagaggctgactgaagaagcggagcaaaatcagcttgacatcgtcggatgcggtttttacaagcagtcatcggacaggcggacatatgtgccgccgcagcttgaggcaaaccgcgtgctgacgaaaccagaaatgactgaacagcttaaacatgctcacgaaacgagatttatctggtatgtatggcgttatctttaccgtcgtgagctttttgaaagggcgaatctgctgtttgatgaagacatccgttttgctgaagactctccctttaatttgtccgcttttcgcgaagcggagcgggtgaaaatgcttgatgaaggattgtacatttatcgtgaaaacccgaacagcctgacagaaatcccttataagccggcgatggatgaacatcttcaaaaacaatatcaggctaaaatcgcattctacaatcactacggcttagcaggcgcatgtaaagaagatttgaatgtgtacatttgcaggcaccagcttccgatgcttttggcaaatgcctgtgcttctccgaattcgccgaaagacatcaaaaagaagatcagacagattttatcctatgacatggtgcggcaggctgtcagacatacaccgtttcagcatgagaaattattaagaggagagcgtttggtattagcactgtgtaaatggcggctcacttttctcatcaagctgtttttcgagcagcgggggacaatgaaaggcagtgcgaagcaggcatgaaattcacgataaatttcagcgcgaatctcacggcttttctcttgtctgttttcctatcggtttggatgacgccttttattgtcaaaacgctcggtgtcgaagcgtttggctttgttcacttgacacaaaatgtgattaattacttttcggttattaccgtggcgctcagctcggttgtcgttcggttcttttctgttgctgcccacaggggagagcgggagaaagcaaatgcgtatatcagcaattatttagccgcctctgttttgatttccttgctgctcttgctgccgcttgcgggttcggctttttttattgaccgcgtcatgaatgtgccgcaagcgcttttggcagatgtgcgtttgtcgattttaatcggcagtgtgctgtttattttaacgtttctgatggcgggcttcggcgctgcaccattttatgccaaccgcctttatatcaccagttccattcaggcggtgcaaatgcttatacgggtgctgtctgtgctgctcctgtttgcatgctttgcgccgaaaatctggcagatccagcttgcagctttagctggtgctgttattgcgtctgtgctgtctttctatttcttcaaaaagctgattccgtggttttcgtttcgtatgaaggatctttcattccgtacaagcaaggagctgtttcaagcgggcgcatggagctccgtcaatcaaatcggcgtcctgctttttttgcagattgatctgttaaccgccaatttgatgctgggggcgtctgcatccgggaaatacgcggcgattatccagtttccgctgcttttgcgcagcttggccggaacggtcgcatccctgtttgcgcccatcatgacttcatattattcaaaaggcgatatggaaggattgatgaattacgccaataaggcagtaaggctcaatggtcttttgcttgcacttcctgctgccttattgggcggattggcgggaccttttctgacaatctggctcggaccgtccttttcaacgatagcaccgcttttatttattcatgccggatacttggttgtcagcctcgcctttatgccgctgttttatatatggaccgcttttaatcaacaaaaaacaccggcgattgttaccctgctgttaggtgcggtgaatgtggtgctggcggtcacgctgagcgggccggctcatctcggtctgtacggcataacattggcaggggccatttctcttattttaaaaaatgccatctttacgccgctttacgtatcccgcattacaggctacaaaaagcacgtgttccttaaaggcataatcgggcctctttcagccgctgtatttgcctggacggtctgtaaggcaattcagttcattgtgaagattgacagctggccgtcattgatagcgacgggagtgacagtcagcttttgctacgctgttttcgcttttatgctcgtttgtacaaaagaggaaagacagctggtattaaaacggtttcgaaaaacgaaaggagctgtgaatctttgatcctgaaacgactttttgatctgacggccgccatttttttgttgtgctgtacaagtgtgatcattctgttcaccatcgccgttgtcaggctgaaaataggatcacctgtcttctttaagcaagtaaggccgggcctgcacggcaaaccgttcaccctatataagttccggacaatgacggatgaacgggacagtaaaggaaatctgctgcctgatgaagtccggctgacgaaaacgggcaggctgatcagaaagctgagcattgatgagcttccgcagctcctgaatgtcctgaagggcgatctgagccttgtcgggccgcggccgcttttgatggactatctgcctctttatacagaaaaacaggcacggcgccatgaggtgaagccgggtatcacaggctgggcgcaaatcaatggcagaaacgcgatttcctgggaaaagaaatttgaattagatgtttggtacgttgacaactggtcattttttctcgatttgaaaattttatgtttgacggtgcgaaaggtccttgtttcagaagggattcagcaaaccaatcatgtgaccgcggaacggtttaccggaagcggagatgtgtcctcatgaaaaatgtggccattgtgggtgacggcggtcacggaaaggtgatcagagagctgataaacgcccgctcagatacgcgcttagccgcggtgctggatgataaattcaaaacgttcgaaggcggaaaagaatggtacacaggaccgccgaaagccgttactgaactgcgcaggctcattcctgatgtgctgtttctgattgctgttgggaataacagtgtcagaaaacagctggcggagcgactgggactggggaaagatgattttattacattgattcacccgtcagccatcgtcagcaagtcggctgtcattggggaagggacagtgattatggcgggcgcgatcattcaggcggatgcgcgcatcggcgcccactgcatcatcaatacgggtgcagtggcagagcacgacaatcaaatcagcgattacgttcatctgtccccgcgtgccacgctgtcaggagcggtttccgttcaggaaggcgctcacgtcggaaccggtgcatccgtcataccgcagatcataatcggggcttggagcattgtcggagccggctccgcggtgatccgttccataccggacagggtaacggcggccggtgctccggcacgcatcatttcttccattcaaacatcaaacaaaggatgattctatgcataaaaaaatctacttatctccccctcatatgagcggcagggagcagcactatatttcagaagcctttcgctcaaactggattgcgccgcttgggccgctcgtgaattcatttgaagaacagctggcagaacgagtcggtgtaaaagcagcagctgcggtcggctcaggaacggcggcgattcatctcgcgctgcgtttgcttgaggtaaaagaaggtgacagcgtgttttgccagtccttcacatttgtagcaaccgccaatccgattctatatgaaaaagcggtgcccgtctttattgattctgagcctgatacgtggaatatgtcgccgacagcccttgaaagagcattggaggaagcgaaaagaaacggaacactgccaaaagcggtaattgccgtcaatctatatgggcagagcgcgaaaatggatgaaatcgtaagcctgtgtgatgcatacggagttcctgtcattgaggacgcagccgaatctctcggcacagtctataaagggaagcaaagcggaacattcgggcgcttcggcattttttcatttaacgggaacaaaatcatcaccacatcagggggagggatgctcgtttcaaatgatgaagccgcaattgaaaaagcaagatttctcgcttcgcaggcacgagagccggctgttcattatcagcacagtgaaattggacataattacaggctgagcaatatcttagccggcgtcggcattgcccagcttgaggtgctggatgagcgagtggagaaaagaaggaccattttcacgagatacaaaaatgcgctcggtcacttagacggcgtccgctttatgccagagtacgcagcaggcgtatccaatcgctggctcaccacgctcacacttgataacgggctcagcccatatgacatagttcaacgtcttgctgaagaaaacattgaagcccgtccgctgtggaagccgctccatacccagccgctgttcgatccggctttattttattctcatgaagatacaggaagcgtatgcgaagatttgttcaagcgaggaatctgtctcccatcggggtccaatatgacagaagatgagcaaggccgggtcattgaagtgctactgcacttattccatactgtcgaggtgaagaaatggacagcaagcattcgatgatcagcctgaaacagaaactgtccgggctgctcgacgtcattccgaaacaatcagagattatatatgctgactatcctctatatgggaatgtaggggatttatttattatgaaaggaacagaagccttctttaaagaacacgggattcgggtcagaaaacgctggaatccagacaatttcccaatcgggcgaaagcttgatccgaatctcatcatcgtctgccagggaggcggaaacttcggggatctgtatccgtattatcaaggctttagagagaaaatcgtccaaacctatccgaaccacaaaattgtgatcctgccgcaatcgatttattttcaaaacaaagacaacctcaagcggacggcagagatattttctaagcatgcgaaccttcacatcatgacaagggaaaaagcctcctatgctacggcacaggcctattttacaacaaatcacattcagcttctgcctgatatggctcatcagctgtttcccgtcattcccacgcagcagccgtccaatcaaaagctgagatttatccgaacagatcatgaagcaaaccaggcgcttcaggaacacgcagaagcggaaagctacgactggcgcacggtgctgtcagcttcagaccgccggacgattgcttttctccaaacgctgaacgtcttgaataaaaaagcaggcaaccctttgcccattgcgtatatatgggaaaaatactcggattatatcgtccaaaaagcgattcggtttttcagccgttacgaatcggtggaaacatcaaggctgcacggccacatcctgtcttctcttcttcaaaaagaaaacacggtcattgataattcctacgggaaaaacgccaattactttcatacctggatggaaggcgtgccaagcacccgtctcatccagcacgcctcaaagaaggaaaaccttcctgctcacatgtgagcggaaggtttattttgattctccacgtttgactttgttgtatgcttcatctaaatgctgaatccgtttcaggacaactgcgtttttcgtcagctggtcctgcactagtgttgagacgacggaacggtagtagctgttcatcgcgtggattttatcctcagactgattcatttcaatatgctgttttaaattctcaataaaataagggacggaaaaaagttcagacatttctttggcagctcctttttcataaatgtatacggtgtgatctcaatcatgtacaatgaagaaaggggagtgagcaagatggatatgaaacttcagcaagtacaagtattaaagcctcaactgacacaggagctcaggcaggccatcacgctgcttggctatcattcggcagaactcgccgagtacattgatgagctctcactggaaaaccctcttattgaacgaaaggaaacagacacaccgccactatcttaccataaaacaaacaaaaacaggatgaatgcacaggaagcgggccttcaattaagtaatccgcaaaaaacattgcaggatgcgttaaaacagcagtcactcgatatgaatctgacaaacactgaaaaaaagatttttaattatctgattcattcgcttgattcaaacgggtacttggaagaagatatagaggaggcagcacggcgattatctgtatcggccaaggaagcggaggctgttttggcaaaactccagtcgttagaaccggctggaatcggcgcgagatctttgcaggaatgcatccttcttcaattacagcggctgccgaacagaaatgaacaagcggaaatgctggtttcagctcattttgatgcttttgcgcaaaaaaaatggaaaacgctttcagtagagacgggaattccgcttcataccattcaagatatctcagatgatatcgcggctcttcatcctagacctggccttctgtttgcccggccagagcaagatgtgtatattgagcctgacatttttatcaccgtaaaaaatgggcacatcgcagcggaactgaatacccgctcgtttcccgagatcgatctgcatccgcagtacagaacgcttttatcatccggctcctgtcaggatactgtctcctatttatctgcgaaatatcaggagtggcgctggctgagccgcgcgctgcggcagcgaaaacagacaatcacgagaattatcaatgaactgatcacacgccaaaaggatttctttctgaaagggcgaagcgcaatgaagccgctgactctcagagaggtggcagactgtctaagccttcatgaatcaactgtgagccgggccattaaagggaaaacaatacaaacgccttacgggctgtttgagatgaaactctttttctcagcaaaagccgaggcttcaggtgatggagatgcgtcgaattatgcagtcaaaacgcatctggaaaacctgatcaatcaagaggacaaaacaaaaccgctttcagaccaaaagcttgtcgatttgctgtatgaacaacacggcatccaaatctcgagacgcaccgtggcaaaatatcgcgatcaaatgaatattccgtcatcggcagcgagaaagcgatataaataaaatcctccctagacgggaggatttttttaaggaatcatccagctgaatacgtgatgctgcaaaaaggtgatgatacagacgagcagcagcaaaaacagactgtgtttaatggtaaagcggaaaagatctgactcctttccggcgagtcctaccgcggcgcacgccaccgctatcgactgcggtgaaatcatttttcctgtgacaccgcctgaagagttggcggccacagacagaacggggtccatgccgactgataatgcggtgactttctgcaggttgccgaacagcaggttggcagaagtatccgagccggtaatgaagacgccgagccagccgagaacgggcgaaaagaaggtaaacatcgaacctgtcagcgcgagtgtcatcccgagtgtcgtgctcattcccgaggagttggtgacataggcaaaaccaacgacagaagcaatggtcaaaatcggaagcttcaattcctggactgtttctttaaaaacggttccccagtctttccacgaaatcgccgtgatgaattttgacagcactgcggcaatcaatatcgcggtgccggccgaaccaagcacctccaacttgtaaaccgcttcaatcggcgtaccgtcagcattgacaatctgattgttcaaaaaaggcacaccgggggaaaaagtcagtttttctccaacagcattcagccacttcaagaacaccgcagagccttcataatgcccggtcagcgcggatttgacagatggaatgccccatacggaaatcatcgccgtcagcagcagaaatggcgaccaagccttaaaaatctgtccgcctctgtatgcaggcgccgccggatttgtgcgcgccgtttcaattgaggcggccgactcttgttcaccggcaaaccggaatgttgttttcggcttccaccatttcaaaaacacagcaagcgcagccattgaaacaagagctgacaaaacatcgggcagctcaggccctaaaaaattggaactgagatattgaacaacagcaaaggaaacaccggatacgagaatcgccggccagatctccaaggctttcctgaacccgctcatgatgatgattaaataaagaggaataaatacggataaaaacggcagctgccgcccaaccatttgcgaaatctccatcgccggaatccctgtcggcccttctacggctgtaattggaatcccaattgccccaaaggcaaccggcgccgtattggcgatcaaacagatccccgcagcataaagaggattaaagccgagaccgaccagcagcgcggcagaaatggcgaccggcgctccgaagcctgctgccccttctaaaaaagccccgaatgaaaaagcgatcaagagagcttgaagccgtcggtcatcagtaatcgagagaacagagctgcgaatgatatcaaactgtcccgttttcacagtgattttatacaaaaaaacagacgtcacaatgatccagccgatcggcaacaatccgtatacggctccttgtgtcgcggacatcagcgctttttccgccggcatacgataaaccaatacagcaatgataagggcgatccccaatgtggccaagcctgctgtataccccttcatccgtttaatcgcgagtgcccaaaaaaagaaaataatcggtacaagtgcggcaagcgctgataatagcaaatttccccctataggcgtatatgcctgtgtccattgcatcccaaacccctccttgaaacataaactggcgccatatgtaagcggtttctatagatgatatgatcatctgatgactgggtaataagaccagttacctagcattatattttgaaaaaaatcaaagtacaagactttttgacaaaatagtcaaaatcttttggcggcccacaaaacagagtataatagatcgtaaacagccagacctacaagttacggggtgaattgcattgaaatataaacagattaaaacaaaaaaatatatgaagaagtagcggatgccctattagatatgatcaaaaatggcgaattgaagccgggggataaactggactctgttcaggcgcttgctgagagctttcaagtcagccgttcagcggttcgcgaagcactttctgcgctaaaagcgatggggcttgtcgaaatgaaacagggagaaggcacgtatctgaaggaatttgagctcaatcaaatttctcagccgctctcagccgcccttctgatgaaaaaagaggacgtcaagcagctgctcgaggtcagaaaactgcttgaaatcggcgtggcttcactagcggctgaaaaaaggacagaagcagatctcgaaagaattcaggatgcactaaaggaaatgggcagcattgaagcggacggggagctgggagagaaagcagactttgcatttcatcttgcgcttgcggacgcttctcaaaatgaacttcttaaacacttgatgaatcacgtgtcatcattgctgctggaaacaatgagggaaacgaggaaaatctggctgttttccaagaagacctccgttcagcggctgtatgaggagcacgaacggatttacaatgctgtggctgccgggaacggtgcacaggcggaagccgccatgctggcgcatttgacgaatgtggaagatgtgctttcgggatatttcgaggaaaatgtgcaataaccaactcatttcccgggcaattccgccggttccgaatgatacgaacaactgagactgagccgcaaatggttcagtctttttacatggcagccagagggctttgtgcacttgacatttgtgaaaaagaaagtaaaatattttactaaaacaatgcgagctgaataatggaggcagatacaatggcgacaattaaagatatcgcgcaggaagcgggattttcaatctcaaccgtttcccgcgttttaaataacgatgaaagcctttctgttcctgatgagacacgggagaaaatctatgaagcggcggaaaagctcaattaccgcaaaaaaacagtaaggccgctggtgaaacatattgcgtttttatattggctgacagataaagaagaattagaagatgtctattttaaaacgatgagattagaagtagagaaactggcgaaagcattcaatgtcgatatgaccacttataaaatagcggatggaatcgagagcattcctgaacatacggaagggtttattgccgtcggcacattttcagatgaagagctggctttcctcagaaatctcactgaaaacggcgtgttcatcgattcaactcctgatcccgatcattttgactcggtaaggcccgatttggcacaaatgacaaggaagacggtaaacatcctgactgagaaggggcataagagcatcggttttatcggcggcacatacaaaaatccgaataccaatcaggatgaaatggacatccgtgaacaaaccttcagatcctatatgagggaaaaagccatgctggacgagcgctatattttctgtcatcgcggattctctgtagaaaacggctaccgcctgatgtcagcagcgatcgacacattaggcgatcagcttccgactgcttttatgattgcagcggacccgattgcagtgggctgtctgcaagccctgaacgaaaaaggaattgccataccaaacagggtaagcattgtgagtatcaacaacatcagcttcgcgaagtatgtctcgcctcctctgacgacgtttcatattgatatacatgaattatgtaaaaacgctgttcaattactgcttgaacaagtgcaggacaagagaagaacggtaaaaacattatatgtgggcgcagaattaatcgtcaggaagagtatgaattaaggatgacttaggacactaagtcattttttatttaggtaaaaaaatttactctatgaagtaaatagtttgtttacacattttctcaggcatgctatattatctttaaagcgctttcattcctaccgaaagggtgacaatcaatgaaaatggcaaaaaagtgttccgtattcatgctctgcgcagctgtcagtttatccttggcggcttgcggcccaaaggaaagcagcagcgccaaatcgagttcaaaagggtcagagcttgttgtatgggaggataaagaaaagagcaacggcattaaagacgctgtggctgcatttgaaaaagagcatgatgtgaaggtcaaagtcgttgaaaaaccgtatgccaagcagattgaagatttgcgaatggatggaccggccggcacaggccctgacgtgttaacaatgccaggggaccaaatcggaaccgctgtcacggaaggattactcaaggaattacatgtcaaaaaagacgttcaatcactttatactgacgcttccattcagtctcaaatggtagatcaaaagctttatggactgccaaaagcggtcgaaacgactgtgcttttttacaacaaagatctcatcacagaaaaggaattgcccaaaacgctggaagagtggtacgactattccaaaaagactgctgacggcagcaaatttggctttttagccctattcgatcaaatttattatgcagaaagtgtgatgagcggatatggcggatacatttttggaaaggccaaagatgggagctataacccgtcagacattggaatcaataatgaaggagctgtcaaaggtgcggcgctgattcagaagttttacaaagatggcctgttcccggctggcattattggagaacaagggattaacgtgttggaatcgctgttcacagaaggaaaagccgccgcaattatttctggtccatggaatgtagaagccttttcgaatgcaggaatcaattatggcattacgaaactgccgaagctggaaaatgggaaaaacatgagctcctttatcggcgtcaaaagctacaacgtcagtgcattttcaaagaatgaagagctggcgcaagaattagccgttttcctggcaaatgaaaaaaattctaaaacacgatatgaagaaacgaaagaagttcctgctgtgaaatccctagccaatgacccggctattatgaaaagcgaggcggcacgggctgttactgaacaatcccgtttctcagagccaacaccaaatattccggaaatgaatgaaatatggacgccggctgattcagcattacagacggttgcaacagggaaggcagatccgaaacaagcattggatcaagcagctgaaacggccaaaggacaaattaaggcaaagcacagcggaaaataaagagaaagctagatttgtattgtaagagaggtgaaaacggtgcagcatcgtcaagtcgctttgttgctttctatcattccgggactcgggcaattttataacaagcaatggataaaaggtattgtctttcttttcttaggcgcatcgttttttgcggtctttggagatctgctcaatatggggttttggggaatctttacactgggaacagaagtgccgcgggataattccgtttttctgctggcggaagggattattgctgtcatcgtgacctgctttggccttgcggtgtattatgtaaatcttcgcgatgcgttccaaagcggaaaacagcgtgatgaaaataagccattaagttccttaaaggaacaataccagcatatcatttctgagggctatccttatgtcgtcagcggcccatctttgtttattttaattttcgccgtgatctttcctatcttattcagctttgcattagcgtttacaaactatgatttgtatcattctcctcctgcaaaattaattgattgggtcggttttcaaacgttcgcaaatattttcacagttgatatttggaggtcgactttttttgatgtactggcttggacggtggtttggacacttgctgcatccacactgcaagtcaccttggggatttttctcgcgatcattgttaaccagaaagaccttcggtttaaacgttttttcggacgattctgattttgccatgggccgttcccggttttgtgacgattttaatttttgcgggactgtttaatgatagcttcggtgcgatgaatcacgacatcttggctttcttcgggatagatccgcttccgtggatgacagatgccaattggtcgaggcttgcattgattctcatgcagggctggctcggatttccgtacatctttctcgtctcaacaggcgtattgcaatccatcccggacgatctgtatgaagcagctacgattgatggcgcttctgtcttttcaaagctgagatacatcacgcttccgatggtgttcattgcaatggctccgattatcattactcagtttacgtttaactttaataactttaatattatctatctattcaatggcggaggtccggctgtaaccggatcaacagccggcgggacagatatcctcgtttcatggatttataaattgacaatgcagtccagccaatattcacttgctgcggctttaaccattttattatctgtatttgttatctccatcgcattgtggcagttcagacagacaaagtcttttaaagaggaggcataaggtatgctggcagatatgaaagtcagaagatatatccgtctccttttctcttacttgttgctagcctttatggcggtcatcattgtttatcctctcctttggacggcaggcgcaagctttaatcccggcaacagcttaatcagtacatccatcattccgaagcatccgacattcgatcattacaaggaattatttgcgggcaaggaaagccttcaatatgtgcagtggtatgtcaactctatgaagatcagcctgtttacaatggcagggtctttgctctgtgtgacgtttacggcctatgcgttttcgcgctttcggtttaaagggaggaaatacgctttaacgctctttttattgctgcagatgattcctcagttttcagctttaattgccttgtttgtgctggcgcaaatcttgggaatgatcaatagccactggctgctaatcttgctttatatcggcggcctgatcccgatgaatacgtatttgatgaaagggtacatggattccattccgatggatttagacgaaagcgccaagattgacggagccagcagcaccagaatcttcttccagatcattctgccattatcaaaaccgatggcggcagtcgtggccatgaacggctttaccggtccgctcggagattttgtgctgtcctcaaccatattgagaacgcctgaatcatatacattgcccgtcggtctattcaatttagtgaatgatgtcatgggggccagctatacgacatttgcggccggagccctgcttatcagcataccggttgccgtcatctttattatgctgcaaaagaattttgtgtccggattaaccgcaggcggaacgaagggctaagagaacaaggaggagaatgtgatgtcaaagcttgaaaaaacgcacgtaacaaaagcaaaatttatgctccatgggggagactacaaccccgatcagtggctggatcggcccgatattttagctgacgatatcaaactgatgaagctttctcatacgaatacgttttctgtcggcatttttgcatggagcgcacttgagccggaggagggcgtatatcaatttgaatggctggatgatatttttgagcggattcacagtataggcggccgggtcatattagcaacgccgagcggagcccgtccggcctggctgtcgcaaacctatccggaagttttgcgcgtcaatgcctcccgcgtcaaacagctgcacggcggaaggcacaaccactgcctcacatctaaagtctaccgagaaaaaacacggcacatcaaccgcttattagcagaacgatacggacatcacccggcgctgttaatgtggcacatttcaaacgaatacgggggagattgccactgtgatttatgccagcatgctttccgggagtggctgaaatcgaaatatgacaacagcctcaagacattgaaccatgcgtggtggacccctttttggagccatacgttcaatgactggtcacaaattgaaagcccttcgccgatcggtgaaaatggcttgcatggcctgaatttagattggcgccggttcgtcaccgatcaaacgatttcgttttatgaaaatgaaatcattccgctgaaagaattgacgcctgatatccctatcacaacgaattttatggctgacacaccggatttgatcccgtatcagggcctcgactacagcaaatttgcaaagcatgtcgatgccatcagctgggacgcttatcctgtctggcacaatgactgggaaagcacagctgatttggcgatgaaggtcggctttatcaatgatctgtaccgaagcttgaagcagcagcccttcttattaatggagtgtacgccaagcgcggtcaattggcataacgtcaacaaggcaaagcgcccgggcatgaatctgctgtcatccatgcaaatgattgcccacggctcggacagcgttctctatttccaataccgcaaatcacgggggtcatcagaaaaattacacggagcggttgtggatcatgacaatagcccgaagaaccgcgtctttcaagaagtggccaaggtaggcgagacattggaacggctgtccgaagttgtcggaacgaagaggccggctcaaaccgcgattttatatgactgggaaaatcattgggcgctcgaggatgctcaggggtttgcgaaggcgacaaaacgttatccgcaaacgcttcagcagcattaccgcacattctgggaacacgatatccctgtcgacgtcatcacgaaagaacaagacttttcaccatataaactgctgatcgtcccgatgctgtatttaatcagcgaggacaccgtttcccgtttaaaagcgtttacggctgacggcggcaccttagtcatgacgtatatcagcggggttgtgaatgagcatgacttaacatacacaggcggatggcatccggatcttcaagctatatttggagttgagcctcttgaaacggacaccctgtatccgaaggatcgaaacgctgtcagctaccgcagccaaatatatgaaatgaaggattatgcaaccgtgattgatgtaaagacagcttcagtggaagcggtgtatcaagaagatttttatgcgcgcacgccagcggtcacaagccatgagtatcagcagggcaaggcgtattttatcggcgcgcgtttggaggatcaatttcagcgtgatttctatgagggtctgatcacagacctgtctctctctccagtttttccggttcggcacggaaaaggcgtctccgtacaagcgaggcaggatcaggacaatgattatatttttgtcatgaatttcacggaagaaaaacagctggtcacgtttgatcagagtgtgaaggacataatgacaggagacatattgtcaggcgacctgacgatggaaaagtatgaagtgagaattgtcgtaaacacacattaggctgatgctccgctcgatatgggcggattcttttttctatagaatgaaaacgcttgctaagtcttggggggatgaaatcatgaaaagcaaagtgaaaatgttctttgcggctgccatcgtgtggagtgcatgtagttcaacaggatatgccgctgccattgagaaggagaagcacgtgtcagagcttcgggcagaggatctttttgttaaaaaagtagaggggatgaacaaggattttatcaaaggggcagatgtatccagcgttattgctttggaaaacagcggtgtcaccttttacaatacaaacggaaaacgccaggatatctttacaactttaaaacaggctggggtcaactatgttcgcgtccgcatctggaatcacccgtatgattcaaatggcaacgggtatggcgggggaaacaatgatgttcaaaaagccatcgaaatcggaaaaagagcgacagcgaacggaatgaaggtgctggccgactttcactactctgatttctgggccgatccagcgaaacaaaaggtgcccaaagcctgggcgaatctcagctttgaagcaaaaaaagcaaagctctatgagtatacgaaacaaagcctgcaaaagatgatcaaggaaggcgttgacatcggcatggttcaggtcggaaatgaaacaacaggaggatttgccggtgagactgattggacgaagatgtgccaattatttaatgaaggaagccgagcggtcagggagacaaattcaaatattttggtcgccctgcattttaccaatcctgaaacggctggaaggtattcatttattgcagaaacactcagcaaaaacaaagtggattatgatgtgtttgctagctcctattatcctttctggcatggcacattacaaaatttgacctccgtgctgaaggctgttgccaatacgtacggcaaaaaagtcatggtggcggagacatcgtacacctataccgctgaggatggcgatgggcatggaaatacagcaccaaaaagcgggcagacgttgccatatccaatttctgttcaaggccaggcaactgcagtaagagatgtaatggaggcagtggcgaatacgggcaaagcaggacttggtgttttctactgggagccggcgtggattccagtcgggccgaagacacagatagagaaaaacaaagtgttatgggaaacatacgggtcagggtgggcgtccagctatgctgctgaatacgaccctgaagacgccgggaagtggtatgggggaagtgctgtagataatcaagctttatttgattttaatggacacccgctgccttccttgcaggtgtttcaatatgcggagtcaggacatattccaaagaaacgctgaaacaaaaaaatccatgagatgtaacaaatcattgttatgtctcatggatcattttattttacatcaactaatataaaacattcgtcatcactcttatgatgagcttccttttgatgctgcagtgatgtaaggattttctccttcaggtcagcgattggcgaatcaggatgatcctttagtaaatcaaataaataacatgaagccgtaggatccatcacgccatccgtatacagaagcaatcttccgtcctccgtgtatgaaaggctgcttgactgaaactctaagtcttcaaacatcccgatcggaggcgaggtcgcgtgaagcagatgttgagttccgctatcgtcctgccaaagtgccggcggatgccctgcgttgacataatcaattctttgccgtgctatatcaatctcgagataaatagcagtgcaataatgtcttgcttcctcatcattttgaaacaagctgtgaaggtgccggtccaattccttcataactttaacggggctgagaccttgcgtgatctggcgctggaacaaaggatgaagagacatcgtaatcaatgcagatgaaattccgtgccccatcacatcaaggataataatgccgtaacggtgttcatcgatttgataatatccgtaaagatcacctgacaattcactcgatgcgttgtaataagagtcaatctgaacctgatcgtttacaatcggttcagtcaacgagtttttctggatctttctggcgagttcaagctctcttttggtgtttaatttaaattgttgattttgtttattgatctcaagaagttcttcttgttttgctttcagcgtttccaaggcaatttctaactccgcattggctttctgtttggcaagcaaagcttcctgagcctcatttctggctatcagcagctcattttcatattcatttcgctttcgcattggaatcagaacacaatcaaagacagaagccccgctatcgtgtctcgcaatagcattgataaggacgggaatttcttctccatctcttgctttcagggaaatgtatatttcttcgatgtgatgctccaatttcaaaagcggaaaaaaataaagctggcagaaaagctgcgcgggaatggtcaacatcatattcatgtgctggccgataacctgctccggttcataatccagaatcttgataagggtgcggttggcagctatgatcgacccctcttctgacaaagcgaggaaaccgcatggtgcatcattcaattgtttgtccatctaagagggtcacctctatccctttcgttcctatatcacacgtgtgcttttaaataatcgccgatcagctgtatcgtctcatctggatggctcatatgagggcaatgtccgcgagcctccatttgtttcagactgctataaggcagatgctgatgcatatacttacctactgttgcaggtgcgatgatatcatctgcacattggagaataagagagggaaccgttaccttcgaaagatcctctcggtgatcagaaaaaaacgccgctttcgcgaattggcgggcaatgacaggatcagtagaacaaaaacggctttcaagctcttccttaatttcaggccgatctggctgattcagaacggttgccgcaaatacagtcgcccagccgatataatttttctccatcatctccagcaagccaaggagctgctcctcttcaaatcctccgtaatactcaggcggatcattcaaatagcaaggagaaggccccaccatcaccagatgggaaaaaagctccgggcggcggatggatgcaagcatcccaatcaaggccccgacggagtgacccacaaacacggtttccttcagatctaaagcttcacaaacatcaagaacatcctgggcatagccgtcaagtgtctggtaacgattcaggtcatatgcgcgcaaatctgaatgtcccgaaccgacgtaatcaaataaaatcacccgatgatcttcttcaaaggcaggtgccacggcattccacacgctttgatcgcatccaaaaccaggtgcgaacatgatagatgctttgccgctgcctttcaccttcacatgatttctagacaaaatcgcttcgttcatgattggctcctttcagccggaaagtaatataaagttcaatatttctatcataacactcggatggtttgaagagtgtatctttctatgaatgtcacagcagtttaaaagaaagaggacatgggagatagaaaagatggatgaattggaagatgcaggaggaggattgcctagacaccggggtgagaaaaaaatgacatttgtcactccatcatcatgacaccccatactaacatcgtcttctccgtcattttacaatcaatgtaaacgatcaggaggtgctcatgtgatgaaagaagcagtaacagtaagcaacgtgacaaaacatttccagcgaaaaaccgctgtaaacaacatcagcttcagtattgaaaaaggagaaattgcagccattctcgggccaaatggggcagggaagacgaccgtcgtctcgatgatattaggattgctgaaaccgagtgagggagaaatcaaactatttaaccgggttcccgatgatcaacaggttcgtgaaaaaataggtgtaatgcttcaggaagtaagtgtcatgccgggccttaaggtggatgaaatccttgaactcttccggagctattatccgaatccattgtccatgaaagaactcgtttcgttaacagcactcaccaaagaagatttgaaaacaagagcagaaaaattatccggcggacaaaaacgccgtttgagctttgctttggctcttgccgggaacccggagctgcttatacttgatgaaccgacagtcggcatggacacttcatcaagacaccgattctggcagaccattcacggactgtcggaccaaggaaaaacgattattttttcaactcattatttacaggaagcagatgatgccgcacagcgaatcctattttttactgaaggacagcttgttgcagacggctcaccaatgcaaatccgctcaagaattcaaaaacagtctgtttcctttacgcttcattcaagtgaatcattggaaaggctgtcttgtcacccggaagtcgagagagtgatccacgagcatgagagaaccatcatccagacatcaaatacagacaaagtgttggcgctgatctttcaagaaaacatacatgcacgggatattcgaattgagcaagcaacgctcgatgaggcatttcgccagctggctgacggcaacagggaggcgatgtgagtgaacgtgctgcaaaagcaaagcatcgctgaaatgaaaagggtgcttaggaacaagtactttgtgctttggtctctgatcatgccgattgccttttattatttctttacaaatgtagtgaataccaacgtccctgatcaacgtgcatgggaagcccattacctgatgtcgatgacagtcttcagcgtgatgggttcctctatcatgacgcttggcatccgaatggtacaagaacggtcacaaggctgggccgcctttatccgccttacgcctcttccggatcatatctatttatcagctcagatgatcggccaaagtgtcattcacgttttatcaattaccgtcatatttctgttcggcgcaatcatcaatgatattgccttgtcaccgtttgaatggatgatgagcggactgtggattttgtttggcgcattgccttttttagcattaggcacactaatcggcctcatgagaaaagtagaaacagcggccggaatcagtaatgtgctttatatgctgctggctttaggcggagggatgtggatgccgtttgaggtcatgcctgacatgatgcagagcattggccagtggcttccgtcttatcatttcgggagcggagcgtgggaacttgtccggggtgggagtccgacttggaaaaatattctgatattaatcgcttatatgatgctcttcatgctactatctaaatatataagaagaaaacaagaagcggtgtaatacatgaaaaaggcaatatctattttcccgaaggaattcgggtttttcccttatatctttctggtgtatacgattatgccgttcctctctttattaaaagaatcaggggtcaaacaggggatcggatatggtatgctgctcctttttgtagcggcatatcgccagttattctgcagcgtgggcaaagcttcgtttacatattggcttatcgtgcaaatggcggttattttgatgtatagtgtgttttacaatatcacctatatatacttaggtttttttccggcaaactttgttggttattacaaagagaaaacgaattttaaccgtgcgttctgcgctttaatctttatactgctttttccatgcctataccaatttatcgcgaattcggtctcgcttcgggagcttttttctgttctcccgtttctcgtcattatgctcatttctccattcggaattcgttctatgtttcggaggattgagcttgaagctaagcttgcacaagccaacgaacagataaaagaactctctaaaagggaggaacgtgttcgaatcgcccgtgatcttcacgatactcttggccacaccctgtcgctgcttacattaaaaagccagctcattcagcggctggctgcatctgatccagaacggaccaagcttgaggcaaaagaaatggaaaccagttcacgctccgcactcaagcaagttcgagagctggtttctgatatgagaacggtcacgataacagaggagctcgtaaacattcagcacatattaagagcggggaacattacctttcaatacgaaggagccgacgacttttcagtgatatctcccgtcactcaaaatattatcagtatgtgtatgcgggaagccgtgactaacattatcaagcacagcaaagcaacccactgtgccatcaccatttctcaatttgctgacaaaatgaggatcgtaatacgggatgacggaaagggagcgccgaaggagaaaatgtttgggaatggcctgtggggaatggaagaacggctcatgctcattgaagggggattaacggtttcagaccataacggaacggttgtggcactgacgattccgcttattaaaaaagcagaatgattggaggacgaaaagaatgattcgtctgtttattgctgaggaccagcgaatgcttttaggcgctttgggatctttgcttgatttagaagaggatatgacagtcatcggacaagcattaaacggggaagaggcgctacatgctattttgaagctggagccggatgtatgcattatggacattgaaatgccggttcgaagcgggctgaatgtggcagaggaattaatgaaaaaaggctgcgtcagcaaggtcattattttaaccacctttgcccgccccggatattttgaacgcgccgtaaaggccggtgcacatggctatctgctgaaagacggtgaaattgacgatctggccgatgccattcgaaaatgtgtaaagggaaaacgtgtcttcagccctgagctgacgtttaatatgatgcgagacgaaaatccgctaaccgttagagagcaagaaattctgaggcttgcggctttaggcaagacaacaaaagacattacgctggagctctatttatctcaaggcacagttcgaaactatatctcagaaatcatccaaaagcttaatgcgaaaaatcggacagaagccgccagcatcgctgaggaaaagggctggatctaaccatatactgcactcctgggagatcgggagtgtttttgatatgccacaaatgaaaatatccctagaaaactctttccttccattgtcagaatagtgtacgatattcatatagttattttaactcaggtcatcagatgacctgatcatatattggggatgagagaggggttcatcatgaaagtctcactttttgtcacttgtcttgttgatatgtttcaaacaaatgtcggaaaagcaacggttgagctgctggagcggcttgggtgcgaggttgattttccagaagggcagatttgctgcggacagccggcttacaacagcggctatgtacatgacgccaaaaaagcaatgaaacggatgatcgaaacgtttcaggattccgaatatgttgtcagtccttcgggttcctgcacaacgatgttccgggagtatccgcacctgtttcaggatgatccgaaatgggccgataaagcgaaaaagctggcggataaaacgtatgaactgacagattttattgtgaacgtccttggggtagaggatgtcggcgcgacccttcatacaaaagcgaccttacatacgtcgtgccatatgactaggctgctgggtgttcggaaggagccgatgaagctgttgagccatgtgaagggcctgcagtttacagagcttccgggcaaacataactgctgcggattcggaggaacgttctcagtcaagatggcgcagatttctgagcagatggtcgatgaaaaagtcgaatgtgtggaggaaacgggagcagaggtgctgatcggtgctgactgcggctgtttgatgaatatcgggggacggcttggccgaaaagataagaatgtcaaagtgatgcacatcgccgaagtgctcaacagcagataaaactggattcagagggggaaaggatcatggcgatgaaaatcggtactgacgcttttaaagagcgggtatcacaggggattgataatgaatttatgagaggcgctgtttcaggtgcacaggagcgtctgcggacgcggcgcctagaggcagcagaagaactgggaaactgggaggagtggcgctcattatcagaggaaatcaggcagcatgtccttgaaaaccttgatttctatctcggacagcttgccgaaaatgtggcgaaaagaggcggacatgtctatttcgcgaaaacagcggaagaggcgtcttcctatattcgggatgtcattcaaaagaagaacgggaagaaaattgtgaaatctaaatcaatggtcacagaggaaatcaatctgaatgaggtgctggagaaggaaggctgtgaagtcgtagaaaccgatctcggcgagtatattttgcagattgatgatcacgatccgccgtcacatatcgtagcgcccgctcttcataaaaataaagagcagatacgcgatgtgtttaaagaaagactggactatcaacatacagaaaaaccggaagagctggtgatgcatgcgcgcgccattctccggaaaaagtttctggaagcggatatcggcattaccggctgtaacttcgccatcgctgacacgggttccgtcagccttgtgaccaatgaaggaaatggacggcttgtgagcaccttgccgaaaacacaaattaccgtcatgggaatggagcggattgtcccgtcattttctgaatttgaagtgctagtcagcatgctgactagaagtgctgtcggacagcggctgacaagctatattacagctttgacgggtccgaagctggaaggtgaagtggacggtccggaagaattccatcttgtcatcgttgataatggacgatccaatatccttggaacggaattccagtctgtgctgcaatgtatccgctgtgccgcctgtatcaatgtctgtcctgtgtaccgccatgtcggcggacattcatacggctcaatctactcggggccgatcggagctgttttatcaccgttgctcggcggttatgacgattataaggagctgccgtacgcatcttcactgtgcgctgcttgttcagaagcctgcccggtcaaaatcccgcttcatgagctgctactcaagcatcgtcagaatatcgtcgaaaaagaaggcagggcgccgatcagtgaaaagcttgcaatgaaagcattcggacttggcgcatcctccttatcgctttacaaaatgggctcaaaatgggcgccggccgccatgacgccttttacagaggacgaaaaaatttcgaaagggcccggcccgcttaaaaattggacccagattcgcgacttcccggcaccgcataaatcgagattcagagactggtttgcggacagagaaacaagtgaacgcacgaaggaggagcagtgatgacgaagggaaccattcagaatcaagagagctttttaaaccgaatcgcatccagcctgggccgtgaacgaagaacaggaggcgtggcagtccctgaatgggcgcatcagccgcaatataaaacacttgaaggttattcagcggatgacttagtcacagtgctcaaaaaccattgtgtcaaaatccatacagagctgattgaaacggattcaaccggcctttacgatgccctgcgcgagcaagtcagccgcttttctggaggccctgtcatcattccgaaggacccccgctttgaagaatacggactgaaaagcctgctcaccaaggactggccgagtgaaggaacgccggtctgggagtgggatgctgacaaaggcgaggaaaatattaaaaaagcggagcaagccaatgtagggattacattcagcgaaattacattggctgagtcggggacggttgtcctcttctcctcaaaagacatcggccgctctgtcagccttttgccaacgacttatattgcgatcgtgccgaaatcaagcattgtaccgagaatgacacaagccagtgatatcatccgccaaaacattgcgaacggtgtcactgttccttcatgtatcaactacattaccggaccgagtaactcagccgacattgaaatggatttagttgtgggggtgcatggaccagtaaaggcagcatatattctcgtctctgaccgctgaactcaggaagcccggcaggcatatgccgggctttttgcttgaaaaaacttcaacttccaattttttggccgatgagaagagtatgacttgatacaggaggaaatgcgatgaaaaaatggctgatcatagcggtttcactggcgattgcgattgttctgtttatgtatacaaaaggagaagcgaaggcagccggtatgacagtaggctacacgactggggatacggcttcatacaattctcttacgaaatatcatacatacatgaatgccatcgcaaccgatacatttgcgtttgaaaaaaacggacaaatcattggcgatgccccaactaagcagctgacatatgcgaaaaagaaaaaaatcaagacatgggctgtcatttcaaactataatgatgccatttatgattttgacggagatttagcgagtcgggtcatgagcaataaaacagcgaaaaaacgattcacagatcagttaattacactggccaaaaagcactcatattacggaatcaatatcgattttgaagcagtaaatccagaagaccgcgctgcatactcgaacttcattcaatatgtctcacaggctttgaataagaaacatattaaaacaatggtatccgttccggccaaaagcgccgatgataaaaatgatgactggagctggccgtatgattatgcgaaaatcggcaaatatgccgacttcgtacaagtcatgacctacgatgaacacggcatttggggtgagccggggtcagtggcaagcacaaactggatcaaaagctctctgcagttttcagtcaaaaagatcaaagccaataaagtcatcatgggaatccctgcgtacggctatgactgggatgtaaaagacggaagtaccagcacaataagggaatggaatgagctcaaatccctcatcaaaaaacaaaaagcaaagccggcattcaacaaaaaatcaggctcgatgacgttttcttatgttgacaaaaagaagcataaacatgtcgtgtggtatgaaaacgaaaaaaccgttcaaacgaaaagccatctggcaaagcaatataaaatagcaggtgtttcagtttacgcattaggaaacgagtcagaatccttttggaaagccattcgaaaagggacaaaataacagtttcttttttctctgaagttattgacagttaaaagagaagcacgtatattatgttaatatattcagatcataaaatttgagtttttcagaaaactaaaacacatagattgggagcagtaaaagaaagtgatcagaacagagagctgcggggtggtgcgacgcagcctgattcttctttgaactcgcccgggagtggtaagacggaacggaatagattgaatattccctatgttttaacggctaaccttcgttacaggtcaaaagcaggattcttcatgaagaatcaacaagagtggtaccgcggtcagccgaaggctcgtcgtctctttatctattagattaggtaggagacggcgggcttttttgtttttgaaaacgagaaggagaggtagaagaggatgaaaaacgacaatcaaacgttaaaacgcacgatgacgtcccgccatattatgatgatggcgctgggcggagcaatcggcgcaggtttatttaaggggagcagctcagcgatcgatgtggcagggccatctgtcattatcgcatacctgctcggcgggattattttgctgtttattatgcaggggctggcggaaatggctgttcgaaaccgtaacgccagaaccttccgtgatcttgtccagcaggtattgggaaattacgctgcttactttttggactggatctactggaaaatgtgggtgcttaacattgcggctgaagctgttgtagctgcgattttcattcaatattggctgccgggctgcccgatctgggtgttggcattaggaatttctcttatcgtcacgattgtaaacttgctttctgttaaaatcttcgccgaaactgaatattggctggcaatgatcaagattaccgttattattatctttattattctgggattgctgctcttatttgtatcattcggtgatcatacagcatccggattttccaacctgacagaccacggcggatttttcccgcacggcggcacagggctgatcacggcgatgcttgtcgtcatctactcttacggcggtacagaaattatcggtgtaacgcttgcagagacaaaaaatccggaaaaggttgtcccgaaagctgtccgcagcacactgacacggattgtcgcgttttacctgctgccgtttttcatcatcgtcagcctgattccatggaaccaagtcaattccgttccggaaagtcctttcgtgatggtctttaaaatggtaggcattccgggcgcggatcatatcatgaatgcagtcatcctgctggcgatcatttcttctatgaattcaggtttatacggatcatcacgcattttgtatacacaggcaagtgacggaaggcttccaaaggtcttctcgaagctttcatcgaaaaacgtaccgatgtttgcgattctgatgtgcacttcttctctctatattggcgtattgatttctctgttcgcaggaagccaaacatttaattatttaatgggatcattgggatataccgttttattcatttggctgatcatcggattcgctcatttaaaatcgagaaaacagcaaacggaaacaccggcctattatgtaaaatggttcccgtacacgacatggtttgcgattgtggcattactcgccattctgatcggggtcatcatgacaacatcaattgtcattaccggcattactgcggcgatctaccttttgattacagttgcatatttggtcaaaggacgcaagcatcagtaaataagaaaccctcttgccgcatccggcaagagggtttttattattgtgcagctttctcgtttataccaatcgccgcagctttctgcgcttttgattttgtattcacgagacagatgctcgtgacaatcagcagcagccctgccaagaggctaagggtgagcggttcatgcaggaaaatggagctggccacgattgatatgagcggaatcaaaaaagtataagatgcgaccttgcttgcttctcctgaaccgacaagcgtaaaaaagacaagccagccgagtgcgataacgaatacggagatgaacagcaggctcgtaataaacggagctgtccattggatcgccgaaaagctttctgtccaaaagccggagataagcagaaacacgcttccgatcgtcagctgcagagcgaccatccagatggaatcgacgcggctgcctgtttttttcatatatactgtcccgagcgcccagctgactgcggagccgagagccagcagaaccccaatgacagaaatatgcccgccaaagcccgcagcactaatgacggctactcccgcaaaaccgaggatgaggccaatcactttcattacaaacatggattcgccgagccacagccaagaaaatacacccatcagaacaggctggaagaagacgattgcagaaaacaggccggccggaagataattcagcccgatcgtttgcaggccgtagaataatgtaatatttaaaagagcagaaacaagataaatcggccacgtttcttttaagcgtaatttatgaatacgcggcagtgcgactatgactaataaaagcccgccgatcagcgttcggatgcccgcgaacaataatggcggagaataggcgagcgcggctttggacagcggccaattgacgccccacatgatgacgagaaatgcgagcaggagagctgtccgcgtttttgggagctgcttcattgttcattcactccttgtagaacttttccatcatatgatacggtagaacataagataaataaaatgaatcttttttataaggagcataagtaaattgttatgaccattactcaattaaaggtttttgtgaaaatagctgaaacgggaagctttacaaaagcgggtcaggcgctgaacatgacacagccggctgtcagccatgcgatttctgcgatcgaagctgagcttgatgtaaagctgatcattcgtgaccgccgcaatggcctgatgctgacggatacgggaaaacagatcttagtacacatcagagaagtcttaaaaggcattgaaaaagttgagcaggtagcagcagcggaaaaagggcttgaactgggaacgatccatatcggcacattctcaactgcctcggcttattttatgccgaagctgatcagtgaatttaaacaaaaatatccgaaacttgagctcgtgctgcacgagggaactgtaaatgaagtcaaggagtggcttcatacgcggatgatagatgttgggattcttctgtatccaacagaggagatggagtacattcatttgaaaaaagacaaaatggctgtcgtgctcagggacgatcacccgcttgccagtcattcagccattacgctgaaagatcttgaccatgaaccgatgatcgtctgtgacggcggctatgaatcaccatttatcgatatgttcaggcaggcgggtgctacgctgcacccagctttcacggtctataacatcaacacctcgatcagtatgatcagagaaggcctgggcctggccattttatcagaaatgtccatgtcggggatgccgctgccagagcatgtggtgaccagggaattggacccgcaggtataccgtgatgtgcagcttgctgttccgtcgctaaaggaggcttctctggcggctaagctctttattgagatggctaaggagttgtttggagcagaataatgttccaaaccgttcgttttatattgttcgaatttcatcgaatcaaattcttttattcctgaatgcagttgtgttatggtgtgatagaagttctttcaatcatgacctgacagctttgggctgtttactgataacacatttgcaaaggagaacaatatgtctaacaaccaacgcaaagataccttgctttctgtcttgaatttatctccggttgttcagggaggaacgattgcagaatcattccgaaacagcatggacttggcgcgccgggcagaggaatggggctatcaccgttactggcttgctgaacatcataatatagaaggtgttgcaagctctgccaccgcagttttgattggccatattgccggaggcacgaagaaaatccgcgtcggttccggcggcattatgctccccaaccactcttcattagtcattgctgaacaattcggcacactggaaacactgtatcccgggcggattgatctggggcttggacgtgcgccgggaacagaccaattgacagccagagcgctccgcagaaacatcaacagcggggaggattttccagaacaattagaggaactgcgcaattattttaaaccgtcaggaaatgtgcgcaatcaagttcgcgccattcccggagagggcatagatgtgccgatttggctgctgggctcaagcggcttcagcgcccgtctggctggcgaacttggtcttccgtttgcgttcgcggcccatttctcaccggcgaatacggttcccgctttggagctgtaccgcaattccttcacgccgtcagacgtgctcgacgaaccgtatgcgatggtcggtgtcaccattatcgcggcagatacaaacgagaaagcgcagcaccttgcgacttcccattatcaaaggtttcttgatcttgtccgcggtacgcctaaccagcttaaaccgcctgttgaggatatggaccaaatctggagcccgtatgaaaaagcgatggtcaatgagcagctgagctccacgattgtcggaggtccggaagaagtgaaggcgaagcttgaagatttcgtcaaaacgacacaggctgacgaaattatggttaactcagaaacctttgaacacgcagacagaatgcgttcgtttgaaatcatcgctgacgtttggaaaaacagataacagctataaaaaaagcaatgtagcggggagacccatacattgctttttttattcattcagttttcgtgcggactggcgaatgatcaactcaggctcaaatatgacatcctcttgcttcggctttttatgctctaagcagtcaatgacatatttggcggctgcttttccaagcactgatttcggatgtttgacagaggttagtttcacttctgagatttgggcgaaatgtgaatcatcgtacccgacaatagacatatcctccggcactttaagatccatctccctcagcatatcaatcaccttcagcgcaatttcatcgttataacaaagaatggctgtcggcatgtgcttgctgtttttctccagtgtggcttttactttctccagaagttttgattctttttcttccgttgtaaatgtcacgatcatatccggagaaggaaacaactcacgctcccggtgcgcctgtataaatccgttcatccgtttcacgccttgtgtgtcatcagctttaaaaatacccatcatatgcgtgtggccgagagaaagcaaatgctccgccgccatcatcccgcctttcacatcatccaaggtaaaacttggcgcggcaagctcggcatatgacgcgttaatcatcgcaaaaggaatgccgtttttctccaagttcagataatagccgatgtttggggtttgaagggcgctttttgtcggttctacgatgagtccgtcaatatgctgggacagcaggttttctaagcctcttctttcattgtccgggttgttgtttgtgcttgtcaaaagcatagaatacccctgctcgcttaaataggactcgattcctctgatgatgctcgggaaaatatagtctgatatgtaagttgtcaaaacaccgatcgttttattggaatgcagcgctgacttagcagagcgtgaagcgacaaaggtgcctccgccttgcacgctgtacagcagaccttgtgatacgaggtctccgatcgctttgcggatggtatgccggctgacgccgaattgctgcattaattcgttttcggtagggattttttgatcgggcagtattttgccttgattaatccaagaactgatttcttcttttacttgcgcgtattttggtaacatatccattcctccaaaatgtatacggacaaatttcagtatatcacagcgttctttgtaagaaaacattgacagaaaatgcaaacaagattattctatatttgtacgtactaattaaatgtaattttcgttaaattttaatataagtacgtacaattgaaggtttaaatgaaaacgctttactcaacattcgggagggcagggaaatgaagaatactccaactcaattagaaccaaatgttcctgtaacaagaagccattcaatgggatttgtcattttgatctcatgtgcggcggggcttggcggcttattgtatggctatgacacggcagtgatttctggcgccatcggttttctgaaagatttatacagcctgagtccgtttatggagggacttgtcatttcaagcattatgattggaggagttgtgggcgtcgggatatccggatttttaagtgacagattcggccggagaaaaattttaatgacagccgctttgttatttgcgatatcagcaatcgtttcagcgctttctcaagacgtgtccaccttaatcattgcaaggattatcggggggctgggaatcgggatgggctcatcgctctctgttacgtatattacagaagcggcaccgcccgctatacgcggaagtttatcttcgttatatcagctctttacgatactgggtatttccgcaacatactttattaatctagctgtgcagcggtccggaacatacgaatggggcgtgcacaccggctggagatggatgcttgcttatggaatggtgccatccgtcatttttttccttgtcctgctcgtcgtcccggaaagtccgagatggctggcgaaagcgggcaaaacaaatgaagctttaaagatcctgacacgtattaatggagaaactgttgcaaaagaagaattaaagaacattgagaactctttaaaaatagaacaaatggggtcgctctcccagctgtttaagccgggtctcagaaaggcgcttgtcattggaatcctgctggcgctgtttaaccaagtcatcggcatgaacgcgattacttactacgggccggaaatctttaaaatgatgggattcgggcaaaacgccggatttgtgacgacttgtatcgtcggggttgtagaagttatttttaccgttattgcggtgttgctgattgataaagtcggacgaaaaaaactgatgtccatcggttctgcttttatggctatttttatgattttaatcgggacgtcgttttattttgagttaacaagcgggatcatgatgatcgtccttatattaggttttgtcgctgctttctgtgtctcggtcggaccgatcacatggattatgatttctgaaatcttcccgaaccatctgcgtgcgcgggccgcgggcattgcgaccatctttttatggggagcaaactgggcgatcggacagtttgtgccaatgatgatcgattctttcgggctcgcctatacattttggatctttgcggtgattaacatcctttgtttcctgtttgtcgttacgatctgtccagaaacgaagaacaaatcgctcgaggaaattgaaaagctttggataaaatgaaaacgctttaatgaaacagccctttctacgggaagggctgtttatattgggatgcaccatttggcgctttctgtataagataaagatatataggataaaatattgctggataaaacgacgcggcatgaaaactctgcgaatattgtcgatgaattggctcttaacagttgaataaacaattccaccctgttaaaataattaaagaaagcagaaatgattttttttggctatgacgggacgttttttgtcatagcgggacatataatgtccagcaaaaaaggaaggaacgtttgagtcatgaaccagttaatacaagctcaaaaaaaattattgcctgatcttctgctcgttatgcaaaagaggtttgaaatcttgcagtatatcaggctgacagaacccatcgggcgaagaagcctgtctgccagtctcggaatcagcgagcgtgtgctgaggggcgaggttcagtttttaaaggaacagaacctggtcgatattaagacaaacggcatgacattgacagaagagggctatgaactgctttctgttttggaagatacgatgaaagatgttttaggtttgactcttttggaaaagacattaaaagaacgtttaaatctaaaggatgccattatcgtatccggagacagcgatcaatccccatgggtcaaaaaagaaatgggaagagcggctgtcgcatgtatgaaaaaaagattttcaggcaaaaatatcgtcgctgtaactggcggtacgacaattgaagctgtcgccgaaatgatgacgccggattctaaaaaccgcgagcttttgtttgtgcctgcaagaggcggtttaggcgaagacgtgaaaaaccaggcgaacaccatatgcgcgcatatggcggagaaggcttcaggcacttaccggcttttgtttgttccgggacagctgtcacaaggcgcctattcatctattattgaagagccttctgtcaaagaggtgctgaacaccattaaatcagcgagtatgctggttcacggaatcggcgaagctaaaactatggctcagcgcagaaacacgcctttagaagatttaaagaaaatagatgataacgacgcggtgacggaagcgttcggctactattttaacgcggacggcgaagtggttcacaaagtgcattctgtcggaatgcagctggatgacatagacgccatccccgatattattgcggtagcgggcggatcatcaaaagccgaagcgatcgaggcttactttaaaaagccacgcaacacggttctcgtcacagacgaaggagccgcaaagaagttattaagggatgaataatccctcaatataaatatctctcacttatttaaaggaggaaacaatcatggcagtaaaagtcggtattaacggttttggtcgtattggacgtaacgtattccgcgcagcattaaacaatcctgaagttgaggtagtagcggttaacgatttaacagatgctaacatgctggctcaccttttacaatatgattctgtacacggaaaattagacgctgaagtttcagttgacggtaacaaccttgttgttaacggcaaaacaattgaagtttctgcagaacgcgatcctgctaaacttagctggggcaaacaaggcgttgaaatcgtagttgaatctactggtttcttcacaaaacgcgcagacgctgcgaaacacttagaagctggcgcgaaaaaagtaatcatctctgctcctgctaacgaagaagatatcacaatcgttatgggtgttaacgaagataaatacgatgcggctaaccacgatgttatctctaacgcatcttgcacaacaaactgccttgcgccgtttgcaaaagtacttaacgataaattcggcatcaaacgcggtatgatgacaactgttcactcttacacaaacgatcagcaaatccttgatcttccgcacaaagactaccgtcgtgcgcgtgcagcagctgaaaacatcatcccaacatcaactggtgctgctaaagcagtttctctagttcttcctgaactaaaaggcaaactgaacggtggagcaatgcgtgttccaactccaaacgtttctctagttgacttggttgctgaactgaaccaagaagtaacagctgaagaagtaaacgcagctcttaaagaagcggctgaaggcgaccttaaaggaatccttggctacagcgaagagccattagtttctggcgactacaacggaaacaaaaactcttctacaatcgatgctctttctacaatggttatggaaggcagcatggtaaaagtaatctcttggtacgataacgaaagcggctactctaaccgcgttgttgaccttgcagcttacatcgcaaaaaaaggtctttaatttatagctgaaaaaggacctgacttggttctttcgaatagaagcgctataatgaaagcggacaagggaaggggacggactccctttccctttttccatgaagaccggctttcagaaaacgctctgtgatagagaaacgaccgcgttttaagcagctttgccggcgctttcgcctaaggccgctgccctggcttttagacgaactgccctgtgccgaaaaagactgcgatctgccctagcggagttatcgcttgaacagacggtttcacgtttttcgtgctgtatgcaaaccattttgaaggaggatctcctaggcatgaataaaaaaactctcaaagacatcgacgtaaaaggcaaagttgtattctgccgcgttgactttaacgttccaatgaaagacggggaagtaacagacgatacacgtatccgtgctgcgcttccaacaatcaaacaccttgcagaccaaggcgcaaaagtccttcttgcgagccacttaggccgcccgaaaggcgaagtggttgaggagcttcgtttaactcctgtcgctgcacgtctcggcgaactgcttggcaaagaagtgaaaaaagcggatgaagcatacggcgatgctgtaaaagcacaaatttctgagatgaaggacggagacgttcttgtattggaaaacgtacgtttctatcctggtgaagagaaaaatgatcctgagcttgcaaaagcatttgctgagcttgcagatgtatatgtaaatgacgcattcggtgctgcccaccgtgctcacgcatctacagctggaattgccgagcatctgccagcagttgcaggtttcttaatggaaaaagagcttgatgtacttggaaaagcggtttccaatcctgaccgcccgttcacagcgatcatcggcggagcgaaagtaaaagacaaaatcggtgtaatcgaaagtcttcttgataaagtagacaacctgatcatcggcggaggtcttgcttatactttcgtaaaagcgcttggctatgaagtcgggaaatctcttcttgaagaggataaaatcgagcttgcgaaatcatttatggaccgcgctaaagaaaaaggcgttaacttctacatgcctgaagatgtactcgttgcagatgatttctctaacgatgcaaacgtgaaaattgtgccgatctctgaaatccctagtgatttagaagcaatcgacattggtacgaaaacacgcgaaacgtatgctgacgtcatcaaaaacagcaaacttgtcgtgtggaacggaccaatgggcgtattcgaaatcgacttgttcgctcaaggaacaaaagcggttgcggaagcattggcagaggcgaaagatacatactctgtcatcggcggaggagactctgcggcagcggttgaaaaattcggccttgctgacaaaatgagccacatctcaacaggcggcggcgcatcccttgagtttatggaaggcaaagagcttccaggggtagctgcactgaacgataaataatctcaaaactgctataaggaagtggaacagatgagaaaaccaattatcgccggtaactggaaaatgaacaaaacactcggcgaagctgtcagcttcgttgaagaagtgaaatcttccattccagcagcagacaaagctgaagctgttgtttgcgcgccagcgcttttcttagaaaagcttgcttctgctgtgaaaggcactgacctaaaagtcggcgctcaaaacatgcacttcgaagaaagcggcgcgttcacaggcgaaatcagcccggttgctctgaaagaccttggcgttgactactgcgtcatcggccactctgagcgccgtgaaatgttcgctgaaactgatgaaacagttaacaaaaaagcacacgcagctttcaaacacggcattgtgccgatcatctgtgtaggtgaaacgcttgaagagcgtgaagccggcaaaacaaatgatcttgttgctgaccaagtgaaaaaaggccttgctggtctttctgaagaacaagttgctgcttctgttattgcgtatgagccaatctgggcaatcggaacaggcaaatcttctacagcgaaagatgcgaatgacgtgtgtgcgcatatccgtaaaaccgtcgctgaaagcttcagccaagaagctgcagacaagcttcgcatccaatatggcggaagcgtaaagcctgcaaacattaaagaatatatggcagagtccgatattgacggtgctttggtcggcggcgcgagccttgagccacagtcattcgttcaattattggaggaaggtcaatatgagtaaaaaaccagctgcactcatcattcttgatgggttcggattacgtaacgaaacagtagggaacgcagtcgctttagcgaaaaaaccgaattttgaccgctattggaaccagtatcctcatcaaactttgactgcttcaggcgaggctgtaggtcttcctgaagggcaaatggggaactccgaagtaggtcacttaaatatcggtgcgggacgtattgtgtaccaaagcttaacacgcgtaaatgttgccattcgtgaaggagagttcgaacgcaatcaaacattccttgacgcgatcagcaacgcgaaagaaaacaacaaagccttgcacctgttcggtcttttatctgacggaggcgtgcacagccatatcaatcatttattcgcactgttaaagcttgcgaaaaaagaagggctgacaaaggtttatatccatggcttccttgacggccgtgatgtaggtccgcagacagcgaaaacgtacatcaaccagttgaacgatcaaatcaaggaaatcggtgtaggtgaaatcgccagcatttccggacgttactactctatggaccgcgacaaacgctgggaccgtgtagaaaaagcgtaccgcgcaatggcgtacggcgaaggcccatcttaccgcagcgccctggatgttgttgatgattcatatgcaaatggtatctacgatgaattcgtgattccatctgtcatcacaaaagaaaacggtgagcctgttgcgaaaatccaagacggcgattctgtgattttctataatttcagaccggaccgcgccatccagatttccaacacgttcacaaacaaagacttccgtgacttcgaccgcggcgagaattatccaaagaacctgtatttcgtctgcctgactcacttcagtgaaacagttgacggctatgtagcgtttaaaccgataaatcttgataacacagtcggagaagtattatctcagcacgggttaaaacagcttcgaattgcagaaactgaaaagtatccgcacgtcacgttctttatgagcggcggccgtgaagctgaattcccgggtgaagagcgtattctcatcaactcgcctaaagttgcaacgtatgacttgaagcctgagatgagtgcgtatgaagtgaaagacgcgcttgtcaaagaaattgaagctgacaagcatgacgcgatcattcttaacttcgcaaaccctgatatggtcggccactccggaatggttgaaccaacaattaaagcaattgaagcagtggacgaatgcttgggcgaagtcgttgacgcgatccttgctaaaggcggacacgctatcattaccgctgatcacggtaatgctgacattctgattacagaatcaggcgaaccgcacactgcgcatacaacaaacccagtccctgtgattgtaacgaaagaaggcattacgctgcgtgaaggcggaatcctaggcgaccttgcaccaacgttattagaccttcttggtgttgaaaaaccgaaagaaatgacaggaacatctttaattcaaaaataatttgaaaatcaaaaggagagacaaaactcatgccatacattgttgatgtttatgcacgcgaagtattagactcccgcggcaacccaacagttgaagttgaagtatatacagaaacaggagctttcggccgcgcattagtgccaagcggagcttctacaggtgaatacgaagcggttgagcttcgtgacggcgacaaagaccgttaccttggaaaaggcgtgttaacagctgttaacaacgtaaacgaaatcattgctccagagcttcttggctttgatgtaactgaacaaaacgcaatcgatcagcttttaatcgagcttgacggtactgaaaacaaaggcaaacttggtgcgaacgcaatccttggcgtatctatggcttgtgcgcgtgctgctgctgatttcttacagattcctctttaccaataccttggaggattcaactcaaaaacgcttcctgtaccgatgatgaacatcgtaaacggcggagagcatgctgataacaacgtggatattcaagaattcatgatcatgcctgtaggtgctcctaacttccgtgaagcacttcgcatgggcgctcaaatcttccacagcctgaaatcagtattaagcgcaaaaggcttaaacactgctgtaggtgacgaaggcggattcgctccaaaccttggttctaacgaagaagcgcttcaaacaatcgttgaagcaatcgaaaaagccggcttcaaacctggcgaagaagttaaacttgctatggatgctgcatcttctgagttctacaacaaagaagacggcaaataccatctgtctggcgaaggcgttgtgaaaacatctgctgaaatggttgactggtatgaagagcttgtttctaaatacccaatcatctcgatcgaagacggacttgacgaaaacgactgggaaggccacaagcttcttactgagcgtcttggcaaaaaagttcagcttgttggtgacgacctcttcgttacaaacacgaaaaaactttctgaaggtattaaaaacggcgtaggcaactctatcctgatcaaagtaaaccaaatcggtacattgactgaaacattcgatgcgatcgaaatggcgaaacgcgcaggctacacagctgttatctctcaccgttctggtgaaactgaagacagcacaatcgctgacatcgctgtggcaacaaacgcaggacaaatcaaaacaggtgctccgtctcgtacggaccgtgttgcgaaatacaaccagcttcttcgcatcgaagatcagttggctgaaactgctcaataccacggtatcaactctttctacaacttaaacaagtaataaaaagaccgccgggattttctctcggcggcttttttatgctttcagagatccaaataaagccttaccatatcgcggcattgaatcccgttttcaaaaatgtcctcatcataatgtctgagaaagaaatcgtggtcgatcgcctgaatgcggaatccgcatttttgatagagggaaagctgatgaatgctcgaattccccgttccgatttcaatcgtgtccgcccccagcttcttcgctttttcgatggcgtcaagtacaagctgtttgccaaagcctttcttctgaagagattcttttaccgcaatatttacaatttcaactgtttgcggccttgtttttagcaatacataaacccctgcaagctcatcaccggcccaagctgtgtaacattctcccctctcaagatattcatctacaatgtctttcgatggatcggcgagcagcaatagatcatataattcgtcatttgtttcttctcctaattcaatcctgagcttttgcatattcattccacctttttagtctgatagacatttaattttttcattcgttcccaatttcattctgttttattataaaatatgaaaagcagtaaatgttatcaaattagtagaataggaggaaagtcatgttattttgtaagaattgcggctcccagaataatgaaggagccaagttttgtaaacaatgcggcaccccgatcggagggggcagcaaacaggcaaatcaagaaacagctagcactgcagaaacgaggcaggctccgcgaaaaccgatccctaagaaaaccatcattttatggagcagcattgccgcggcgtgcgttatattattcgccgcatataaaaccggagcgtattttacttcaaaggataggttagtagacaagtttgaacaggccgtaaatgatggggatcaggaccaaatcgcgactctgcttacaccggtaaatgacaatcttaaactcactaaaaataatgtaaaaccgtttcttacatatttgaaggatcatccagacaaaaaagatgaactttttgcatcgctgcgtgatgaaacagcccagaaggatatcgtatatgcggaaaaagacgggaaaagcctgctggtatttgaccattatgacttaaaggtagcacctgtttattttgaagtgagcagcaattataaaaataccgatctatatgtcaataaagaggaagccggatctgtaaagaaagcagatcaagcacaaacccttggtccgtacattcccggcgaatatacagtctcagccaaactgaaaaacgatgtcgttgaccttgtgaaaaaggaagacattcaggcgattggcgatagcagctttcgtgttgatctctcattggaagcagacgatgtgacattcagcttagcgaatgacatcaagagcgggaagggagatttgctgattaacggtaaatcaattcataaagatccgttcaaatccgtaacatatggtccgctgctgacagatggatcaatgacagcttcagtcgaggcagaatttccgtggggaaaaacaaaaactgccggcgttccgatcgatgataaagaaatggagttaacgttaattcctgatcaagatacacaggaacagattatgaacacaattgtcaaaacaacaaaacaatactccaaagctctatctgatgggaatacagcccagatgacagaggcaagtgccaattggaaggcggagacgaaggacaccgtcgattctatgaaaagcgcggattcatacttaaaagatagatacttggaaactgattttgacctggacacatttgccctctctcagaaaaacgacggaacgtggcaggtatcggtaacaggaaaagaacttcaccagtcttcttcgtataacgactatacaaagtctgaaatgactgacgacagtccgagttatgaatatcttctttcatatgataaaaaacagaaaaagtggattttcgaagatgcagaatcaacattcgaatctgcaggcacaaatataaagaaaatcaaaaatgataaaccagagacatacacttccgcctgggctggctcgaaaaacaaaggcagtgaaagctctgcaagcggcgatgttacagatgaacaagtgacattatttatgggcagttatctgcaaagtcaggcagatgccgtgaatcaaaataatttctcactgatggaagacagccttgaaaaaggcagttccctttattccgaccagcagcatctcgtgtcgaaattaaataaagaggggacaacagaagactttaataactatgaagtgaaaagctggagccaaaatgggtcggctatcacgattaagacgtatgaagaattctatatcacaaaatcaggcggcagtccaaagctcagaacatataactggacctacaccggcgtagtgaagaacggaagaatttacttaacgtctattcaataaaacaaccccatcaccagcaggtgatggggttgtttttaaaagagcatataacggaaaatttctttgacatagtgttcgataataagctgaaatgtaacgcagatgatcagataaatcacaatcgttgagtaaatgaaatcaaccttccctttatatgaatgctggtaactgctcagcatcgcaggaggaatggcgaagaatgcaccgattaaaccaacggctaatatggtaaagcaaatgtctgtatgtaataaaaagaagaaaagggcaagaatcaaaatagccgtaaaaggaataagaaatgctccgaatcttgagaatgaatccttgaaagacacttggtttcccgcgattttcagggcgaaaaagatgcatgcatgcaggccaaatagaaataaaataaaataaatggttggctctaagaagattgctgtaaagcttacgcttccgggaccgtctgaaaaaagaatataaaacatcaaaggggtcagcaaactgaaaagaaccatcgtaatgattgcgctgatcagctgttctccgcctgttgctttacattcctgataagggcgtttcaggacggataagacaaatgaaccgaactgttttgctgcttgctttgcagcggctccagtttgagctgcatgctggtggcctgattgaccggggagcggtgatccgcatttctcacaaaaatttccgccatctgtttgatggccgcattgaggacaatacataaaataactcctttatctgtaatatagggaaaatagactaatagttttattataaaagaaaaaagttgtaaagtaatcaatattcatacaaaaaaagacacgagcacgatagcagctgtgtctttttttatctagttattaatatatttctcaaatacatccccaaaatccttaatatgatactgcgagcgaacggatgtcagccaagtgaatccgaattcggtcagctctttgtattgcgtttcaatattgacgtgctcagggcgggtatggtgaagaatcgtcactgctttatctaagctttgctccgcttgattgattaaaatgtcattttcataggttgtttcagcgatgcgaagcagtgctttataaaggtcttttaacttttcaatctggtctttgtggacatcaatgtcgaattgttcaccgcccagcttgaacttaatttcaacatccaaatccacttttccggcagtttcaagaaaaacgtcagagattttatattgcgaataaggatagcgtttcaacgttcgttttgaggaagtggcgcgttcgccgtccacatggatcagggccaggttcgtaaagcaatactcgtctgcttttgttttaatcaagaaataaattttctcattatcttcatgcatgacatagtcatctgcgtctgttttgtcatagtcctgaggttcgataatttttccgatatcagataagcccaaggcatctgccgcaatttttttgaacatctgtatacgtccttcctattcaatttgtcacttcattgtagcatggcgcgtttctgacaggctataaaggtttaccgggaaatcgcctccgggtaaaagggtggagaatcattctatttcctgtgcagagactatcaacaaggaggtatatgatgttctcatttatcgttcacgtcttcatttctttattcgcagtatcgaatccgatcggaaacgtaccgatatttctgacgctgacagaaggctatactgcagcggaaagaaaagcgattgcccggaaggcagctattttatccttttttattctcgcagcttttttggttttcggtcatcttatctttaaactgtttgatatcaacattcacgcgctccgagtggcgggcggcatattcattttcggcattgcctataatctattgaatgcgaaagaatcgcacgtgcaatctcttcaccatgatgaacataaggaaagcaaggaaaaagcggatatatcagtcacacctttatccattccgatcattgctgggcccggaacgattgcaacagtgatgagcctttccgccggacatagcggcattggtcattatgcggctgtcatgatcggcatagccgccgttattgccctgacctttctctttttccactattctgcttttatcagcagcaaactcggaaaaaccgagatgaatgtgattaccagactgatgggattaatcttagccgtggttgcggtcgggatgattggtgccgggctgaaaggcatgtttccggtcttaacttcatgatgcaaaaagcagctctcttattttagagagctgcattcttttgttttcggcacataccgaaagacttcctcactctcaaaaaattcaatcaacctgctcagccaatcatagtaatgaagccattcttttaattcattcagcagctgattgactttctcttccgcttccggggtaagcccgtccctttgtaaaagatcactcagctcccggtttaattttttatacagcactttgtttttgctcacgacctttgtccaattcgccgcaaataaagaaatgaaggtttgataataatcctgctcgacgtcataaaggtcttttcgtacgcctttttcaaacaccttttcggcgatattggcatcgatcatttcccggacaacctggctcatccgtgttttgctcatgcccgttgcctcagagagctcgcttaaggtcattggttttcgattcatataaataattccgagcacacgtccgacagttgaaggcattccaaacgtatgcatattttcggcaatcttctcaatgagatgctcttcagcatgttcaatgatgtcgagagcggtttttttcacagctgatcatcccttcaaatggcaattgatggtgtcaatatatcatatttcttcctggtgttgaaaatagctgaatgcagaggaagtgggaggtatccggagtaattgtaagaacaccctttccgtctcggtcataacaataaataatctataaataacatataatttcaacacattgtaaactttttattttacaaagttcaaactataataaggattatacttttcagaaaatttaaaggaaacctgcggaggtgcacggattgctgaaattggaacaagtgtcaaaagtatataaaggcggcaaaaaagctgtgaacagcattgatttagatattgcaaaaggtgaatttatctgttttatcggcccgagcggctgcggaaaaacgacgacgatgaagatgatcaacagactgatagaaccatcgtctggaaggatctttatcgacggagaaaatattatggaacaggacccggttgagctgaggagaaaaatcggctatgtgatacagcagattggtttgttcccccatatgaccatccagcagaacatctcactcgtaccaaagctgctgaaatggcctgaggaaaaacggaaagaacgggcgcgcgagctgttaaagcttgtggatatgggcccagagtatttagaccgttatccgcatgagctcagcggcggacagcagcagagaatcggcgtgctgcgcgccctggcagcggaaccccctctcattttaatggatgaaccgttcggagcgcttgatccgattacgcgtgattcccttcaggaagaattcaaaaaactgcagagaaccttaaacaaaacgattgtgtttgtaacccacgatatggatgaagcgattaagcttgctgacaggattgtgatattaaaagcgggagaaatcgttcaagtcggcacacctgatgagattcttcgaaacccggcaaatgagtttgttgaagaatttatcgggaaagagcgcctgattcagtcaagaccggatatcgagcgggtagagcaaatgatgaacagaacgccggtgacggtatctgcggacaaaacgctttctcaggcgattcagctgatgagagaaaaacgtgttgactcgctgctcgttgtggaccggcaaaacgtgctgaagggctatgttgatgtggaaatgattgatcaaaaccgcaaaaaagcgagcatcgttggcgatgtataccgttcagatatatataccgttcaaaaaggggcgcttcttcgcgatacagtccgaaaaattttgaagcaggggatcaagtatgttccggtggtcgatgaacagaaccatttagcagggattgtgacaagagcgagcctcgttgatatcgtatacgattccatttggggcgacgaggaaaaccagctcatgacgatctgaccaggggaggagctcttttaagatgaatcaaatgatgacttttttgcaaacgaacggcggagagctgctgtataaaacaggagagcatttatatatttcactcatagccgttgtattgggcattatcgttgcagtgccgctcggcgttgctcttaccagaatgaaaaaaggcgcaggtgcggttatcggtttcgtaaacattgtgcaaaccctgccgagtctggcgattttagccttttttattccgcttctcggcgtaggaaaagtgcctgcgattgtcgctttatttttctattcggtactgccgatcctgcgcaatacgtataccggcattaaaggtgtaaataaaaacctcctggaatcggggaaaggaattggcatgaccggctgggagcagattcggctcgttgaaatcccgctggcgattcccatcatcatggcggggatccgcacatcaacgatctacctaattggctgggcgacacttgcgtcgtttatcgggggaggcggcctcggggactatatttttatcggactgaacctataccagcctgaatatatcattggcggtgccgtgcctgtcacaattctggcaattattattgattatgttctggctgtgacagaacgaaaggtgacgccgaaaggcttgcaagggatgaaggaagtatcgtaaggagttggcactgttgaaaatgacaaaaatcaaatggcttggcgcgtttgctctcgtctttgtcatgctgctaggcggctgctctctgccgggtctaggcggcgcttctgacgatacgatcaaaatcggggcgcagagcatgacagaatcagaaattgtagcgaatatgatcgcgcagcttattgaacatgatacagatttgaatactgctttagtgaaaaacctcggctcaaactatgttcagcaccaagcgatgctgggcggtgacattgatatttcagccacgcgctattccggaacagatttaacaagcaccctcggcaaggaagcggagaaagatccgaaaaaagcgctgaacattgtgcagaacgagtttcaaaagcgcttttcttataaatggtttgattcctacggctttgataacacatatgccttcaccgtaacaaaaaagtttgcggaaaaggagcatattaacaccgtgtctgacctgaagaaaaatgcttcccaatataaattaggcgtcgacaatgcttggctgaaacgaaaaggcgacgggtataaaggctttgtcagcacatatggctttgagttcggcacaacttatccaatgcagatcgggctagtctatgacgcagtcaaaaacgggaaaatggatgcggttttggcttattcaacggatggacggattaaagcatatgatctgaaaatcttaaaagacgataagcgtttctttccgccgtatgactgttcaccggtgattccggaaaaggtgcttaaggagcatccggaacttgaaggtgtgatcaataagctgattgggcaaatcgacacggaaacgatgcaggaacttaattatgaggtggatggcaagctgaaggagccgtctgtcgtagcaaaggaatttttagagaaacatcattattttgactaagaaaagaggtggatcatatggaagtactacagcagcttggcacatactattcgcaaaacggcggttacgtgctgcaggaattttaccgccattttctgatgtcggtgtatggcgttttatttgccgccattgttggaattccgctcggcatcctgatagccagatacagaagattaagcggatgggtttttgcggtcacgaatgtcattcagaccatcccggctctcgccatgctcgccgtgctgatgcttgtcatggggctgggcgctaatacggtgatattgtcattatttctgtattctcttctgccgattatcagaaatacgtatacagggattatcagtattgagcacgcctatcttgaatcgggaaaagcaatggggatgacaaaatttcaagtgctgcggatggtcgagcttccgcttgcgctttctgtcataatggccggcctgcgcaccgcgcttgtcattgcgatcggcattacggccatcgggacatttgtcggtgctggcggtctcggggacatcatcgtcagaggatcaaacgccacaaacggaaccgcgattatattagcgggagcgatccccacagctctgatggcggtgattgccgatttggtcatgggctggcttgaacgagcattaagcccgattaaaaagaaaaaaggaaattttattatagctgatagaaaaaccacctctatttaaatacaacagaggtggtttttttaaataaacaacatgtgttagtatctgttaaacatattttccagcgttgggattatccgagtatttgaaaaaatacaaaaatcagatattataaccaatttgagggttgtttttaaaaaaattcaagttataatgaaaataatacatttatacaaatatctaaatgtctaaatgtttttttgtaaaggagaaaacgctatgaataatgttttcaaagctatatcagatccaacaaggagaaaaattttggatttgttaaaaggaggggatatgactgcgggagatattgctgagcattttaatatcagcaaaccgagtatttcgcaccacttgaatattttaaagcaagcggaagtcataagtgaccatcgcaaaggacaatttatttattactctctaaatacaacagtacttcaagactcaataaattggatgcttaactttataaataaaggggataacgatttatgaagaaaaatataatttccataattattgtatgtttgagtttcttgacttcaattatattatatcaataccttccagaagaaataccgatacaatggtcaggaaataaaccggctgcaattgtatctaaacctttaacaatatttattatacctgttgttatgcttatttattatcttactttttatatgttaactattaagtctacacaaaaaaataaagcattgcttttcctagcttctaataatatgttaatccttttatatattttacaactctcaactctattgataagtttaggatacgaagtgaatattgatttaataatagggcttggtgttggtatctttttaattattggtggaaattctatgcagctagcagaacaaaaccatcttattggattgaggacaccttggacattaaaagatgagactgtttggaaactgggaaatcgctttgcctctaaagtacttgtagtgtgtggttttataatagctgttctttcattttttacaggagaatatataattcttattatgattgtgctagttcttctagcattagttatttcaacactagcttcatatcattattacaaaaaattaaacggttcacgttgaaaaagtgtcttgcggagcaatccgcaagacactcaattataatggattattgatgaatcaattttagggtttttgcagcagccgcttctaaatcagaattattagaagctgaagaggaatatttggcaacgtatttccacactgcagttgttactgcggcagccgtttgtaatgcaactgcgttaacgcccacaacatataaatatccagctgctacacagacggcataaagcccacaagatggagtaactttattagaagagtattttacgttttcatttttcttagcatatttttggataagttggtctgctttggtcatattttcaatgagttttttagggtctttgctgtcaatcgattgtttcaattcatccatatattgtggttgatctttttttataaatttgactacatcatttactaactttttaccttctgtactatttgcctcttttacgagtttagggtccaaatcgtttgaaattaatttaccaacttccccttgtccaaataaaagtcctctaaagtaatcttctccagaaaatgtatggttttctttagcagatgtacttgactccttagagagtcctactaatgaaaaaaccaatatcgttaccatggaaacaatcaatagcctaagtaatttacttttcaaattattatacctccattaagttatttctccattatctaaatgttagctatgaaacaattttgtaagaaacttgactgattcacctcctattcttttgaaatttctctttccttttacatatatatatttaaataaaggagaacaccaattcatagtgatattttgttgtacaggatgcagatatataattaatgctgatatcatgatcaagccaaaacttacaataccaatgctgaatattatcccaatatgaaataatattcccaaaacaagggcaattctctttattctgatatttgaaattatgcttgctgctaagaacaactcaaaaatagttactaaccaagtgatgacaacaataaaattgctttcaagtagtggattcattaagttaagttgatattcaggtaatccaaacaccggatcagaaaagaaatagtaaattgctgttccttctgcccactctttatttttcaatcgctctaaagctgcgtttaaataaatgataaaaacttgaattttaattattgtcattatataaaacaatactgtcttctttgtgaaagattcattattgtttttctttatattccaatgatttcgccttgaatctaataatgtaacaggtaatataagaaaagaaagaacagttgcaatttgctctccaccatcgatagttaaagctgaagtttgaatactatagcaaatataccagtgaaataaaccggtaaatctaggtctccaccctataaccactaaggttaatataaaaatcattaagtatcttataatctcaaaattgatactatattctttagcaaaacaaaaagcggtagggatatagacattttcacatgtgacattatttgcactataactaaataaaatatcagtactattgaataatagtactagtaatgttgagaaaccaagtaaacttctaaaaagtgcatatgtatttttccatggattataggtgtcaatataaccttctaaactatttaatatcttcatactatttttatttttagcacctttctttcaaaagaggtagtttgcttaaagtctatccaataccatgagagtggtttttggcgatatattaggtattctcctttgctaagatgtatataatcttcattttttataaccttaataggctttatttgtttctctaaatttgtgcaggagttgttgttttcacaagttttccaattctttggatcgatattctctacaattttgcctaattctattgcctgaactcttccttctctttttatcccaaaaaaattattgggaagtgcattaggtaactttaaattttcttttgtgtgaaatgaaatgttttcttctgtagggcttttactataaaagccaaagccttggggagacaattgttgcaaaaaattttttttgaacagtggattctgaggtgaaatattgctaaagtaataagaagaaaataataggaaacatatagtcattacagtaataattccctttttttgatgtagattacctcctctaagctaatataatcatttcaaaaagattatataatagctagtcagaataatcaacaaaaaatggataattaataaattaatgtaaattatgcattattttgtttgttttcttgaagtttgatattcaaccatttggattggacttaaaaaagttcccagaattgaatttgggaactttttacggcttcggcacatatttaaaaatgtcttcgctctcaaaaaactcaatcaaacggctgagccaattataataatcgagccattcctttaattccttcagcagctcattcactttttcttccgcttcaggagtaagctcttcatccaacacgctaagcagctcccgattgagttttttatgcatcattttgtttttgctgacgactttgctccaggtggctgaaaacagcgtgataaatgtttgatagtagtcctgctcaacctcatataaatcttttcgcacgcctttttcgaataccttctcggcaatgttggcatcaagcatttcccgcactacctggctcatacgtgttttactcatgccggtggcctcagataattccgtaagcgtcatcggttttcgattcatataaataatgcccagcactcgtccgacggtagagggcattccaaatgcatgcatgttttccgcgattctttctataaaatggtcctcggcttgttcaatgatcgttaacggatctttctccaacggtttcatcctttcagctaacaattccgatgtcaatataccacatttttgatacggcgaaaatgctgtcaaaagagaatttggcaggaaattggagcaataaggagatcaacacacgtcaatgcgggtaaatcagcgtttacacatactttataaataatatgaacaaattgtaaactttttattttataaactttattctataatgggaagcattcaattgtctgaaaaattaaatttaaactgaacaaattgaataaacttaattttggaggtgcgatgtttgctgacattagaaaatgtctcgaaaacatacaagggcggcaaaaaagccgtgaacaacgtaaatcttaagattgcaaaaggcgaatttatctgctttatcgggccgagcggctgcggaaaaacgacaacaatgaaaatgattaaccgattaattgagccttccgccgggaagattttcattgacggcgaaaacatcatggaccaggatcctgtagagctcaggcgcaaaattggctatgtgattcagcagatcggcctgtttccccatatgaccattcagcagaatatctcactcgtcccaaaactgctgaaatggccggagcagcagcggaaagagcgggcgcgtgagcttttaaaattggtcgatatggggccagaatatgtagaccgttaccctcatgaattaagcggggggcagcagcagcgaattggtgtattacgggcacttgccgcggagccgccgcttatcttaatggatgaaccgtttggggcactcgacccgattacgagggattccctccaggaagaatttaaaaaactgcaaaaaaccttacataaaaccatcgtatttgttacccacgatatggatgaagcgattaagctggcagaccggattgtgattttaaaagcgggagaaatcgttcaagttggaacgcccgatgacattttaagaaatccggcagacgaatttgttgaggaatttatcggcaaggagcggctgattcagtcatccagcccggatgttgaacgggttgaccagattatgaacacacagcctgtaacgatcaccgcggataaaacgctttctgaggccattcagctgatgaggcaggaacgggtcgattcattgctggtcgtcaatgacgagcgcgttctgcaaggctatgtcgatgttgaaatcattgatcaatgccggaaaaaggccaatctcgtcagtgaagttttacatgaagatatatacacagtactgggcggcacactgctgcgcgacacggtccgcaaaattttaaaacggggtgtcaaatatgttcccgttgtggatgaagaccgacgcctgatcggaattgtgacgagggcaagtctggtcgacatcgtgtatgactccctctggggagaagaaaagcagctcgcagcattgtcatagggaggggcgataagtcatgcatcatattgttcaatttttgcaaaccaatgggggagagcttctttataaaacatacgagcatattacgatatcgctcattgctgtgatcttaggtgtgctggttgccgtccccctcggggttgtgcttaccagaatgaaaaaaggagccggcaccattatcggcattgtcaatatcattcagacgctgccgagtctggccatcctcgctttttttatcccgctccttggtgtagggaaggttccggccattgtggctttgtttttctattccgtattgccgattcttcgcaacacgtataccggcattcgcggcgtcaacaaaaatctgctcgagtctggtaaaggaataggaatgacgccggctgaacaagtccgcttggtggagctgccgcttgccgcaccagtgatcatggcgggaatcagaacatcgacgatttacttaatcggctgggccacgcttgcttcctttatcggaggcggcggattgggtgattacatttttatcggactgaatttatatcagccggaatatatcatcgggggcgcggtacctgtcacgatattggcaattgtgattgattatgtgctggcagttgctgaacgaaaactgacacctgccggcatgcagagattgaaggaattgtcataaggaggcggctcatgaaaagaaaatatctcaaattaatgataggtttagcacttgcggcaacgctgacgctgagcggctgttcgcttcctggtctcagcgctgctgcagaccagaccattaaaatcggcgcgcaaagcatgagcgaatcagaaatcatcgccagcatgcttggccagttgatcgaacaccatactgatctcaaaacaacaacgattaaaaatcttggctccaacgcggtgcagcagcaggctttaatgaacggggaaatcgacattgcggccacaagatatacgggagacgcgctgacaggcacgttgagaatggaacctgaaaaagatccggacaaagcgctggcgcttactcagcgggagtttaaaaaaagatatgatttaaagtggtatgactcctacgggtttgataatacatatgcctttacagtcagcaaggagctggccgaccaataccatttagagaccgtatcagacgttaaaaaatgggcgccgcaattaaagctgggcgttgataactattggatgaagctcaaaggaaacggctatcaggattttacgaaaacctacggcatgacattcggcggcacgtatccgatgcagatcggccttgtgtacgacgcggtgaaaagcggaaaaatggacattgtgcttgcgtattcaaccgatggaagaatcaagtcctatggtctcaaaatgctaaaggatgataaacaatttttcccgccgtacgactgctctccggttgttccggaaaaggtgctcaaagaacatcctgaacttgaaggcatcatcaagaaaatgctcggaaaaatcgacacagccacgatgcaggagcttaactatgaagtcgacggcaatctcaaagaaccgtctgtcgttgccaaggaatatttagaaaaacatcgctatttcgaatcgtgaaagggggaagaggtcaatgaacgtgcttgaacagttaatgacgtattacgcgcagaatggcagttacgtcatggatgaattcggccgccactttctcatgtcggcttacggcgttttatttgccgctgtcgtcggggttccggccggaatcctcatcgcgcattttcgccgtttgtcagcctgggtgtttgccgtaacaaacgttattcaaacaatcccggcgctcgctatgctggccgtcttaatgcttgttatggggctcggcgcaaataccgtgattctatcattatttctgtattccctgctgccgattattcgaaacacgtacacaggcattatcagtattgaacatgcctacttagaatctggaaaagcaatgggcatgacgaaattccaagtgctcagaatggttgagctcccgctcgcactttctgtcattatggcgggccttcgcacggctctcgtcattgccatcggaattacagcgatcggcacatttgtcggtgccggaggccttggggacatgatcgtacgcggctcaaacgcaacaaacggaactgcgattattctagccggagcgataccaactgcggtgatggcggtaggggcggatttgctcatggcttggctggagcgggcattaagtccggtgaagaaaaaaagaaccggggcgaaacatgttcaatcagctgcatagaatagaaaaagaggctggagtccagcctcttttttctctttaaatcgtaaactgacccatcttctcattaagctcattggccagctgctcaagctcttcagcatttagaagcacttgatccatcgaatgggcggattgctcggtaattgaaaatgtttcttcaatgccggcggcagactcttcggatacagaagcgatattttcaatcgattgattgatggtaatcgattggtttgttaactgcttcaagccatccgttacttccttaatgctgtctgcaacatgggtgacggattgtttgatatgctgcatagcctgtccggtgtctgtcaggttttccgttcctttttcgacttctgtaaagctgctttccaagtacgtaatgacagtgtggatctcctgctgtgtcccgtttacaatccgggtaatgtcctgcacggaatcagaaacgccgtcagccagctttctgacctcctctgccacaacggcgaagcctttgccgctttctccagcgcgggcagcttcaatcgcggcgttaagggacagcaaattcgtctgctcggcaatcccgttgatgacctgaacgagcttgttaatatcctgagaatgctgttccagtgatctcactttatgcacggcttcttcaacaatatgatggatggttttcatttgctgtaatgacgtagccatattttcgttcccgcttaccgcgagttcgagaacgttttgagacgtatcgctgattgtgatgccgtgattataggctttatcaatgctttcggtaaactcattcatcgattcggcaatcgtcaccgcgtcttgggcctgctgttcagagccctcagccatttcgttcatcgtctcggtaatatgtttgctgccggatcttgtttcattcgttgcggttgcaagcacctgtgaagaagaaagaacccggcttgatatgtctttagaatatccgacaatatctctcagattccctaccattttttgcagcgcttcattcagatcacccagctcgtcttttgagttgagggcctccatatcgttcgacaaatcgccttcggcaatatgattggcagattccttcatgcgaatgataggctttacaatgtttcgcgtgatataaagccagatgaaaatgctgatgaggattgatgctgccacaagcaaagcagtgtaaatgagccctttatgatagacggccttcgtttcttttaccgctgtgttgctgccttcttgatttaagtcaacaagctgagtgattgtttttttcatatcctcaaagctggcctcagtctgaaccaataaacctcttgctttgtccatgtcattcgtgcggccgctttcgataatttgcgcatgaatatccatataggtattcactttagtttgaagctgctcgaacagtttctgctctttatcagtggagatcgttttttcgtagttatcgagcttttggttaatgtcttccatgatttgattcatttcttgatcaagtgtatccattttacttttgtctgtataaatcagaaagtccttttctttagaagacaggtgctcggttacataattaattgaagtgattcctttgatgccgtcaatccattttgtgttgatttcatctgttttttgaatgatatgctgcatattaagaacgcctattccgcctacaagtaaattgatcaggatcagtgtcaaaaataccaggctgaatttgcgggaaatcgtcagtcgcatatagtggtctcctttaaaaacgtaatgtgtggatgtactatatatcggctgagatatctttttttcacctggaaaataaaaaacggttcttttctcgtctttgagatcagaaccattttagcaattagtcaagaaaggaagggtcaatccattcagtcgcccatttagaaatctcacctaatatgggtgctagtgcctttcctttatcagtcaatgaatattcgatgcgaaccggagtttcagggatgacatcccgcttcactactccttcaagctcaagttctttcagccgttctgacagaactctgccgcttagatttggaagtgctgcttcaatttcgctaaatcgctgcgacccgttcaagagctgaaatacgattaaagcgacccagcgtttacttaagatgtcgactgctttttcaaatctaggacacatttctgattggttcatacttttcacctcgtctgtcactattataacgcaaataacgagggagggcatgcaagcgtgattgataaaatatagaaagagaaacaggggattatgaggaagaggcgcgtttttttgcttctgaagacaaaaaatcgaagtatttgctgagattttcaatatcctgctttgagagatgttcccatttttgactattgaaaatcgggaggtgctccgctccgcgtgtgacagccgtctggtaaatttcataaacggattgatagccttcagatgcttcgcggatttcttcaggaaaggcctgaatatggcctgcggcggccattaggttttcgtacggcactttcaggacggctgccagttttttaatcgtggcgggttttggcgtcccgcgtttgccgttttcaatttttgaaatggtggccgagctgatgcctgagtacaccgcaagctgattcactgtcagtttgcgggcgcggcgcagctcccgtaattgctgtccgaacggtgacatggtctatcgcctcacatttctatcaagagtcagtcatcagcagaccgttttttcgcttcatctgaaataaacgaaaaataatgatccagcatgagcaaatcttctttattgagatattgccacttttcgttctcaagaagcgcaaggtttttcaggtcataggcctccgctttttcaagcagcttgcacttcgtttcataaggggccctggcttcatgcacttcttcgatgtaaccagccttgtacataagcccctcataaggaatttttaaggcctctgccagttttttgatggtggcaggtttgggaacgccccgttttccgttttcgattctggagatgccggccgcgcttacgcctgaataagtcgccagctggttgactgttaactttctctcttcacgcaatgcccgtaattgttcgccaaagctttccatatatctcaccccgtccctcactgttactcatattttagtatgtttattgactaaagggaataggtagactggaaatgtattgacaaaagttaacataagccgtaatgtaaaagtatagaaaaaagtttttcaggaatggaaggtgaggaaagtgccagtagaaaagatacagattagacgtgattatgtcttgcagtatatggttaataacgattattcccttaatcagcttgcgctggaaatcggagtctcacccgccacactgagccgcgtgctgaatggagaaagaaggccggggcagcttgtgattggtaaaatgcttcactattttaatttgaaatttgaggatcttttttactatgatttcgttgacaaaagtcaataaagtaacaaaaaacgcaaggaagccaagcgttttctattcctatgaatgatgtgtcagcacaaaccctgtcaccagctcattgcacgttttccattgttttgtcggcaattgatgtccctgatattccaatctgaaaaattcggcatgtctgcacgatcttcggtaatagcctgcgtttgtaaaggtccagtcccgcaggccgccatacataaacagcattggcatttctaggcggggcagctgttcaatgcagttgtagccaagcgaatccagataatactgatgccaatgggcctggtctgcttttttcatatggtctgttaatatgctgcgaagctgtctgtcttttgtgtggctgccagcgaggattttcatgagcaaaccggggtttttttcaagcagatacattcccagtttgtgcagcttctggccgattacgttatgaacagcggggtaggcgccggacagaataaggtgtgacactttgtccgggcgggtgaagccgatatgctgcgcgattaagcctccggcagaatacccgaataacacagctttatcaatgtgcaaagcgtccatgaattgcgcgatctcgtttgcgtaataggaaatagacgctggctgatcgatgtgatcactatcaccgtggccacttaaatccggaaaaatcaccctgaaatgcttggatagaaggcgctgataataaaaaacctttcgtcccatgcccggcgggtggataaaaatgatagggattccctgtccatattcttcataaaaaagatgtttcctgctgtctatgctgataagcggcatcgcttttctcctttgaccttttcatatgaatagggtaaccaagataaaacgtcttatccggccttttggcgtctgatacagcgtgacatgccaacccttttcatgtaaaatagaagtaatgtagccagtgagtctggaggtgtatgggatgcacgcagttttgattaccttattggttatcgtcagcattgcacttattattgtcgttttgcttcaatccagtaaaagtgccggattatctggtgcgatttcaggcggagcggagcagctcttcgggaaacaaaaagcaagaggtcttgatttaattttgcaccgcattacggtagtgctggcagtcttgtttttcgtgttaacgattgcgcttgcttatatcctatagggcaatgtttgtataaggtctgatgtgaagtcaggcctttttcacgtttctggatgatattcaaaacgtttttttctgattaaactgtggaaaactaaaatgatcgtgcagatagaaagggagacatgagcatgaaagttgtgacaccaaaaccatttacatttaaaggcggagacaaagcggtgcttttgctgcatggctttacaggaaatacagcggatgtaaggatgctgggacgatatttgaatgaacgcggctatacgtgccacgcgcctcaatatgaaggacatggcgtcccgcctgaagaacttgtacatacggggcccgaagactggtggaaaaacgtaatggatggctatgaatatttaaaatctgaaggttatgagagcattgctgcctgcggactgtcgcttggcggggttttttcgctgaaattgggttacactgtacccataaagggaattgtcccaatgtgcgcaccgatgcatattaagagtgaagaggtcatgtatcaaggcgttctttcatacgctcgcaattacaaaaagtttgaggggaaaagcccggagcaaattgaagaggaaatgaaagaattcgaaaaaacgccgatgaataccctcaaggcgctgcaagacttaattgctgatgtgcggaataatgtcgatatgatttattcaccgacatttgtggtgcaggcccgtcatgaccacatgattaataccgaaagcgccaatattatttacaacgaagtggaaactgatgataaacagctgaaatggtacgaggaatcagggcatgtcattacactcgacaaagaacgtgacctcgtccatcaggatgtgtatgaatttttagagaagctcgattggtaatcaacaggaggtcggataatggaaaaagaagcatttatggaaaagcttctctcgtttatgaaggaagaggcgtacaaacctctgaccgttcaggaacttgaggagatgttaaatattacggaagccgaggagtttaaagagctcgtcaaagcgttagtcgccttggaagaaaaagggcttatcgtacggacgagaagcgaccgctacggcattccggagaagatgaatttaataaaaggaaagatttcagcccatgcgaaaggattcgcctttttgctgcctgaggatacgtcgttaagtgatgtgtttattccgcctaatgagctaaatacggcaatgaacggcgatatcgtcatggtgcgtctgaactcacaatcaagcggctccaggcaggaaggaaccgtcatacggattttagaaagagcgattcagcgggttgtcggcacgtatacagaaacgagaaacttcggctttgtcattccggacgacaaaaaaatcacgagtgacatcttcattccgaaaaatgggaaaaatggagctgcggaagggcataaggttgttgtcaagctgacgagctatcctgaaggccgcatgaacgcagagggtgaggttgaaaccattctcggccacaaaaacgacccgggcattgatattttatcggtcattcataagcacggcctgccgggagaatttccagctgacgcgatggaacaggcatcaagtacgcctgacacgattgatgaaaaagatctgaaagaccgccgtgatctccgtgaccaggtgattgtcaccattgatggtgcggatgcgaaggatttggatgatgcagttaccgtgacgaagcttgatgatggaagctacaagcttggcgttcacatagctgatgtcagccattacgtaaccgaaaactcgccgattgacaaagaagcgcttgaaagagggacaagtgtgtatctggttgaccgtgtcatcccgatgattccgcacagattgtcaaacggcatctgctccttaaatccaaaggttgaccgcctgacgctttcttgtgaaatgacaattaacagtcagggacaggtgacagagcacgagatcttccaaagtgtcatcaaaacaacggaaagaatgacatattcagatgtgaataaaattcttgttgatgatgatgaagagctgaaacaaaaatacgagcctcttgttccgatgttcaaagacatggagcgtctggctcaaattctgcgcgataagcggatggaccgcggcgccgttgactttgatttcaaagaagcaaaggtgcttgttgatgacgaaggagcggttaaagacgttgtgatcagagaacgctctgtcgccgagaagctgattgaagaatttatgcttgtagcaaacgaaacagttgcggagcatttccattggatgaatgtcccgtttatataccggattcacgaagagccgaatgctgaaaagctgcaaaagtttttagaatttgtgacgacatttggctatgtggtgaaaggaacggcggggaatattcatccgcgcgcgctgcaaagcattctggacgctgtgcgtgacagaccagaggaaacggttatatctactgttatgctccgttcgatgaaacaggcgaaatacgacccgcaaagcttggggcacttcggtctgtcaacggaattctatacgcatttcacatcaccgatccgccgttacccggacttaatcgttcaccgtctgatccgaacgtatttgatcaacggcaaggtcgatgaagcgacacaggaaaagtgggctgaacgcctgccggatatcgccgaacatacatcatctatggagcgccgtgcagttgacgccgagcgtgagacggatgatctgaaaaaagcggaatacatgcttgataaaatcggtgaagagtttgacggcatgatcagctctgtgacaaacttcggaatgttcgtcgagctgccgaatacaattgaaggactcgtccatgtcagctttatgacagatgactactaccgctttgacgaacagcatttcgcaatgattggcgagcggacaggcaacgtcttccgcatcggggatgaaatcacagtcaaggttgtcgatgtcaataaagatgagcgcaatatcgactttgaaattgtcggcatgaaaggcactccgcggcgtccgagagaattggacagcagccggagcagaaaacgcggaaagcctgccagaaaacgtgttcaaagcaccaatacacctgtttctccagctccgtctgaggaaaaaggggagtggttcactaagccgaagaagaaaaagaaaaaacgcggcttccagaatgctccgaaacagaaacggaaaaagaagaaatagcagctcaaccagcaaatagggccgcagcgctctatttgctttctttcggaaacagcttttcattgtagcggtacgtgacatttggtaaaatagagcgtatcgcaaaaggtggacagtttttccttagagagaggaggttctggcatgccaaaagggtcaggaaaagtattatctcaaaataagaaagccaaccacgattattttatagaagaaacctatgaaacaggcatcgttctgcaaggaaccgaaatcaaatcgattcgcgccggccgcgtaaaccttaaggattccttcgccaaaatcgaacggggagaagtgtttctccacaatatgcacgtcagcccatatgagcagggaaaccgctataaccacgatccgctccggacaagaaagctgttaatgcaccgcaaggagattaataagctgatcgggttaacaaaggaaaaaggctattctctcgttccgctgaagctgtatttaaaaaacggctttgccaaagtgcttctcggccttggaaaagggaagaagaactatgacaaacgggaagatctgaagcgcaaggacgcgaagcgggaaatcgaaagagcgttcagagacagtcaaaaaggcttctaaaggcatagtgcttgattcgaaaatcaggcctgtgctatactgtgttcacgatcagatcacgacgccattcatttgaaggatttgacaattgaaaagagccgtgatcatgttataataagactatagccagtttgagtgagagcttgatattttctcccgtatttcccttataccaaggggacgttacggattcgacagggatggatcgagcttgagctgcgagccgagaggcgatctcgtaaacacgcacttaaatataactggcaaaactaacagttttaaccaaaacgtagcattagctgcctaataagcgcagcgagctcttcctgacattgcctatgtgtctgtgaagagcacatccaagtaggctacgcttgcgttcccgtctgagaacgtaagaagagatgaacagactagctctcggaaggcccgcccgcaggcaagaagatgagtgaaaccataaatatgcaggctacgctcgtagacgcttaagtaatcgatgtttctggacgtgggttcgactcccaccgtctccatacatactgacaataaagcagaacctcttaagaggttctgctttattttttctccaaaccacaggcaccaaaaagtgcgtacttccatttcaatcccagctgtttcatactgattgcagagcagatgtttcaccaatcagatttctgtcaataaataagaggaatcaaaaacggagggatgaataatgaagctgaatttacaaggaaaaaccgcactggtgaccggttcgacatcagggatcggaaaagctattgcctcttcgttagctgaagaaggtgcggcagtgatcattaacggacgccgggaagagaaagtgaatcaaacgatagatgaactgaaaacacaacatgctgaagcggttctttatccggctgcatttgatttgggaacagaagaaggctgcaatgagctgtttcaggcatatccagaggttgatattttggtcaacaatttagggatttttgaaccggcggagtactttgatattcccgacgatgaatggtttcgtttttttgaagtgaatattatgagcggtgtaaggctgacacgcaggtatttgcataacatgatagagaaaaaagaagggcgtgtgattttcattgccagtgaagcggcgattatgccgtcacaggaaatggcccattacagtgcgacaaaaacgatgcagctgtccatttcccgcagtttggcggagctggcaaccggcacgaatgtcacagtcaacaccgtcatgccgggctctaccttaacagagggtgtggaaaccatgctgaactcgctgtatcctggtgaaaacctgactgttcaagaagctgaggcacgttttatgaaagaaaaccggccgacatctattattcaaagactgatccgtccggaagaaatcgcccacttcgttacatttttaagcagtccgctttcctctgcgatcaatggcgcggcacttcgggcggacggcggtttggtccgcagtgtcttttaaacctctcccaataggagaggtttttttatatattgttgatttccataaatttctgccgtataatattggtaccgaaatagttttcttggtaccgaaagcgggggattaatatggataaaagaattctggcggaaaccttccggctgatcaagcagaaaggattttcatttacgatgaatgatttggcggcagcgctgggaacgagcaagcggacgctctatgcatattattcatctaaagatcagcttgttgaggcggttgtcgaacaatttatagctgaaatgaagcaaatagaaagagacatctatgaaaatgaaagtttaaatgtgctcgaaaaggtgaaacaaatgctgatcagccttccgcaggggatggaactgctgaacatgggattattaaatgaactaaagaaataccattacgatgcgtggcttacattagacgcgtttattaaggaagaatgggcgattgtcctagcattattaaatgagtgcaaacagcaaaagagaatcagaaacatcaatccggacctgtttgttcacatgtatatagggagcatcaatcaagtgtatgaccctgaatatccgctgaaacatcagttcacgacaggagaggtacttgaatcaattgtagatgttttgtttaacggtataacagctgatgaggaggctgatgccacatgaattgggtgtttctatgcttggcgattttgtttgaggttgcgggaactgtcagcatgaagctatcgtctggttttacaaagcttattcccagtttgctgttgattttcttttatggagggagtcttttctttctgacgcttacgcttaaatccattgatgtatcagttgcttatgctgtatggtcagggatgggaattgtcttgattacagtcgttggtttttgttttttcaagaacatgtgagtgtcatgaaagtcatttcaattggattgattattgccggtgttgtgtctttaaacctgatcgagcatgttgcggtgtctgagccggtacataaaagcgggcagtacaaatgagatatatgaagctgttttttctcgtgactgatatcggttttatcttgtactggctgtcagccggattttcgctcataccggaaagctgggcttttaaacatcatgaccatccgtttatgatcgcttggaactggtctttttttccgctggatatcctgatttctgtcacagggttgtacagcttgtacctacagcgggtgaatcgtgctgactggaagctgatggcgctgatttctcttgtgctgacctgttgttcaggtctgcaggcgctatcattctggacattcagcagtgactttgatcttgtgtggtggctgtttaatgggtatctattgatttatcctttattttttattcacctgctcttgaaggaaggcagaaggacaaaacagtcctgacaggtgccgcttttataataaactgatgtaatgaagcagagacggtataagtctctgtttttttatcgtgcgcaccaattgagaagctaaccgcgtttttgggcatactaaagcgaagaaactggaaaagttctacacattcattgaaaaggattttgtcaaatgaacaaaactgctgcgaacaatcaaagaatcatgcctatcgtgaaggatgcctttcgcattcatgcaaatccatttccttggaaaaaggctatcggatcaggtttcgcttcagggtttcctgtgctggtcggtgcattggcaggtcacacggattacggattaattgcaagtatcggaggctttgtttatttatatgcgggcggtgaatcgtacaaaaagcgcgccttgaagctgctcttggtttctattgggatcgccctctcatttggtttagggacgcttttgtccgggatgctttggatgatggcggctgttttggggctgatcggtgcagcggcgatgtttatttttagcgcgctcggcattcaaggccctgcgccgatgttttttgtccttgcctttttagtcagttccgggctgccggccgatccttcacaagcgctgttcagagcgggactgacgtttctcggcggcattttcgccatgggtatcgctttaatcggctggttatggaacaaacatggaccggagggagcggtgctgcaaaaaacatatcatcagctggctgcatgtctttcagccgtcggaacgccaggttttcataacgcacagcatcagacggtgctcatgcttagaacagcccgccaaacggttcttgggaaagggaacagacggaaaaaatcgcggcatgatgaacgattttttcgcctccttgagaaagctgacgacatatttattgccattattcatttttcagctgaaacgccggacagagagaccgcgcagattgaaaaggcacttcgccaaaccggagatatgcttgcgaatgcacgggttttcaatacgtttcagattaatgaaaatgaatctgagcctaggcggaagctgtttgaagaaatcaatgaggttttgtatatcgcttcaggacgttttgataagcagcttgacggggaaccaagccgcctgccatcctctttttactttttgagaaatgcctttgactggaagtctccagttttgattagagcgttaaagtacggaattgttctgtttgccgccgatatgtttgccctcgcattcggctttgcacgctcctattggattccgctttcggcagcagcggtcatgcttggcactactgttgtttttacgcttcacagggctattcagcgttcggccggaacggtgatcggtgttatactggcaggcgcaatcctgttttttaagccgggcggtgtttatattgcgttttgtattgcagcgctgcaatgtcttcttgagatgctgatcgtccgcaattatgcgctggctgttccctttttaaccgcaaatgcgcttgttatcacagaaagtatgcatggcggggcgggcgccggttattttatgatagcgaggctgactgatgtagctgtcggcagcgtgatcgggctgttgggaacaatgcttttgtggcggcggttttcaaccaagcggctgccagaacttgtgcggaatgtcatccggctggaagggcagtttatggagaaactgttaaccgggcaaattgccgacgaacacaagttaagggtgagtcttgtcaggcttcgggatgcgtatgacaaggcgcttggcgagtttcctcacgcgaatgcggatgcgctctggcctgccatttccggtgctcagcacttagggtactatttgctctcggcgcaagctcaccgccgtccgtctgctccgttttctgatgaagagatcaaccagctgcgggcgttttttgaacaggctgagcaatcctttatcatgaaaaggatgcctgcggatattcaagtgccgcatgtccctcattatcctcggatcagtaaagaattgtccgcgctgtattccggcttgagaacagcttttgaaaagtaagctgtttgggaaagttaaataatctttaattcgagatgttttacttgaaagtaaatttctttgtctctataataaagtctaagagagacagaataatcattatgcatctgtatgataataattgatgtgtgatttttaaaaacgaaagggctggtaaaaatggcaaaagtattatatatcactgctcatccacatgacgaagcaacttcgtacagtatggcaacaggtaaagcatttatcgaatcttacaaagaagcgaatccaaatgatgaagttgtacatatcgatttgtacaaagaaaacattccgcacattgacgcagatgtatttagcggatggggaaagcttcagtcaggtacaggctttgaagagctttctgaaagcgaaaaagcgaaagtaggccgtttgggagagcttagcgatcaatttgcatcagctgataagtacgtatttgttactcctttatggaacttctcattcccgccagtgatgaaagcgtatctcgattctgttgctgttgcaggaaaatcattcaaatacacagaacaaggtcctgtcggcttgttaactgataaaaaagcaattcatatccaagcgcgcggcggctactattcagaaggccctgcggctgagatggaaatggggcaccgctacatcggcatcatgatgaacttcttcggcgtaccatcattcgatggcattttcgtagagggacataatgcggagcctgataaagcacagcaaatcaaagaagacgcgattgcgcgtgcgaaagaagcaggaaaaacattctaatgaaaaagcctccccttatttggggaggcttttgttttagtgctccagcataatggttcgtttctctttactgctttccatcgcggcttcaatgatgcggatgacattaataccttcctcagcagtgactggcagcgcagcaccttctcgtatgctttccgctattttacggtaataagtaaggtaggagccatttactgatggaatcgtttctgtttttttgtcggagccacgaatggttgtaagctttccgtaaaactccggaacatccgcaccccagctgtcatcctctggttttcttcccgctctgagtgcgtcttcctgtccgtcaattccatatttgataaagctagaatcttttccatggatttgataacgaggtccgtttgccggaacgattgatcctccgtatagaatggcttgaagcttgccataatccagggttaaatgaaaatagtcaaccgtttcggcattttcccgctgggccatcacgtttgcagtcacggctttaggcatcccaaacaaatgcagggtttggtctatgatgtgggagccgagatcatacagcgtaccagtggcagtgccttctttttcccgccaccgcgcttgaacttcaggtctgtagcggttataggaaacttgatatgtattgatatcttcaagggatccctcagagatcagctttttaatcgttaaaaaatcgttatcccagcgtcggttatgatatacgcttaataatacgcctttttcatcggcagccctttttaatgtttccccctcttcggccgttgctgtcattggtttttccatcacaacatgttttccggcctgtatgcatgccatagtatgctcgtaatgaaggccgctcggggtggtgacaatgacaagctcaatggcagggtcatttgtgatttcttcaagctcatgtacaacctcagcatctggaaaatcccgtttcacttcttctgtccgtgatgtcatgattttgctgatttgatattcatccagaacatccagcagcggcccgtgaaaaacagaaccggacaatccgtatcctaatattccaaccttgatcgtatccacttttcttctcccctttaaaagcgttatcaacagaagtatataccctcctgatcaaatggtaaaacctaactgattcattttttgcgtcggcatgcttagacaaccgtttggacaatcagtataatgggaattaatatcattaaacagaggtgtacgcatggaaaagcataacgaacataaaacattaaaccataaaagctcgaaagaaaaggatcagattacaaaccggcttaagcggattgagggccaggtcagaggcattcaaaacatggtggaaaacgacagatattgtgtagatattcttgtgcaaatttcagctgttcaggcggcaatgaaaaatgtggcgcttcatttgcttgaggatcatgcccatcattgtgtagcagatgccatcaaaagcggagacggggaacaggccatttctgagcttttggacgtatttaaaaagttcacaaaatcataaagcgttttttattgtaataccctacgggggtatggtaggatgaaaatagaaagaataaacaggaggaattgatatggaacaaaaaacattgcaagttgaaggaatgtcttgtcagcactgcgtcaaagcagtagaaacaagcgtaggagaactggacggcgtcagtgccgttcatgtcaatctggaagcgggtaaagtcgatgtttcgtttgatgctgacaaagtatcagtcaaagatattgcggatgcgatagaagatcagggctatgacgtagccaagtgattcaaggtatcgcgcctttagggaggcgcgatatttctttcatttttatataccccccaggtgtatataaaggagtgagtatgttgagtgaacaaaaggaaatcgcgatgcaggtctctggtatgacctgtgcggcatgtgctgccagaattgaaaaaggcctgaagcggatgcccggtgtcacggatgcaaatgttaatctggcaacggaaacatcaaatgtaatctacgatcctgctgaaacagggactgcagcgattcaggaaaaaatagagaagctgggctatcacgtcgttacagaaaaagctgaattcgatattgagggcatgacctgtgcggcttgcgccaatcggattgaaaaacggcttaacaaaatagaaggcgtcgcaaatgcaccagtaaacttcgctttagaaacagttacggtcgaatacaatccaaaagaagcgtctgtcagcgatttgaaagaagcggtagataagcttggatataagctaaagttgaagggtgaacaggacagtgaggctgctgctaaaaagaaagaagaacggaagcaaacggcgagactgattttttcagctgtcctgtcatttccattgctttgggcgatggtgagccattttacatttacatcattcatttgggtaccggatatatttctcaatccgtggatgcagtttgcgctggcgacaccagtccagtttctgatcggctggccgttttatgtgggtgcgtataaggcgcttagaaataaaagcgccaatatggatgtattggtcgccctcggtacgacggctgcttacgcttatagtctttatctaacttttcaaagcattggctctcacgggcatacagacggcctttattatgaaacaagcgcgattttgctgacgctgattttattaggcaagttgtttgaaacaaaagcaaaaggccgttcctcggatgcgattaaaaagctgatgaagcttcaagcgaaaacagctactgttgtaagagacggacaggagcaaatcatcccgatcgacgaagtgcttgttaatgacattgtttacgtcaaacctggcgaacgaattcctgtcgacggagaagtggttgaaggccgttcagcggttgacgaatcgatgattacaggagaaagtcttcctgttgacaaaaatcctggtgacagcgtgacaggttcaaccgttaacgcaaacggctttctgaaaattaaagctgtcaacgtcggaaaggatactgcgctttctcatatcatcaaaattgttgaggaagcacaagggtcaaaagcgccgatccagcgtctcgctgaccagatttcaggcatttttgtacccattgtattggggattgcggttctcacttttctcatttggtatctttgggcggctcctggcgattttgccgaagcgatcagcaagttcattgcggttcttgtcattgcctgtccttgcgccctcggtcttgccactccgacgagcataatggctggatctggacgcgctgctgaattcgggattttatttaaaggcggcgagcatttagaaaaaacacatcgtctcgatacaattgttcttgataaaaccggaaccgtgacaaacgggaagccgcgtctgacggatgccattccattcggccgttttgaagaaaaagatttgcttcaatttgcagcggcagcggaaacgggatcagagcatccgcttggcgaagcgattattgctggcgtgaaagataaagggcttgagataccgaaacttacccgctttgaagcaaaagtcggcgcaggcattttggctgaagccggaggaaaaagcattctcgtcggcacaagaaaattaatggagagcgaacaggttgagcatggggctcttctcgcccaaatggaagagctagaggccgaagggaaaacagttatgcttgtatccattgatggagaagcagcggggctagtagcagttgcagatacgattaaggatacgtcgcggaaggctgttgcccgtctgaaagagttgggtcttgatgtcatcatgatgacaggagacaatcgcagaaccgcagaagccatcgcgaaggaagcgggaattgcgaatatcattgcggaagttcttcctgaacaaaaggcggcggaaatcgcccgcttgcaaaaagaaggccgccagacagcaatggtaggcgacggaattaacgatgcgccggcgcttgccacagctgacatcggcatggcgattggaactggcacggacattgccatggaaacagcagacattacacttattcgcggcgatctgaacagcattgccgacgcaatccgcatgagcagattgacaatgaaaaacattaaacaaaacttattctgggcgcttggctataacagcctcggcatcccaatcgcagcacttggatttttagcaccgtggatagcaggagcagcaatggcattcagctccgtttccgttgttctgaatgctcttcgtctgcaaaaagtaaaatgaaaaaccggctatatgccggtttttgtttttcattgacactttcttggaaaacaacatataataggtgtaacttatatatgagtatatgctcatatatataaaataaatacaatactcattgatacgctttgaagagggaaccctaaatcggaaggtaaggtgagactagtgaaacaggaatatgttctggacggtttggattgcagcaattgtgcccgaaaaatcgaaaatggagtcaaaggcataaaaggcattaacggatgcgcggtaaattttgcggcaagcaccttaactgtctcagccgatgggaaagaagagcaatgggtcacgaataaagtagagaaaaaagtgaaatcaattgatccgcatgtaacggttcgccaaaagcatataaagaaatcagctgatgatggctatcgtaatcgaatggtcaatatgctgatcagaatggcggcggctgtcattctcggcgcagcggcatatttggttcagtcgggaaccattgaatttttccttttcctcggtgcttatttgattatcggcggtgacattataatccgcgcagtcaaaaacatcatccgcggtcaggtgtttgatgagcatttcttaatggctcttgccacaatcggcgcttttctgattcagcaataccctgagggggtcgccgttatgctgttttatcaaatcggtgagctttttcaaggagccgcggtcagccgttccagaaaatcaattagtgcgttaatggacatacggcctgattacgccaatctcaaaacaaagaacggcatcgaacaggtttcgtcggaggacgttcagacaggagacatcattgtggttaatccgggagaaagcatacccctggacggtaaggtcgtgcaagggtcagcgatggttgatacatctgctttaacaggtgagtccgttccgagaaaagctgcggaaggacaagatgtaatgtcaggctttatcaatcaaaacggcgttctgcatattgaagtcacaaagggctatcaggaatcagcagtatcaaaaatattagacttggttcagaatgcgagcagccgtaaagcccggacagaaaactttatcacgaagtttgccaagtattatacacctgctgtggtgatcattgcggtattgctggcctttgttccgccgcttgttctttctggcgccgcgctttccgattgggtgtaccgcgcgcttatctttttagtgatttcttgtccttgtgcgcttgttgtctctattccgctcggtttcttcggtggaatcggagcggcctcaaaggccggagtgcttgtaaagggaagcaattatttagaagctttgaatcaagtcaaatacgcggtgtttgataaaacgggaacactaacaaaaggcagctttgaagtgacagaaatcaaacccgcggaaggttttacaaaggatagattacttgaagcggcggcatacgctgagcttcattcacagcatccgattgctgaatctgtgcgtaaagcttacgggaaaatgctttcctccgatgagattgagtcatacgaagaaatctccggtcacggcatttttgcaaaggtaaatggaactgagatccttgctgggaataaaaagctcatggaaagagaacaaattgaggatgtcccggatgaaaatgctggaacaatcgtacacgttgctgtagatcaacgctatgccggagcaatcatcatagcggatgagataaaggaagacgcagcacaggcggttgctgatctgaagtcgcttgggatcaaacagacagctatgctgacgggtgattcgaaacaaacgggagaagccgtcggaaaacagcttgggattggtgaggtatatgcagagctgctgccgcaagataaagtcgcgcaggtcgaagcattagaagctaagcttttgcctagtgaaaaactcatttttgtcggtgacggcatcaatgatacgccggtgcttgcacgcgcagatataggggttgcgatgggaggccttggctcagacgccgcggtagaagccgcagacatcgtgctgatgacagatcagccgtcaaaaatagcagaagcgattcggattgcgaaacggacacggcgaatcgtgtggcaaaacatcggctttgctttaggtgtgaaagcgatctttctcattcttggtgcatttggaattgcgaccatgtgggaagcggttttctcagatgtcggcgttacactgcttgctgtggcgaacgccatgcgcgtcatgcgtctcaaaaacaaataaattgtcggagagaattcattttttcggggttttcttatcagcgcttgtcttgttaaaataaagaagtgggtcaattgcgatccgcttctttttaattttaaaacgatgaggtgtcggagtgaaaaagaaacagcagtcttctgcgaaattcgcggtcatccttacggttgtggttgttgtattgctagcagccattgtcatcattaataacaaaacggaacaaggcaatgatgcggtgtccggacagccgtctatcaaagggcagcctgtgcttggcaaggacgatgcaccggtaactgtagtagaattcggagattacaaatgtccgtcttgcaaggtgtttaacagtgacatctttccaaaaatacaaaaagactttattgataagggcgatgtgaaattttctttcgtgaacgtcatgttccatggaaaaggttcaaggttagcggctcttgcatctgaagaagtatggaaggaagaccctgactctttctgggatttccatgaaaagctgttcgaaaaacagccggatacggaacaggaatgggtaaccccaggcctccttggtgatcttgcaaaaagcaccacaaagataaaacctgagacgctcaaggaaaatcttgataaggaaacattcgcttctcaagtggaaaaggattctgaccttaatcaaaaaatgaacatacaggcaacaccgacgatttacgtcaatgataaagtgatcaaaaattttgcggattatgatgaaatcaaagagacaatagaaaaagagctgaaagggaagtaacaatatgaaaaatagaatcgtatttttatatgcttcctgggttgtggctcttatcgctatgctgggcagcctgtatttcagtgaaatcagaaagtttattccatgtgaactgtgctggtaccagcgtatcctcatgtatccgctcgtcctgattttaggcatcgccacctttcaaggggacacacgagtgaaaaaatatgtgctcccgatggcgattattggggcattcatttcgatcatgcattacttagagcaaaaagtgcccggctttagcggcattaagccatgtgtcagcggcgtgccgtgctcgggccaatatattaactggtttggttttattacgattccattcctggccctgattgcttttatcctgattatcatttttatgtgcctgctgaaaggcgaaaaatctgaataacaaaaaaagcgcccgcgtatgccgggcgcttttttaatttcgcaaactcatgtccatcagcaatagccgtattccctctaaatttatctttttttctcatgaaaatgttattgattttacgctggagcgattataaaatctagaggtcgtcagaaaatttaacaaacataaaagggagtcatcagaatggcttgggagctgcttagtgtgattggcatcattgcgtttgcagtcagcggcgcaattgttgcgatggaagaggaatatgatattttaggagtttatatattagggattgtcacagcttttggaggaggagcgatccgcaatttgctgatcggtgttccggtgtcagcgctatgggagcagggagcgtactttcaaatcgcgcttttatctattacaattgtgtttctgtttccgaagctgctgctgaagcattggaataagtggggcaatttatcagatgcgatcggcctcgctgcctttgctatccaaggcgcactgtatgccgtcaaaatgggccatccgcttagtgccgtgatcgtggctgcggtgctgacgggaagcgggggcgggatcatccgcgaccttcttgccgggcgcaaaccgcttgtgctgaaagcggaaatctatgcggtatgggcggcgctcggcggtttaatcgtcggcttgggctggctggggaactcgttcggcttatacgttctgtttttcgtgctcgttgtttgccgggtttgttcctatatgtttaattggaagctgccaaaccgttcttttcgcttagataattaatagcaaaaaaaccgatttcgaagtgaaatcggtttttttctgcataatataaataacccaaaccttgattggtattgggtgaatgtgctattataaattgtatttgccagtttgcatcatatatttaatatatgtatccaattatattttacagtatttcatctatgtttgtcaactattttctggaggtgccgttcatgaatcagcaggataaggaatggaaggaagagcagtcgagaatagatgaggtgctgaaggagctcgaaaaaaaagagcggtttctggaaacgtctgcgggcgggttgaagcatgatatcatcggattaagaaaaagcttttgggaggatgttaaggttaattttgatgatgcccatgaagcgattgaaacgatggctagcattaagcagcaggcagagctgctgtctgatcgggaacacaatcatcggcgcatggatcagcagctcaaacgaattcatcaattgaaaaaatcgccttatttcggccggattgattttattgaaaacggcgaggagcaggcagagcgaatttatatcggtttagcttcctgtttggatgagaaggaggaacactttctgatctatgactggagggcgccgatatcaagtttgtactacaattattccccaggaaaagcggagtacgaggtgcccggtgaaacgatagaaggggaaatggtgctgaaacgccagtttatgatcaaaaacggcactctcaaggcgatgtttaataccgatatgacgattggcgatgaaatgctgcaagaggtattaagccatcactctgatacccaaatgaaaaacatcgtgtctacgattcagaaagaacaaaatcagattatccgtaatgaaaaaagcaagatcctgatcgtgcagggagcggctggcagcgggaaaacatcggctgcgcttcagcgtgtcgcttatttgttatacaggcaccgcggtgtcattgatgccggacaaatcgttttgttttcacccaacttcttatttaacagctatgtctcctctgttttgccggagttaggagaagagaatatggagcaggcgacgtttcaggaatatatcgagcatcgtcttggccgcaagttcaaatgtgaaagcccctttgatcagctcgaatattgcctgaccgaaacaaagggaggcgattttccaacaaggcttgcaggaatcacatggaaggcgggtttatcctttcagcaattcattaatgaatacgtcacacggctttcctctgaagggatgatttttaaaaatattatattccgcggacaaaagctgatcacaaaggagcaaattcaatcctatttttactcattggatcaaaatcactccattccgaatcggatggagcaaaccgcgaagtggctgctgagtgagcttaacaagcttgagaaaaaggaacggcgaaaggattgggttgttcatgaagctgagctgcttgacaaagaggactacttggacgtgtacaaaaaactgcaggaaaggaaacggttcagcgagagtacgtttaacgattatcaaagagagcagcagctgcttgccgccatcattgtgaaaaaagctttcaaaccgctcaaacaggcagtcaggctccttgcatttcttgatgttacacaactttatttgcaattgttttctggctggggaggaaaatttcaacatgagaagatggatgcgataggtgagctgacccgttcggcatttacggataataaattgctctatgaggacgcggcaccgtttctttatatgcaggatctgattgagggcagaaagaaaaatacgaaaatcaaacatctatttattgacgaagcccaggactattcaccgtttcagatggcttacatgagaagcatttttccggctgccagcatgacagtgctcggtgatatcaatcagtccatctacgcgcataccataaacggggatcagcgtatggatgcgtgctttgaggatgagcctgctgagtatgttcgtttaaagagaacatacagatcaacaaggcagattgtcgagtttaccaaagcgatgcttcaagatggagcggatattgagccgtttaatagaagcggggaaatgccgctcgttgtcaaaactgaaggacatgagagcctttgccaaaagctcgcgcaagaaattggccggctcaagaaaaaagggcacgaaacaatagccgtcatctgcaagactgcgcatcaatgcatacaggcgcacgcccacatgagtgaatatacagatgttcgcctgattcataaagaaaatcaaccatttcaaaagggtgtttgcgtgattccggtgtatttagcgaagggaattgaatttgacgcagtgcttgtctatgatgcatctgaagaacactatcatacagagcacgaccgcaggcttttatatactgcgtgcacccgtgcgatgcacatgctggcggtattttatacaggtgaagccagtccgtttgtaaccgctgtgccgcctcacttatatcagattgctgaatgaagagaagggagtccttctcttttttctatttacatgaagcatagccgttttatcattaggattcttaatagttatcatcatgtaaatatattttacttaagcctagtattccggtaaagttcaattagatgcaattttcgatcagtttataactttgtgaggtggatacgttgcaacttcaggtaatgaacagtccgtttaatcaggagcaggcagagctccttaaccgccttctgccgaccttgaccgaatcccagaaaatctggctgagcggatatttatccgctcaatctgtttccgcccaagaagctgcgggtacgccggcggcagctgtgtcagcggaagcaccggcaccggccgtttcaaaagaagtgaccgttctttatggttcacagacgggaaacgcacaggggcttgcagaaaatgccggcaagcagcttgaacagagcggttttcaagtgaccgtctcatccatgagcgattttaagccgaatcagctgaagaaggtaaccaatcttttaatcgtcgtcagtacgcatggagaaggcgagccgcctgataacgcgctgtcgtttcatgaatttctgcacggaagacgggcgcctaagcttgaagacctgcgcttttccgttttggcgcttggtgacagttcgtacgaatttttctgccagacagggaaagaatttgatcaacgcttagaagaactcggcggaaaacggatttctccgcgcgttgattgcgatcttgactatgatgaaccggcagccgaatggcttgagggtgtattgaaaggattaaatgaagctgggggcggaagcgccgcgcctgcgccggcggctgcgtcacaaaccggtgagtcttcgtattccagaacaaacccgtttcgggctgaagtgttagaaaatttaaatttaaacggcagaggatcaaataaagaaacacgccatgtggagctgtctcttgaaggatctggcctgacttacgagcctggtgacagcctcggcgtctatccggaaaacgatccggaacttgtcgagctgctccttaaggaaatgaattgggacccggaagaaattgtgacgcttaataagcaaggtgatgtccgaccgctgaaagaagcgctgatttctcactatgagattaccgttctcacaaaaccgcttcttgaacaggcagcccagctgacagggaacgatgagcttagagagcttttagccccgggaaatgaggagaatgtaaaagcctatattgaagggcgcgatttgcttgatctcgtccgtgactatggcccatttagtgtatctgcgcaggagtttgtctcgattttgcgaaaaatgcctgcccgcctttattcgattgcaagcagtttatccgcaaatccggatgaagtgcacttaacaatcggcgcagtccgctacgatgcgcacggccgtgaacgaaaaggcgtctgctcgattttgtgcgcggaacgactgcagccgggagacacactgccggtttatgtacagcacaatcaaaactttaagcttccgaaagaccctgaaacaccgattatcatggtgggccctgggacaggcgtcgcacctttccgttcgtttatgcaggagcgtgaggagacgggagcggaaggaaaggcatggatgttctttggcgatcagcactttgtcacggatttcctttaccagacagagtggcagaattggctcaaagacggtgtgctgacaaaaatggatgtggcgttctcacgtgatacggaagaaaaagtatatgtgcagcaccgcatgcttgaacatagcgcagaattgtttgaatggcttcaagaaggagcggctgtttacatttgcggagatgaaaagcacatggcgcatgacgtccataacacattgcttgaaattatcgaaaaagaaggcaatatgagccgcgaagaggcggaggcttatcttgccgatatgcagcagcaaaaacgctatcagcgtgatgtatattgatttgacttgaaaggagtttttcaacatggtgaccaaaattctaaaagcaccggacggctctccaagtgatgttgaacgcattaaaaaagaaagtgattatttgcgcggcacgctgaaagaagtgatgctcgatcgaatcagtgcgggaattccggatgatgataaccgcctgatgaaacaccacggcagttatttgcaggatgaccgcgacctccgaaatgaacgccaaaagcagaagcttgagcccgcatatcagttcatgctgcgcgtgcgtatgccagggggcgtctcgacgcctgaacaatggcttgtcatggatgacctgtcccagaaatacgggaacggcacattaaaattgacgacacgtgaaacattccaaatgcacggaattctgaaatggaacatgaagaaaaccattcagacgatccactcagcacttttggatacgatcgcagcctgcggagacgtaaaccgtaacgtcatgtgtgcatcaaacccttatcaatctgaaatccactcagaggtatacgagtggtctaaaaaattaagtgatgatctgctgccgcggacgagagcatatcatgaaatttggcttgatgaggaaagagttgccggcacgccggaggaagaagtcgagccaatgtacggaccgctctatctgccgcggaagtttaaaatcggtattgccgttccgccgtctaatgatattgacgtcttttcacaagatctcggattcattgcgattgtcgaggatggcaagctgatcggttttaacgtggcaatcggcggcggtatgggaatgacgcatggcgatactgcgacatatccgcaattagccaaggtgatcggtttctgccggcctgagcaaatgtatgacgttgctgaaaaaacgattacgattcagcgtgattacggcaaccgttctgtccgtaaaaatgcgcggttcaaatacacagttgaccgcctcggtttagaaaacgtaaaagaagaattggaaaaccgtctcggctggagcctggaagaagcgaagccgtatcatttcgatcataacggcgaccgctatggctgggtggaaggcatcgaggataaatggcatttcacgctgtttgtcgaaggcggccgtataacggattacgatgattataagctgatgactggcttgcgggaaatcgccaaagttcatacaggtgagttccggctgacagccaatcagaacttaatgattgcgaacgtttcaagcgataaaaaagaagaaatcagtgctttaattgaacagtacggactaactgacggcaagcactattcagcgcttcgccgcagctcgatggcgtgcgtcgctcttccgacctgcggattggcaatggctgaagcagaacgttatttgccgaccctgttagataagattgaagagattattgacgaaaacggccttcgtgatcaggaaatcaccattcgcatgacaggatgcccgaacggctgtgcacgtcatgcactcggtgagatcggatttatcggaaaggcgccgggcaaatataatatgtatcttggcgctgcgtttgacggaagccgtttaagcaaaatgtaccgtgaaaacatcggtgaagcagacattttaagcgagctgcgcatccttctttcccgctatgcgaaagaacgcgaggaaggcgagcatttcggtgactttgtcattcgcgcgggcattattaaagcaacaactgacggtacgaattttcatgattgagaaagaaagacgagagacagggagtagcttcctgtctcttttttctataatttgctcttctgcaaaaaagttcactgtgagcatatcatgagaaaaaataccctaaaaagggtactataaaagaagacaagtgtggagagaactcctgcgaaaccacatagcggatgcaaggccaccctagctcaagggcttttagacaaacagattttttggctcatcatgccgacacacaacagacgaaggaggtcatgcatttggacatatttttagttgtgctcgtattattaacgattattgcgatttctaatatcgtgaaccggtttattccgtttattccggtgccgctgattcaagtggctcttgggattcttgccgcctcatttccacagggacttcattttgaattaaacaccgaattgttttttgttctttttatcgcgcctctgctatttaatgatggaaagaggacaccgcgggcagagctttggaatttaagggctccgattttattgcttgcactcggccttgtatttgcgactgtgattgtaggcggctacacgattcactggatgattcctgctattccgctggcagcggcctttggacttgcggccattctttcaccgactgatgtcgtcgctgtcagcgcattatcaggaagagtgaaaatgccaaaagggattcttcgcctgctggaaggtgaggggctgatgaatgatgcatcaggtctggtggcctttaagtttgcgattgcagcggcagtgactggtgcattttcattagcacaagcggctgtcagctttgtctttatttctctcggaggcttgctgtgcggggttgtcatttcatttttgattattcgttttcgcctatttctgcgccgccttggcatgcaggatgtcacgatgcatatgctgattcaaattctgacgccgtttgtgatttatttggcagctgaagaaatcggcgtttcgggcattttagctgttgtagctggcggtattacccatgcggttgaacaggatcgtctggaatcaacgatgatcaagctgcaaatcgtctcctcaagtacgtggaacattattttatttattttgaacggcctggtcttcgttattctcggcacgcaaatccctgatgttatttctgttatctttaacgacactgccatcagcaacatgaaggtgatcggctatatcctagtcatcacatttacattaatgctccttagattcctgtgggtgctgttcttctggaacggcaaatggttctttaataaagatcagaacatctataaaccgggtcttcgttcgacgctgttaatttcgatttccggtgtgcgtggagcagtaacgcttgcaggttctttttccattccgtatttcctggaggacggtacgccgtttccggaaagaaatctgattctctttttagcagccggcgtcattttatgcacgcttgtcattgccaccgttgtgctgccaattctgactgaaaaagaagaagaggacgaggaacgaaataagaagctgctgacggcgagacgcaagttgatcaaaacagcccttcaaacgattaaagaggacatgaatgagacaaacaaaacggcctctcttgcggtgatagctgaatacaatgagaaaatgaaaaatcttcgttttcagcagtatacatcatctaatcgcattaagaagcacgagcgaaaagtccgtgcgcagggggttaaggctgagcaagaggcgctgatgaaaatgctggagcggggagacatcccggaagaaacagcaaatgtgctgcaagaacgatttaacgagttggaaattttgtatgccaacccgtttaaagtcgggttatcaaaaacaaggctcaagaggctgatgtattggattttcttcggtgaacataaaaagccggagatgtcgattttaaatgaagcgggattgatacgggcaacaagagtgaaaacggcaaaagcagcgatagaatatctggaaaaacataagacggatgagcataaagaagtgtttttatctgtcattacattctataagcagttaattttcaggctggagcacagccatcatgagttaaaatcaagtgcccattttgaaaatcagaagctggaagtgaagctgaaggctgtgcaggcgatcagaaatgaaattcaaacgctcttcgaagagagggaaatttcccgggacatctcccatgagcttcgccaatacattaatgatgtcgaagccgccatgcttgaaggcggcgaataaatgcagaaaaaaagctggcgttagagcgccagctttttttattattaagggcgatgaaatgcgacagtgctgccatcccggtcgaaccagcctctgaaggcccagttgatccagccgccatcgcctttgtttgtaaaggttccatcttcaaatacccaaatgccatacgtaatgccgtcgtaaacggctgagccgtaaaattgcacaccgttcaaatgatcttcatattcctggcttaaattaaagaccatgacgttatatttttggccggacgcgtagaaggaagactccatgaggtttttcacaaagccatccctattctgtgcggatttgatggcatcagcgatctggttggcaattccaagtacatccaggttgacgtttaaacctacatcagcggcagttgttccagcagtagttgtctgcgacatcttcggagcaggattttcttcagcggaagcaaaggacaaaggggcaattgtcaaagcggcaccaagagcaagtgtcattgggatacgaatacgtttcaagttgtttcctcctttgttttcatttggttacactacacgcataccctgctcaatgtatttgtaatctcaatattgttaaaataggaaaaaaatagtgtttggatttgcctgtgctgtgaaaaaagaagcaaaaagagggtcttaagcgtattattggtatcggctgagaggaatgtgagataatatagacgcttacatttcagtgaaagggtggaggttcaagtgccaacaagtttaaaagatactgtaaagttacataacggagttgaaatgccttggttcggtctgggcgtttttaaagtagaaaatggtaatgaagcgactgaatcagtgaaagcggcaattaaaaatggctatcgcagtattgatacagcagcgatctacaaaaatgaagaaggcgttggcatcgggattaaagaatccggtgtggcaagagaagagctcttcatcacatcaaaagtgtggaatgaagatcaaggctatgaaacaacgcttgctgcctttgaaaaaagcctagaaagactgcagcttgattacttagatttatatttgatccattggcctggcaaagataaatataaagatacatggcgcgcgcttgaaaagctgtacaaagacggcaaaattcgcgcgatcggcgtcagcaatttccaagttcatcatttagaagagctgttgaaagatgctgaaatcaaaccgatggtgaaccaagttgaatttcaccctcgcttgacgcaaaaagaattaagagattactgcaaagggcaaggcattcagctggaagcgtggtctccgctcatgcagggacagcttttggataacgaagtactgacacagattgctgaaaaacacaataaatctgtggctcaagtgattttgcgctgggatctgcagcatggagttgtaaccattccaaaatccattaaagaacaccgtatcatcgaaaacgctgatatttttgatttcgaattgtctcaagaagacatggacaaaattgacgcattaaataaagatgagcgtgtcggtccaaatcctgatgagcttctgttttaatcaaaaaactccccgttatggggagtttttttagtgcgtttttttctgttgaatgaaaaacagcatcaaaaaggaaatgacaacaatacagacgacccacgcccaagcaagggtattgttgccggaatccaatgcgacatatatcgccgtcggcagtgtttgcgtaacaccggggatgtttcctgcaaacatgagtgttgcgccaaattctccgagcgcccgcgcaaggctaaggatgcttccggtcagtaacgaaggataggcaagcgggacggagatatggataaacactttccatctgctagcgccgtctaccattgccgcaccttgtatatcgggatcaatgtcagcaaatccggttttggctgattgatacataagcggaaaggctacaacagccgaggcgatcacagcggcccaccaggtgaaaatgacaggctgctggaaaatccactcgatggcttgtccgatgaagctgtgctttccgaaaatgacgatcagaataaaaccgacaacagtaggcggaagaacgagcggaagcataaaacatgtttcgagtgccgtttttccgaaaaatgatgcccgtgacatccatgctccagcaagtgttccgagaataatgacaacaattccggcaactgccgccacctgaaaggaaagcacaacgggtgtgaaaaattctgaagcgcttatgctactcggcagtaaagccatatttctcaaatactttcattgcttcatcagattgcaggtattcgtaaaattccttcgcttccttacggtgttttgtatcttttacgattcctaacggatagacaattgggctgtgtgtatctgcttttgcctcgtcaacaatgttgacctttttcgagactagggcatctgttttataaacaacacctgcgtctacattgccggtttcaacataagaaagaacttggcgaacgtcttttccatacacaattttatccttcactttgtcccataaagacagctttgtcagtgattctttcccataagctcctgccggtacggattccggagtgccaagagcgattttttctgattcagccagattgctgaagcttgtcacaggtgaatctccgtttttcggtacgaccagcacaatttcattaccgactaattcagtgctgtctttttttgcgatatctccatcatccaccagctttttaaatttatcctcagcagctgagaagaacagatctgctcctgctccttgagaaatctgtttttgcaaggcgccggatgagccatagttatcttggatggttatatgttgatgatctttttcataatttttttggatttcctcaagtgcatcctgcgcgctggcggcagctgagatggttaacgttacttttttctcgctgtccgttgaagactggtttgaagaacagcctgctacaagcagaaaagcagttaaggctgcgatgaaaatagaatacttcttaaacatgattgcaccccttatcattagatataactaattataactgattatgtttggtttatgtgggtttttttacattcggcgaaaaggtataataaaataggagagtgatgatgatgaatgaaacctcttcctatacgatagaagaagttgcaggtctgctgaaggtatcaaagctgaccgtttatgacttgattaaaaaaggcgtgctgcctgcttaccgtgtcggaaggcagatgcgtgtggatgaagaagatttaaagcaatataaaacgaatatgagaatgtctcagcccatcgctgcaaaagaagcgccgaaacaggtgcaggaggctgagccggacggcagaccaaatgtcatgatcagcggacaggacatttcgatggatatcctcagcaagcatttggagaatgccattcaggagacgccgctccgtaaatacaaaggaagcttaaacagcctgattgatatgtatcaaggcaagtgtgacattgtcagcctccatttgtacgatgcagaaacgggccagtataacgcgccttatgtaaaacggattttgacaggtgaaccgttttgtctcatcaatgtcgttctccgcaaagcaggactgtatgtgcaaaaagggaatccgaaaaacattcaaggctggaaagacttgaaaagagccgatatccggatcatcaacagggaaaagggttctggcgcaagggtgctccttgatgaacagcttggcttgcttggtgtgaatccggctgatgtagtgggatatggcgatatcgtgactgatcattacgctgccgcttcacaagtttcaagcggacaggctgacgcgggaatcggggcacagcacgcggcacatatgggcagtgttgattttatcccgctcatcgacgaacaatatgatatcgttgttttgaaaaaaaatgagcagttgctcaaagccgtgaaggagattttgaattctgaggactacaaggcgaatctgtctcatttaaacggctatgaaacgaagctgactggcaaggtgatattggaaacgtaaaaaatccctcttgatagagggattttttcattcggaaaacctgagcaggtcaccatttaaaattttatcagagagagacagttcttcgtttgctttctccttgtaagggaggcacgcatcctgatcttccagcacttcacctgttttttggctatagcacgtgttctttgtgtatacataatcgttcgtaataaagctgccgtttcgcagaacggcgaatggggtgcggtcgcccgacagcaaatcattgccgaattggatatcgccttttgtctcaacgccgagcaaatgcatcagcgtcggcctgacgtcgacctgtcccccggcatcagggatggtttccggctgttgatcggtgattcccgggatatgtatgataaacggcacccgctggagctgaacgttgtcatacggtgtgatttcgtctttccctaaaaactcagccattgcctcgttatgggcttcagaaatgccgtaatgatctcccataaatacgatcatcgaattttcgtataagccttcgtccttcagttttttgataaaatgcttcaatgcttcatcctcatagcgaaccgtggtcacatagcggtttaacagatcactgcttgaatcgaattcatctatcagctgatccttttcatcaatctcaaacggaaaatgattcgttaacgtgataaaactgctgtagaacggctgcggtaggcttttcagctttttggcggactgctctaaaaattctttgtcttttaagccccagcttgtcgatgtcccgggagtgacatgaaaatcatcaacatcaaaaaagcggtcaatgccaaatgtatcgtacatgacatctctgttccaaaatgttttatggttagcgtgaaagacggctgaataataatcgtgctgcttcagcgatttatacatcgtatgaaattgatggtcgcttttcgtgaaaaagacggcgccgctaagggagggatacagtgagttagcgacgataaattctgaatctgatgttttgccttgttctgtttgctgatagaaatgatcaaaggaatagcttttttttatgagatcattcataaatggggtaatttcttttccatttactttttcattcagaacaaagctttgggtcgactcaagtgttacaaagatgacattgcgcccctttgcaagaccgaatttgctttgatcaggcttgctgtaatcagcctctgtgtagtttttaatggcagttatactgtcttcatcggcaaaagctttcgcgctgatattaacagtctgagaaattgtatcgtaaatatggaactgaaacaggccgatgcttttgactagcatttcccggtcaaaagaatgtgccaaaagcttcggctgctgtacttctgcaagtgccagtgtgcataaaagcattccgcaggaagctgcatagtaccgtttgatcgtgtggggagcggcttttgtctgtgggtgtttggtttttctggcgaacaacagcagaaaaaccaaatccacaaacagggcgataaacagaggatggaacagttcttttacactgctgcccatatcgctcatgttgctggcctgaaataaaaccgggatggtaataaaatcgatataaaagccgtaaaaaatcgtattagagatcaagataacagtcagaaccaaattggcaatcagcaaaaaggcccgctgcttgttttcttttagaaacaggccgatcccgaataaaggaagaataaagctgagcgggttgaccagcagcattagctcctccaacagagtatcgatttgcaaatcaaagccgagtttatatatcacatacgttttgatccacataaataagatcgaaaaacataaaaaccgctgattgtgaaaaaaggttcctttcatcaatatgactcctcacgttttcttgatcatctgcatgaaatgcttcttaagtaaaacctactaaaaacagccggttcagacaagtctcagcactcatgtttaaaacatgcggccatgaaacagcatataaaagtagtaacatgaagcaagggtcaggccggctagcacgagctgctcagaaaaactgcctgtcttcatatataatggaagccgaacgcggatcgtggaagggaataataatttgattccgttcaccgtccaagcgtcaagaatcaagtggctcgccattccgatcatcaggccggctgatatgtttttatctggaatgtatgtagaagtgataaaaaacatgatgagcataaacagcaggctgtgtgtaaaggtgcgatggccaaaaacggagctgaccactttcgataaaatggaaattttctcccgattttgctttgtgtgtggcagatatcgggtattaatgctccaaccgcgcctgacgcagccataagcactggatcaaatccataataataagccgctgccgtacaagaagcgatgcctcccatgatgtgtgtttttcctgtcatttgccgcttctccttttatcttttgcaaaaaatctctgaattacaaatatatcaagagaatgtatgtttgatcaacaggactttggacgataaaaaatatcccgcataatttttcaggaaaaaggcatcttaaacatgtacctattttttaaaagaggtgatacgaatgggtttctttaataaagataaaggaaaacgttccgaaaaagaaaaaacgtaatccaaggagctcttgaagatgctggttcagctctaaaagatgatccgcttcaagaagctgtgcaaaaaaagaaaaataatcgataaccacatgcggatagggcttggctctatccgtattttccatctgttccctttgacagatcatcctttctttgataaccttctgggagtaactgaataattaaatcctcactctttctcagtgaggtagaggttgcgcggatgatgagtcacacatgctaggctgacaggggctgttaaacatgtgtaaaaggcatcagcgccgaagtgtggagaaagccgatccttctctatgctgggactgtatctgaataagtgcaggactgccgcgtgctttttcgcggagggctatccggagatcaagggtgtgtgtttctttaagcatggacttttgttcaggctttttttgcgtttatatgatctcggggtctggtccgtacaaagaatcatggaggtactggaatggaacagacaaaaaaatggggtttttggttattaacggcgtttgtcgttggaaatatggttggatcaggaattttctccttgccgagctcgcttgcttcaattgcgagtccgtttggagctacgtccgcctggcttttgacaggtgccggcgtgctgatgattgcacttgtgttcggacacttgtccattcgcaagcctgaactgacagcgggaccgcaaagttatgcaagagcgctgttttctgacccgaaaaaaggcaacgctgccggtttcacaatggtgtggggctactgggtggcgagctggatcagtaacgtggcgatcatcacaagtctcgccggttacttgacttcgttcttcccgatcttggttgataaacgtgagatgttttcgatcggcgggcaagaggtgacactcggccaattactgacgtttgccgtatgtacgatcttgttatggggaacgcacgcgattcttgttgccagcattaacggcgcaagtaaattaaactttgtcacaacgctttctaaagtattaggttttgtcttctttatcgttgccggtttgtttgtgtttcaaacgtcattattcggtcatttttatttcccggttcaaggagaaaacggcacaagcattggaattggtggccaggttcataacgctgcgatttctacactgtgggcgtttgtcggaattgaatccgcggtgatcctgtccggccgtgcgcgctctcagcgtgatgtgaaacgtgcgacaattaccggcttgctgattgccttgagcatatatattattgtgactttaattacgatgggtgttctgccgcatgataagcttgtcggctctgaaaaaccatttgttgatgtactctatgcgattgttggaaacgcgggaagcgtgattatggcgcttttggctatcctttgtttattcggaacgatgctcggctggattttgcttggctctgaggtgccataccaagccgctaaagcaggagatttcccggcattttttgcaaaaacgaataaaaagggaagtccggtcattgcactcattattacaaacgtcatgtcacaggtcttcattttctcggttatttcccggacaataagtgacgcatttacatttttaacgacagcggctacactcgcatatttaattccgtatctggtatctgcaatctacagcttgaaggtagtcatcaaaggtgaaacgtatgaccagctgaaaggctcccgtgtaagagacggattgatcgcgatactggcgtgtgcatactccgtgtttgttatcgtaacaggcacagcagatttaacgacatttatactcggcatcggtttattctttgtcggcttaatcgtttatccatttgtgagtaacaagttccagaaagaaaaacaagcataatgaaaagacacctgatttgctcaggtgtcttttttataaaatcacaatttctcctgttaggaatccgttcgttaaatatgcaaaaaacgtttttcagtctctccagcataaaaaaactgatcgtgatgaggatgcagcttaatatgaatggctcaaagaaaatatccgatatgattcaaattgagccgttccttataaataagcaaaagagccgcgggcaggcggctcttttgtttatttagtcaagctttccgtaataaactccagttgtccttctaatgaaatcgggtctgtgaaatagaatccgatcggatccatcttgtatacatggccatttttaacggcattcaggttcttccaaatggagctttcaaaaacgccgccatcatcaccgcctgattgccatgggcccgcgaaaatgtaatctccggcgaagtcagggagcttctctaatgaaatacttgtataacctggcccctggtcaatggctttttcttttgtcagctttgtagcctgcaggccgaggtctttgtaaatgatgcttccgcctcttccaaagtctttaccaaatacgtaaatgtcttttccgttcgtttgcataatggaaatggttttgtcaccgaccgcttttttgatttttgttttagcggccgcaacttttttatcccacttggccagccatttttcagctttatcttcagttcccgtcatttttgcaaattctttcagctgttcgatgttgtcgagcttatcgtattttactgcgacagtcggcgcaattttttcaagctttttaatatcagcgccctgtgttgtccagacgataatcaggtcagggttcaaatcaatgaccttttcaaccgaagtgccgtctccgatgttttcgacgccgttggtttttcctttgtagtaagggtttttaaatacattctcaggcgcacctacaacgttgatgccgagtgttttgaagtagccgtaatagccgtctgccatgacaaccacccgtttaggatgcttcgggatttttacatttccgttttcagccttgtatgtaaaggtttctgcgccttttgaatcagaggcagaacctttgctttctgagttattcccgcaggctgccagcgctgcaatcaataacagggcaaaaaacgcggctccgagtttcttgtatatatgggtcatatctcataccttctttctaaaagatagatgaaaaagagaatcattatcatctgtgattataccactgcaagtgccggttgacacgatatttttgcaaatgcattttcatttttgttcaaaacactctattaaatcagctgaaaaaagtgatatactgaaacagcaattgataatcattatcagtaacagaaaggaagtacggcagttgagtcaacataaaaatatacggactgcatcagaagaaatccaatggacgtcaaggacatatggcgcggtcatcgtccttatcgcaggtctatgcctgctttgccttggcgcatttttatccatatccctaggtgcagcggatattcatttgcgcactgtatgggaggccatttttcattatcagccgacaaagacatctcaccaaattatacatgatcttcggcttccgagaacggcggctgccgcgcttgtaggcgcattgttggcagtgtcgggagcaatcatgcaggggatgacgagaaaccctttggcagagccttcgattatgggtgtgacatcaggctctgcgtttgcggtttcgattgcgtttgccttttttcccggactttctgcaatggggcttgtgctatggtcctttgcgggagcggggctgggggcatcgacggtaatgggcataggcatgttttcaaggggcggacttacgcctgtaaagcttgctctggcgggtacggcagttacttatttctttaccggcatttcaactgccattgcaatccgctttgatgtcgctcaggatatcagcttttggtacgcaggcggggtagcgggtgtgaaatggtcgggggtccagcttttgcttattgcaggggctgtcggtttaacgctcgcgtttttcatcgcccggtctgttacagtgttaagtctcggtgacgatctggcaaaagggcttggacaatatacatcagcggtgaaactggttggcatgcttattgtagtaattctgaccggagctgcggtttccattgccggcaccattgcatttatcgggctgatcattccgcatattacccgttttttggtcggtgtggattatcggtggatcattccttgctcggcggtgctcggtgctgttttgcttgtttttgctgacatagcggccagactcgtaaatgcgccctttgaaacgcctgtcggcgcgctgacttctcttatcggcgttccctttttcttttatttggcacgtcgtgaaaggagagggctgtaatgaaaacaaaaacaaacaaaccgctcattgtaatggctgtgacctttttgcttatcgtggtggtcttttttatcagtctcaatttgggcgttatcaaaattgcaccgcttaaaacgcttcaggtctttttcggccaaggaacggcgcgtgatgaacttgtcttatttgagttcaggctgccccggatcatcctttctttgcttgttggagcagggatctccgtagctggagccattttgcaaagcgtgtctcaaaatgaacttgccgagcctggtattctcggaattaacgccggcggttcacttgctgtagtgctttttatatacttttttcaagggtcagcttcagatcttagctttttcggaacatttatgctgccgttcagtgctttggcaggagcaatcctcgctgcgtttctcatttatattctggcatggaaaaaaggcgtgacaccgattcggctgattttagtcggcataggggtgaatgccggattcaacgccctgttgctgatttttcagctcaagatggaccctcatgattttatgcaagccgcggtttggatatccggctcaatatggggggcgaactggaatatgatctgggcgattctcccttggattgtgatcttgcttctgtttactttatataaggcacgctatttgaacattatgcagctcggagaccaattggcgaccgggctgggcaccgctgttgaaaaggaaagacggattcttcttctggcagcggtcactcttgccgcttcatgcgtggcagctgcggggggcattgcgtttctcggattgatcgcgccgcatgtggctagaaggctgaccggtccacgtcaccagacgctgataccggtctccgccttcatcggctcattcctgtttttgcttgctgatacgctggcgagaaatgtattggcaccatcagaaattccggtcggacttgtcatttccgtgctaggtgcgccttactttatttatttattgatgaaagcgaattagaggagggggccgaatatgaattcattatcaacggaacagcttggaatcggttatggcgacagggtgattgtagaggatttaaatatatcgattcctaaagggaaaattaccaccttaattggcccgaacggctgcgggaaatcaacgattttaaaaacaatgtccagaattatgcgttcacatgcaggtgccgtctatttaaacggcaaagcgattcataaaatgtctacaaaggacattgcaaaagatatggcgattcttccacagacacctgaagcgccgagcggcctaacagtgcacgaattggtgtcgtacggcaggtttccgcatcaatcaggattcggcagattaaatgacgaagaccgccggattatcaaatgggcgcttgaagaaacaggcatggctgaatatgctgaacggccgattgaggcattgtcaggcggacagcgtcaacgtgtgtggattgccatggcgcttgcgcaagggacggaactgcttctgctggatgaacctacaacgtatcttgatcttgcacatcagcttgaaattctgcagctgcttgacagactcaacaaagagcaagggcggacgattttaatggtcattcatgatcttaaccatgcagctcgtttttctcattatatgatcgcgctcaaaaaaggcacggtcatcaaggaaggaactgctctggaggtcatgacaccagacattttgaagcaggtatttcagattgatgccgaaatcgtgactgatccccgtacaaataaacctgtatgcttgacatatgacttgattaaaaatgaaaaagagctagttactgtatgaaaaaatcccggtttgaagccgggattttttttattcggctttgaaaatacaatttttctatttgattccgtcatttcaataaaaggattgcaagtctttttgaattaatagataatattggttagaatgtttcgaaaatattacatagtttacagaaagaggagatcgttgtgtccaagaagaaaaaatggcttattggcggtgcgatatgtgccggtgtgcttgtattggctgggatcggcgctggcggtttttactttttactcacatgaaccaagttgccgtatcatcggagccctatgctgaatcggtcgcggtatacatgggaggagattcagaatcaggccaaacgttttctggaaaggttgaacctgagaaacagcagaaagtatacatagattcagaaaaaggcagcattaaaaaaacatacgtcaaagaaggcgatcaggttaaaaagggcgataagctttttgagtatgagggcgaggatcattctgatgaagtggagcaagccaatttgcaaattgaaatgacaaatctgcaaatcaaccgtttgcaaaaatcaataacggaaacggaaaaaaagctgaaagttgcaggaaaagaagagaaaaaccagcttcaagatgaacttgatcaaaccaatttcgatttgaaaacaagccagcttgaactgaagcagcatcaaaaagaactggctggcctgacgaaaaacaaaggttccaatgtcattacaagcaagcatgacggaatcgttcaaagcgtcaatcaggatatcgctgacggtgcaacaggcgaccaggcagcaggcccgtatatccagattgtttcgacaggcaaatatctggtcaaaagccaaatcaatgagctgttaatggacacgatcaaaaaaggcagcaaagtcagggtcacgctgaaaacaggcggtgagggcgagtggaaaggaaaggtcacctcgatcggcaagcttccagcgggagcaggcgagggtgaagaatcagaaagctttgctgatgaagaaatgaatccccagtcctctaactatcctttcaccattttattagacagccataaaggtcttgaagtcggctatcatgtcaacatcgaagtgatgagtgataatgctgatgcggacacgatcaagctgccgtccgacatggtcattcaggatgacggcgaaccgtacgtatggaaagctgatgagaatcacaaagcggttaagcagcctgttgaaatcggagagactgatgaaaatgacatggtggaaattaagagcggcctgacgccggaagattatgtgatctatcctgatcccgcggtcaaggaaggaaagcaggttacagtcaatgctgacactgaataatatttcgaagtcgtacaagctgggaaaagaagaagttccaatcttgaaacatatcaatctgaccgttcaggcgggggagtttttagctattatggggccttccggttctggaaagtcaacgttaatgaatattatcggctgtttggacaggccaacctcaggaacctatacgcttgaccagatcgatatattgaaagggaaagacggggctttagccgaaattcgcaatgaatcaatcgggtttgtgtttcaaacttttcatttgctgccgcgtctcaccgcgctgcaaaatgtcgagctgccgatgatctacaataaagtgaagaaaaaagagagaaggcaacgggcatatgaagcgctggaaaaagtcggattaaaagacagggtctcctacaaaccgcctaagctgtccggcggccaaaagcagcgggtggcgatagcgagggcccttgtcaatcagccgaggtttattttagctgatgaaccgaccggggcgcttgataccaaatcaagtgaacaaattttggcactgttttctgaactgcatcgggaaggcaagaccattattatgataacccacgacccggacgtcgccaaaaaagctgacagaaccgtttttatcagagacggagagttggtattagatgagagaggggatatcagccatgcttgaacatattcgaatctcctttcaatccattttctctcataaattaagatcgattctgacaatgcttggcgtcattatcggcatagcggcaatcatcgcgattgtttcaatgctgaagggccaaagtgagcagttaaagcaaagtatgatcggcatgggaaacaacgccatcaatgttgtctaccagccgtctggcggagaagaggagagcggcggccctcaggtgtcgtatgcgtccgcgccgcctgtagcggaagaaacagtaaaggcgatcaaatcagatccgatggtcaaaggattatccttatattacttgtcagaaggcgcgagcgtttttcatttaactaacgtttcgtatccccaagtgtatggagtggacgatgattacttcgacatgtttccaatccgaataaccgaagggagaaagctgacggaaaacgatttaaacagcacacaccaagtagtgatgatcaatgaagctgtcagagatgaactgtttccagacggagaagctctgcataaaagcattgagatgaatggtgtgccgtttaaggtcgtgggtgtttttaaagaaaaaaatcaacaggaaagcatgtttgaaggcgactatgcgaacccggttttgtacgtgccgaaaaaagtgtggccgcttattgaaggatttgacgcgccaacgcagattgccgtgcaggctgattcttctgagcatatccaagaagcgggtgtaatggctgcagatcttttaaatcagggactgtcagaagctgagctggaaaaagcagagtacagtgtaatggatcttcaggagatcgcgcaggaagtggagtcctttaatcagtcatttgcattgctgcttggcggtatcgccagtatttcacttttggtgggcggtatcggcgtcatgaacattatgctcgtttccgtaacggagcgcacgagggaaatcggaattaagaaagcgctcggtgctaagcggcgtgtgattttatttcaatttttaaccgaggctgtcgtgctgacaagcattggcggaatactcggtgtgctggcgggcttcggcatcgccaagctgctgacggtcatttttccgatgccttttatcgtctccattccagctgttgtcggagcactcatcttttcaatggcagtcggcattatcttcggcttgcttccgtctatcaaggcttcgaagcttcagcctgtagacgcgcttcgctatgaataaaaagaacgcatccaattggaatgcgttctttttttagctgggaagagccgagttgcatttgtctaaaatcaaaaaaacggctgcgacaatcatttcttctgtggtggacagccagatgtcgctgatcaattggtctgttgtatgagcagtcatccacaaaaacagcagctgtacgatgccagcaaggagaatgaatagacgttttcctgtcttgaaaaatgtaaagctatgtatcatcagccgttcaaatggttcaaagcataatccgagaacaaggaataccacggcaaaaagcaggacatgagctgctgagcggtagctcgttcccgctaaagaaaacaatatatagatgacagcaaaataggtcaacaccactgctgctgcggccagcaagtactttatggagagccgcaataagcgttttgaagggttttgatgtttcactggttcagctccttatgaaggcttgcagagaacgagtgctctctgcaagccgcaagtcttttatttactgcatttctttttcactactgggtgcttttcttttgaaagcacatcagtaaagtctttgcccaagtcaaggtgcgcttgaacaaatgtttcaggaagcatggcaagccattggtttaaagatacatcagcataatggtcgtctttgaagatttctaaaaagacaagcggttcatccccgatgttttcaacgtaatgacccattgcaaatggtacatatccgacatcaccggcttggtaattaaacgttctggcatggccgtcagatgcaaaaacggtcattctagctttaccggagatgtagtattgccattcgtgggtattcgggtgccagtgcagttctctcatggcgccgggttctactgttacgagcgctgatgcgatggttttagacactttgaagtttgtcgaatctgcaatgtatacttttcctccctcagattcgatcggctcttgttcaagaaggcggtaagtaaatggataaggcacttcgccattcggcccttccacaatatcatcttttaaactgccaggaagttggttttcaaatatatatttttctttgccaggcaaattggaaatctcttcttttgtcacgccgaagttcgcagcaatgacttcttttggagtgtgggccagccaatctgtcagctggaacgtgctgttttcagagaatgatccatcgtcaaacacgagcaggaactcagctccctcctccagcgcttggatggagtgcggcaggcctgacgggaagtaccaaaggtctccttcacctacatcgtcaataaagctgcgccctttttcatctacaattgtgactcttgcacttccgtaaatcatataagcccattcagcttctttatgccagtgaagctcgcgaatcgcgcctggcttcagccgcatatttacggatgcaaggttttctgaaatcggcaattcacgtactgtcacttcccgggcatatccgcctttttctaatcggttatgagtatcagagaatgaaaacttcatattgctgacggtgccatgatcggtttcaggcggaacgagcatatcagggttttgccggtctctttcaatattgcgcgggatttttaccgttgctcctttgtctcctctaattggctgcggaatgtcattttgttttttcatgaaatgtttcctccttacatttaaatgtgatagcagaaagagaaggtgaaaggcctttcgttttcccttctgttttgttaagtgaaaaaaaccagtgaaaagtcaacttcgattgaaaaattatttttttgcatgatctttcagttctgtcattagttctattagttgatcaaacttcttttcgaatcgggtcagcagatacattgcaatcagcgcgggaaaccccaaattgccgatctgttttacgacttcctctataaaaacctgatccataggaaaatacctcccttctttttctgcagtcatgtatgtaagtgaggaaaaccgataaaacgtaaactgctgcaaagtattttggaagacactaggcggaaagtagtagtttactttttttgctttccttcatttaatttagtagggaggcggtttgatggactatcaaagtcttttacggtcaaaatgtaaggagataatgaagcatcccatcgtgaagcattttttgagcaatcctcagcattaccgtttgttcaaaaacgtaatggaaagccctaacgaaaaagatgcaagatcattggacgagctatttaagcaattttataaagaaatccgcatcgtcaagtatatgaattcaatgattcgcatcttttctattgattttgataagcgggttcgcaaaaaccaaaaacggtatccactgacggttgatcatccggaggcgggagatcggctttcttccgaaacaggtagcgatgcatttgaagaatttttagacaggcaggatgatttgagccagcatgtacaggattaccagctctaccaagcgatccagaagctgactgacaaacaaaaaagtgtgctgacgaaagtctatcttcacggtgccacgatgcaggagattgcagattcattaggggagtcccgacaaaacatctccaacattcataaaaaggggctggagaatatcagaaagcagttagcggcgcaaaaaaagggggaaaagtaagctgtggacggccagtttgaacaaaaaagaaacaaaaagacgagacttatgacattgagcacctgattgcatgcttttcaccgatgatcagaaaaaaactcagcaatacgtcctatcaagaaagagaagatttagagcaagagctgaagatcaaaatgtttgaaaaggctgatatgcttttatgtcaggatgtaccggggttttgggagtttattttgtacatggtagatgagaactcataatattttcatatgaaaaaacatcaaaagggagcgcttgtttgctccttttttgctgttttgatttgccaaggctccaatgtattcaaaaatgtaccataaataaacgatataatgataagatgaaaaaaacagtgacagaaaggaacataaaagtggaaaatgcgtcaattttaatcgtagacgatgagaaagcgattgtggacatgatcaaacgcgttctcgaaaaagaaggttatcgaaatatactggatgcggcaagcgcagaagaagcgattcccgttgtgaaggccaataaggttgacttgattgtgctggatgtcatgatgggcggaatgtccggttttgaagcctgcacattgatcagagagtattcagacgctccgatttttttcctgacggcaagatcatccgacgcggacaaattatcgggctttgcggttggagctgatgactatatcacaaaaccatttaatccgctggaattagcggcgcggatcagagcgcatctcaagcgtacatatcaatcgaaagaaacgagttcaaatcaaacctacacatatgattactttactttttctccgcaaaatgccgagttgatcgtaggcggggaagccgttgcctgttcagcccagcttctgcagcttttgcagtatttttgtgaacaccctaacgtggtgctttccaaagatcaaatatatgaaaaagtatggggctatccttcctacggtgacaacaacaccgtcatggttcatattcgcaagcttagggagaagattgagcgcgatccgagcaatccggagtatattgtaaccgttcgaggtctcggctatcgttttatcccaaatcctgaaggcaagcggtcatgaggttaagatggaagtttttgtttcactttttcggccagatgctgattgtgatcctgctgcttacggttatgcttgttgcatcgtttttctatttagacgcccgttttagcgatgcggaatccaattcagggctgacgaaagcaacgaccgacacacttgaggcatatctcgatgtaaacgaagacgggacatgggaagtggataatttcctgaagaaatctgttgataaacagcacggctggatgcaaatcattgattcggaaggaaacactgattattcctacggcgtgccaaaagacgtgccgggcacctataccaagaaagagcttttgtctatttataaaaccaaaaagcttcataactataaactgaattattgggccatcaatattgaagataagtcgtatcttctattgtccggctggaaatcaaaaagtgaacagctcctgacttccgttgaaaagcgtgaacaaaagatagactcactagcgcactataagtctagtaccatcgactatattaaacggaaaaaaggcgccatttacctgttagacagcaatggaaagattctcgacagcatcaacagcacaaaaagcgagagaaaaacgatgaaccagctggagctgcttaaatacagctctaagccttggaactataagcgggaaatttccgttaagatcctcaataaagacagatggatggtcgctacggtgccgaacccagtctatgtaaccgatcaggagtttaacaaatcattcctgaaggttgtattaaaagcgatgtttctcgtgatggccgttttgttcatgtatatcatttggatgaccgtttggtatatgttccgattcgggctgccgatttttcacacgattagatggctggtcaatctgtcaaaagggaagcttgaggagcccagaaaccgggaaggccgtcctgtcagcaaaaataaaaagggaaaaatcaaacagccgtaccgcttcttcggtgagatatttgaatcaatggatcagctgactgaaacgctgagaagggataaaagaaacagagaaaaaatccaggcgacaagggaagaatggattgccggtttgtcacatgacttaaaaacaccgctcagcagcatttacggctacagcatgatgctcgagtcgaagcagtatgactggtcgccggaagaagtgaaagaaatggggcaggttgtcagagaaaaatctgaatacatgtctaagctgattgaagacttaaatttaacgtatcgcctgaaaaatgatgctcttcctattgagagaaagctcactagccttatcccgttttttaaaaatgtcattgaggattttaagaaaaatccgttttctgaaggctatgatatctcgtttgtatccaaagaagagcatattgaatttgcccttgatgaagcgtggttcaggcgcatattagaaaacctccttgggaatgccgtgaagcacaacggcaaaggaacagagattcaagtcattctggagcaaacaaaaaatcatatttctttaaaagtgaaggacaatgggaaaggaatggatgaagaaacgatcacccatttgtttaaccgctactacagagggacgaacacaaaagattcaactgccggaacgggtctcgggctcgcgattgccaaggagcttgtccatctgcataacggaacgatccatgtgaacagcagaacgaacattggaacggtcattaccatcctttttaaaaaacaataaacatcaagtggtttggacacctctttgccgggaataacaatatatagactgaagctaaagaggtgtaacacatggatgcagtattggaagcagacactcgggcagtgattggtgaaggcccgttatgggatgaagagaacggccgcttatattgggttgatatcctggggagcgagctccacatctttgaccctgaagaaaaaatcaaccgatcaatcaaattcaaatcctttgtgacggcgcttgcgaaatattcaaaggatgaactgattatgacgatgaaggacgggttttacctgtatcatcttcgggatgacagcttggaaaaaattaaacagccgaaggacatgcatgagagcctgagatttaatgatgctaaatgtgacccgtacggaaggctttgggcggggacgacgagcatggaaggcgagcaaaaacaggcgtcgctgtaccgtttgaatctagacggcagtcttgtcaaaatcaaggatcaagtctccacctcaaacggtttggattgggaccgcgagcggaatttgatgtattacatcgacacgccgacccaggagattgtacgttacagctatgatcctcaaagcggagatgtttcgaatccagaacctgtctatcgttttgatcagtcagacggattgccggacggcatgacaattgaccaaaatggcatgctgtgggtggcgctgtttggcggcagccgcgttgttcacattgacccgtttcagaaaaaagaaatcaattcaatcagcgtgccggctaaatatgtcacgtgctgcgcgttcggcggcagagacttaaaaaccctttacattacaacggcaacagaacaaatgacagaaaaagagagatacgagcagcctcacgctggagggttgttttcagcacaactggaaacaggcggatatcagccggtaccatttgctggagacgtataaaaaaaacgcatccgaaacacggatgcgtttttttatactacagagaacggataatgccgccttccacacgctgtgccgtgccgttaatggcggatgcggcgtcagacgcgaggaatacgattgtgttggcgacttcttctgctgtcgcgtatcgctgaataagtgaggttggctcattgaccttgaaatagtctttgataaatgtatctgtatcctgtccggctgcttgtgcggcgccttccatataggaggccacgccctctgtccaagtaggtcccgggagcactgagttgaccgtcacatttgtgccttttgtcatttcagccattcctcttgaaaggctgatcagtgccgtttttgtcattgagtatggaatcatcgttggcagcggtttgacgcctgcttcacttgcaatatttaaaatgcggccgctgtttttggcaagcatttttggaaggaagtgacggcttgtccgaacggcgctcatcacgttcacttcgaaatattgattccactcttcatctgtcacatcggcgaagtcttttacctcgaagaaaccaaggttgttgacaaggatatcgatatcaccgatttcatttactttttcgataaaagccgctgcttcatctgtttttgacaaatcggcagcagcaccgtgcactgttccatagccagaaagctcttcaatggtgcgatcgacagtctcctgtttgcgtccgttgacaatgactgccgcaccctcttgcagaaagctttttgcggcggctttcccgataccggacgtcgagccggtgattaagacgagtttttcttttagctgtaaatccataagaatcattccttttgatagatgatggtattaagtatacaagatcaaatttagtgtttacgaggattttgcttccatacacaatatggggaaaagtcattcaggacacatatacaagcctgtcagtcatatagtataattactccgaaaaacggatacgaatgtcaaataggtgccggtccgtgaacaacagccggcttaaaagggaaaccggtaaaagccggtgcggtcccgccactgtaattggccaagcgccaagagccaggatacctgcctgtttgatcagcacgaattctgcgaggacagatgatgtgtaaacaataggcttttttgtgttgtttacagcatctttaccgtcgtagagatgcttttttagttcgtttaggaggaaaagattatgaaaaaacgagccgggatatgggctgcgcttctgttggctgctgttatgctggcaggctgcggcaatcctgcggatcagaaggattcaaaggcaaaacaaaaaacagaagtgttccctgtcaccattgatgatgcgtcaaaccaagatgtaaccatcaaaaaagagccaaaaaagattgtttcattaatgccgagcaacacagaaattacatacgcactcggccttggtgacaaagtggtcggtgtcaccacaaacgatacctatccaaaggaagtcaaaaaggttgagaaagtcggagatatgaatgtaaacgttgaaaaagtcatttctctaaaaccagatctcgttctggcccatgagtcttccatgtcagcatcagcggatgccatcaaacagctgaaggacgcgggcattacagtgctgactgtcaatgatgcacaatcattctccgaggtgtacaaatcaatcgaaatgatcggagaagctggcggggcggagaaaaaagccgatcagctcgtgaaaagcatgaaatcagatctaaaggatattcaagaaaaagcgaaaaccatttcaaaagacgaggagaaaagcgtatttatcgaggtttctcctgatcctgacatttatacaaccggaaaagatacgtttatgaatgaaatgctaaatgtcatccatgctaaaaacgcagctgcggatcagacaggatgggtgcaaatgacagacgaggcgatcgtaaaactcaatcctgatgcaattgttacaacggacggtgtgaaagcgaaagctgtggaaaaacgcgatggctggagcgaaatcaatgctgtgaaacatcatcgtgtatatgatgtggaccctgatcttgtgacacgttccggtccccgtctgatcgaaggggtcgaagaacttgcggaaagcatttacccggatacgtttaaggaataatcgttatgccgcatatatcattggtttctcatttttagccgtgagcatcatcttaggaatttcttgcggcagcctgcatattcctattcccgctgtttttcgtgtcttttggcatcaaggtttcggcggctctatcggttctgatgatccgatgtacactaatattatgatgaatatcagactgccgagagttgtgctggccgcccttgtgggggcggctctttctattgcaggggccgcttttcaaggattgttgaaaaatccgcttgctgatccctatacgctaggtgtgtcatccggtgcttcagtcggagctgttgtgactctgttcttaggtttgcaccttcctgtcatcggagggtttacactcccggttttgagtgtagccgcggcactggccacgatggcggcggtccttttcttcagccgcctcgttcatgcttcgatgtctgtttccaccctcattttgaccggtgtcatcaccaactcttttttaggcgcatttatttctcttatcatcgccttgacaggagacaacctgcttccgattgtgcattggctgcttggcagcgtctcaatgaggggctggagctatgttattttgtttctcccgttttttcttttgggaaccattttattgattataaacggaagggaactgaacgtgatgacatatggagaagataaagcaaagcttcttggagtcagcgttcagcagaggaagatgatgattttaatagccggatctcttttgacgggaagcgctgtggcagtatcgggtacgattggctttgtcggccttgtgattccgcatatcacaaggcttttgtggggaacggaccatcggcatttactgccgttgtccgccttgcttggggcagggtttcttgttttagccgatctgctttccagaaccatcattgagccgattgaactgccgatcgggatcattacgtccttggcgggagcgcctgtgttcgctcttattttaattcggcagcatcgcggggggagaagcttatgatgaaggcagaagggctgtcgggaggatacggcgacagccgcctaatcaacaatgtcagcttaacagtggagaagggagaatttcttggaattctcggccctaatggaagcggaaaaaccacgcttttgcacttgctgacaggtacgctgccggccaagaaaggcagggtttatctggccggaaaactgctggcggactataaaccgaaggaactggcgcaaatcatggctgtcctgccgcaaaaaatggatcaagccttcacctttactgtcgaagaaactgtagcctttggcagatatccattccaaacggggctgttcagacagcagactgaaaagggtgaagccattgtacaggaagcaatggagcaaacaggagtggccgattttgcgcaaaagccgattcgcgaactaagcggaggggaacagcagcgggtgtatttggcacaagctttggcgcagcagccgcgtattttatttttggacgagccgactaattttctcgatctggcttatcaaaaagacctgcttgatctgatcaaacgcctgacgagagaaagcggattggcagctgtcagcgtttttcatgatctgaacaccgcaagcctgtactgtgatgggctcatgtttatgaaaaacggtaccgccgggcctaagcaaaaaccggaatatgctgttacagaacaaagcataaaggcggtgtacgatacagatgtcaccgccttggttcatcaaagctcacctaaaccgatgattgtgattcagcctgaaaaagatagcgtgaagcggcagtctatcccatttgaagcattgctccaagcggggcgtgatgacattcttctgcaaacggaaatcccgcttcgaacattgtcctccacgcctatcggtgcagggttttcgtggagcaggacgctgatccataaacggctgccagatcagccagatccgatagaaggacttacggcctgtctttcagaaagcggttttcaactgcaggagacgtgtgcgatggcttcttcagaaagacttgaccgtttcgtgtatcgaacatatgaagacggagagttatccgttttcatatgcgttcagaccggcttttcgatttggattttgattaacggctatgcggcagatcaattcttcatcaaagctcttatggctgccgaagcagaacggacgaaagtgctgggagacggaggaggcacaggtgatattctcatcgccgcgactcaaactcagcaatcagaaaacatagaacagcggctgaaccaattgataaagaaagggacagctgaatgtataaaagaggctgctgagttgtttgaataagtctgtaaaggagattcagggtatgaaactatatacaaaaacaggcgataagggacaaacgggcttagtcgggggcagaacggacaaggacagcctacgcgtcgaaagctacggcacgattgacgagcttaacagctttatcgggcttgctttggcagagctttccgggcagcccggctttgaagatctgacagccgagctgctgaccatccagcatgagctgtttgactgcggaggcgatctggcaatcgtcacagaaagaaaagactataaactaacggaagaatctgtttcctttttagaaacgcgcattgatgcctatacagcagaagcgccggaactgaagaaatttattcttccaggcggatcaaagtgtgcttcgcttctccatatcgcacgcaccattacaaggcgggcagaacgaagagtggtggcgctgatgaaatcggaggagattcatgaaacagtgctgcgttatctcaatcgtctgtccgattatttctttgccgccgcccgggttgtgaatgcaagaagcggtattggcgatgtagaatatgaaagaagtgccattgtgtttcgggaccgaaacagcagcgaatcataaaaagtgaaaaggaaagccggcgtgttcaaatacatgccggctttttttgtttttcactctgtcaatttcccattttacgacaaaaaatgaaccttatgaattattgactgaaaaatggaaaaatgagatattgtaataaatagatgtaaaaaataggcaacggggggctctgatggatggtgaatttaattgaaagtgatagcatctggaagagaaatttcaattatctgtttttctcaagaatagtcaagatatccggcgatatgttcgcatttaattcaatattatggtttttaatttatgacggcaaaggtgcgatcggcactgctttattgattgctgtcacgtttttgccggaagccgttctggcgcctgtgacggggccttttatgaaacagaccacgctgaaattttggatgtacttttcagatctgacaagggcggcgattgttttgattatccctctatgtcattttgcgggcttctctccgctgtggtttgtcatgacgcttatgattgtgcattcagctactggagctgcctacaatcccgcctctatcgctttgattcctcaaatcgtcaatgaacagggcattcaaaaagcaaacgctgtgctgcaatcctccgctcaaattgtccggcttggggctgtcacattatgcggcgcttttcttacatttattagtccttcttataccatgcttatcgcacttgtgctctatttggtgtcaggttttctcgttctttttattaagtacactgcggttgaatctcaatcagagtctgcggttgttacacagagaggcacatatatcggaagactgaaacgcggctttaggctcgtcagaaaacaccagattttatatccgctcgccatttactgtatctttatgaatttcgcggctgccccatgggaagcgctctctgccgtatacgttgcggaagatttaaacggccagccgatcgtatactcgcttttaaaggccaccaccgccgcgggcgcgtttttattagggtttgtgctggcgaaagtcaaggtaaacaggtacggcttgttattcgtcactgccggcattattgaaggatttgctttctttattaccgggatgaatacctttttgccgctcgtctttttcgctgcttttacctttggtgccgcagtcagtgctgttaatgttcctgagtacacgattatccagacgtctgtggatagtgaggatcagccgcaggtttacgccgttatacatatgatctcaaatatttcgatccctgccggagctgtcatttgcgggtatgccgctaatgctttcggctcaggtaaagtgatcgctgtcggtgggattgtcgaaattattgcgggtatcggaatcttgctgtttacaaaattggccaaagcagaaaggtccgacctaattaaagaaagggaagcaagtgttcatctgtaaagggttttaaaacgccatgcctcgtgcatggcgtttttttgtgccaatgggtccggtgcgagatacgactccggtcttatataaaaatcaatctctgattcgttttgcatatcttccaacttgtataagatgaagacaaggaaaacgaaaggaggatctgcatgaaaataaacaagaaaacaataggcggattcttattaattgtatttgggatctccgtcttttttggaggaggaagcttcggctttatcatcccgctcgccatcgggagcttgatgacatacgcaggaatcaaaaggtttgccgcgggaaaaaccatcacgggaatcatcgtgggcggtatcggagccattatgctcatctgctcacttccgtttgtcgtcggaatcgcattggcggccgctatggtgtattacggctggaagctgatgaaaaacggatcagctgataacggtgtatcatcttttgatcctgaaccggcttctgctgcctaccaatctcactttgatgacgaatgggaagaatttttgaagaaaaaataatatcaatatattaggaggaatcaggtatggtattaaaaagaatcagagacatgtttgttgcgtcagttcatgaaggacttgataaaatggagaatccaaaggtgatgctgaatcaatatgtacgcgatatggaaagcgacatcgcaaaagcaaagcaaacaattgtgaaacagcacacgattgcctatcaatttaagaaaaaatatgaagaagccgctgaagtggctggcaaacggaaaaatcaggcacagctcgcatttgacgcaggtgaagaagaactggcgaaaaaggcgctgactgaaatgaagtatttagaagggaaggcggctgagcataaagcttcctatgaacaggcaaacagtcagctggctgatctgaaagagcagctggctgcacttgaaacaaagcttcaggacgtaaaggataaaaaacaggcgctgattgcgcgggcaaatgcggcgaaagctaaagagcatatgaatacgacatttgacaaaattgacagtgaaagcgcgtatcgtgaatttttacgtattgaaaatcgtattgaagaaatggaaatccgcgcgaattattcaaagtcagcggaagccggcacagaacttacacgtaaagaattcgcagacgatgtggaagcggagattgaaaaaatgcggacactttcactgcaaaaatcagaccagacaaaagcggcaaatgaataagcggaacggggaaggatttgcggtcaagtccttcccttccgcacgtatcaattcgcaagcttttcctttataatagaatgaatgagaaggatgaaaccgaatgaaaaaaatgcttggcaaactgttgatcactgccggtattctggtttttttcgccgtcgtcgtaaaagatgtgtttgctgcaggcctaggtttcataaatggcacagaagctgattcagccagcgcatcgccgcgggacattgacagcatggtcattgagtcggatagcaaggatgtccggattatagcggaagaacgaagtgacatatcggcaggcatttcaggagactcaggaaagttatttgttactgaaaacaaaagaaaactggagctgaccgtaaaggaaaagaatttcaatttttgaatggatttaaccgttcaactcttatcgtcaggcttccgtatgattataaaggtgatctggcagtacgaacctcaagcggtgacgtgtctgtggccgggaatgaccatcttgcgctttccgggctgaacgcagtatctgcgagcggaaatacgagcgtgacggacgtccgcattcaagatctgaaagtgaaggcatcatcgggggatgtttccatttcaaataccgtctccaaaacagccggcattgatttagcttcaggggacgcaaatctggttcatgtatcaggctctcttgatgtgaaaatgacttcaggagattttaatgctgtattgaaaaaggtaaccggtcccgtatctgtcacgctgacaagcggtgatgctaatgtaagccttccccaaaatggcagctttgcagtcaatgctttatcagcaagcggtgacgtcagttcgccgtattcatttgctgataaaggacataaagaacagcatcacatcacaggcacgcaaggaagcggccggcatccaatcgacatcaaaacggacagcggggatctagcgatacggtagcactaggcagaagaaaggaggcggacaccaggaatgacaaaaaaacagcttctcggattgatcattgctttattcggcatcagtatgtttttgcaaattatcggaataggcgatctgctgttttggccgctcttttttctgattgccggctatttccttaaaaaatattcccgtgattggcttggctccgtcatgtatatctttgccgcgtttctatttttgaaaaacctcttcagcatcacctttaatttattcggctatgcgtttgccgcatttctgatttacgccggctacaggcttatcaaagggaagccgatatttgaaccgaatgagaaacaggtcaatctcaataaaaaagaacatcatgagccgccaaaagatgtaaaacatcccgacatgcgcagcttttttatcggtgagctgcaaatgatgaagcagccgtttgacctgaacgatttaaatgtctctggttttatcggtgatatcaaaatcgatttatctaaagcgatgattcccgagggagaaagtacaatcgtcattagcggagtcattggtaacgttgatatttatgtaccatcggaccttgaagtggctgtcagctcggctgtttttataggagacattaatctgatcggctcgaagaaaagcggattaagcacgaaggtatatgccgcgtcaactgattttagcgagtcaaagcgccgggtaaaagtgtccgtttccttatttatcggtgatgtggatgtgaagtacgtatgagaaaaaaaatgcttgccagcctccaatggcgcgccatccgcatgacaacgggaatcagcctgctcctttttgtttgcctgatttcctttatgatgttttactatcggctcgatccgcttgttttgctgtcatcaagctggttcggaattccgtttatcctgattttgcttctgatcagcgtgaccgtcggtttcgcctcagggtatatgtacggcaaccggttgaagacaaggattgatacattaattgaatccattttaacctttgaaaacggcaatttcgcttatcggataccgccgctcggtgatgatgaaatcggcctggctgctgatcagctgaacgaaatggcgaagcgcgtggagcttcaagtcgcatccctccagaaactttccaatgaacgtgcggaatggcaggctcaaatgaagaagtcggttatctcagaagaacgccagcgattggccagagatcttcatgatgcggtcagccagcagctctttgccatatcgatgatgacatcagccgtgctggaacatgtcaaggatgctgatgacaaaacagtcaagcggatcaggatggtcgagcatatggcaggcgaagcccaaaatgagatgagggcgctgctgctccatttacggcctgttacccttgaaggaaaagggctgaaggagggccttacggagcttttggacgagttccgaaaaaagcagccgattgatattgagtgggatatacaggacacagcgatatccaagggtgttgaagaccacttgttcagaatcgtgcaggaggccctttcaaacgtatttagacattcaaaagcgtcaaaagtaaccgtgattctgggcataaagaacagccagctccgtctgaaggtgattgataatggaaaaggctttaaaatggaccaggtgaaagcctcctcatacggcttgaattctatgaaagaacgtgcaagtgaaatcggcggtgtcgccgaagtgatttcagtagaaggaaaaggcactcaaatcgaagtgaaggtcccgatttttccggaagaaaaaggagagaacgaacgtgattcgagtattattgattgatgatcatgaaatggtcagaatggggctcgcggcttttttggaggcgcagcccgatattgaagtcatcggcgaagcatcggacggcagcgaaggtgttcggcttgctgtggaactgtcgcctgatgtcattttaatggaccttgtcatggagggcatggatggcattgaagctacaaagcaaatttgccgggagctttccgacccgaaaattattgtgctcactagcttcattgatgatgacaaagtgtacccggttattgaagctggcgcgctcagctatctgttgaaaacctcaaaagcggcagaaatcgccgatgccatccgcgccgcaagcaagggagagccgaagctggagtcaaaagtggcgggaaaagtattatccaggctgcgccactcaggtgaaaacgcgctcccgcatgaatcgcttacaaaacgggagctcgaaatactctgcctgatcgcagaaggaaagacaaacaaagaaataggcgaggaactgtttattacgattaaaacagtcaaaacacatattacgaatattttatcaaagctggatgtcagtgaccggacgcaggcggcggtgtacgcacaccgaaatcatctcgtgaattaggcggctgctatttgtttgcgcctttcgttccgaagtctctgacaatcacattgacccggtagtctatttccgcattgctgaaataatcatcatcccattttcttgaaatctttttccacttttgaggataatgaattctgacctcgtttcccagcccggttacgtccgctttgatctctttctgcagcttctctgtaataaatgacgttactgtttcgtgtactcgtttttcgactgtcttttcaatacttttaatatatgaatccttaaacgagtcttcattgggattccagtcctcagatagacgaccttcaatattgcgggtaacggtgaatttgaactttccgtccttgtatgccgtcttgatcttccgattgcttgaatatacttcataagaaaagagatggccatcgcgcttcaagtcaatgacgcctccctcgacagtgcctgaaaataagctgatattttgaacctcaatcggggtgaggtcccggtgccataatttattttttatgatagaggctccgtttatcgcgagcttgccgttttccttaccgacatgagggatgaggaatgaatcgtcagaggttaagtgttctgagatctcccccaatgtaactggctccatcgttctgatcgtcaccttattattctctgtcagatcatatatcacgttggatgcgggttcgccttcatcattcatgttaaatatatccttagttcggccgttggtgataaagacgtaggaactcctccttgttccgttgtctctgacaaactggttaataatggcgtccattccaatttgatccgcaatcacgcttttggaaagcagaatgagacgcaaatgctgtgaaaacgtaggcttatgctttaatgcagaggttctcatcatttgatggacagttttaccctttgtgatagaaagctgtgtcggatcagatgaagagccctccttggcgctgattattttcggcacgagaatttgctgtgtcagctctaaattttcatcgtcaggcttgtctagccctactccgatcactaagcttaattcctcgatattctcactgtcccagcatccggacagcaatagggtgcatataaacatacataaaatccggattttcattttgttgtaatcctcctcttgagagctacaatgaaaaagagaatgaacggaagcagaaacagggagacaaaaatatagccaagataatcgctatacatcatgacttgattggcgtcatccggccagagagaaaaataaaagaccgttatgccgataatcaccatgcttgttttagtcgataatccaaatgtcttctttagcccgttagcggcaaagtatccgtaaatgacaaatgtggtgaaaaactggataatccagaccaccagtaaaaaggattcaaaccgttcaataaatatgcctttaagctcaaaggactgaaagagagaaatagtcggccaaatcagcgttttcacctcgggagcggtcaaagctccgacaacgataatatacgtaaggatatataagataatcggaatcagaaatcctagagacgcatatctgaacgtgtatttctttttcttcatatgttcaggaagaaacagcatcacttccattcctaaaaaagagatggaaacgacggtaagggagtttgcaatgggtccaaggccttcgcctaaaacaggacgcaaattattgatatcaaaaattttaaaactgatcccgaacacaatcagcaaaataataatggttaccgttaaataaaagggaaacagccgcgacacatcgcttaagcccccaaccattaaataaatgccgcagcaaataaacgttaaaataatgacttgaattggggttctctccagcaggaaaaacttcaccatttcagccattgcccgtgtctcgaagctggctacgccgaggaaatagccgcagatcaaaaggccgatgatgctgccgatccatttcccaagcccttccttcaaatattcaaagagtgaagggtattgatgttttttctgaatgagcgtgtttaaataaatgaagaaaataaaaatgaaaccttctaatatcagcgtgatccagccgtcaggcgtattagccttagtggtcagcgctcgcggcaatgttaaaagtccggccccaagcattgtatttgcaacaatagaaataccttgaaaggtattaagtttcagtggagtctgtttttggctcatttggattattcacctcttttggtttgtttttaattgggagacggataatggagtcatccgtatttttcaggctaaagaatccgtttggcgaaaaatacggagacccaaagctcgtttgtctcgttaagtgcgtataaacgacaagcataaataaaataatgccgtatagccctaaaatagcggcggaaaacatcgaaataaaacgcagcacccggaaagacagacccattccgtattgaggaacggtaaaggatgccagggcaatgacactgacgacaatgaccataatcgaactgacgagattcgcttctacagcagcctgtccgatgactacgcccccaacgaggccgatcgtctgtccgagcggattggggagtcgcagtccggcttcccttagcagctcgatggtgacttccatcagcagggcttcaaatatcggagggaacggcacgttttccctgttcgccgaaatcgtgacggcgagtgcggtcggcagcagcccctgatggaaggaaacaagtgctatataaatcgatgacaaaaacaaggtgataaagatagaagcaaagcgcagcgaccggataagagatgctgaaatccagcgttcatagtagtcatccggggattgcatcaggatgccgagagaaaccggcaccagcagcacaaatggtgaactgtcgaccaaaattgccacacggccgttaaacagggctgaagatactttgtcaggtctttccgtattttgtatctgcggaaatggtgaatatttattatcttcaatgagctcctcgagcgttccgctgtcctggatatcttccagctggatatttttaagccgcgccttcacttcttttatgacggacttttttgctttgccttcaatgtacataatggctgcaggcttcagcttgttttcgccgatcatgatttttttggtgatcaatttcggatgagaggttctttgtctgatcagagcgagatttgtatcaatatcctctacaaacgctacttttgggccgcgaaccactttttcagttgtcggctctgtcaggcttcttgtttttttctttcctgtggtcagaatataggctttatccaatccgttgataaacacagcacaattgccgttgagaatcgattcaatcgttttttttgcagtttcaacaggtcttgcgtcaagctggtcaaggcgttttttgacctggtcaagcgttaaggtctcctcatctttaatcaaagttttaatggcttctgacaccttattctcatcagtcatttcactgaaatagagatagtaaaaaaccagtccgttcgcaagcatttttttgtttttcaccagatcatcgttttcttttaattttggcagcaccaatgctaaattatcgtgtatatattccttaaactctgtttgttccaatgaggtcacctcttatccaaaaccttagtagaggttatcttttcctgttaaaaaaatgatatactgtgttagagtatttcatggagtaagtttttttatgaaagcggaggatacgaagtggcacaggtaaggctagctggaaaacaagaagaaattgaacagctcattagatcatttgaacagcattatgatgtctcttatacatcaaaggagtacggcaggacaaatccaaaatacaaatattcaaaggattcccgcgtatatcttgaattaaaattaaaatctgccaagatcgaaaaataaaaaggattttttgtgtcattggcgaattatgatctattgaagcaaccgttatggagggatacataaatggaatacagaattgaacgagacaccatgggagaagtaaaagttcctgctgataaattttggggcgcccaaacacagcgaagcaaggagaactttaagatcggttctgaaaaaatgccgatgcgtgttgtgaaggcgtttgcaattttaaaacgaagcactgctctagctaataaacgcctcggcaatctggacgctgaaaaagcagaagcgattgcagcggtttgtgatgatgtgctcaaaggcaagtacgatgacaacttcccgcttgtcgtatggcagaccggaagcggcacacaaagcaatatgaacatgaacgaagtggtagccaaccgtgcgactgctttattaaaagagaagaactctgatcaaacgattcatccaaatgatgacgtgaaccgaagccaaagctcaaacgacacattcccgactgcgatgcatgttgccgctgttttggctgtttacgagcagcttgtgccggcgcttgatcagcttcgcaatacactggatgaaaaagcaaaagcatacaatgatattgtcaaaatcggacgcacgcatcttcaggatgctacgccactgaccctcggacaggaaatcagcggatgggttcacatgctggaccgttcgaaggaaatgattttggaagcgacagataaaatgcgtgcgcttgcaattggtggaacggctgtcggaacgggtatcaacgcccacccagagtttggagagcttgtctcagaagagatcactaagctgaccggccaaacgttcagcagctcgccgaataaattccacgcgctgacaagccatgacgaaatcacttatgcgcatggcgcattaaaagcgcttgcggctgacttaatgaaaatcgcgaacgatgtcagatggctcgcaagcggaccccgctgcggcatcggggagatcgtcattcctgaaaatgagccgggaagctctattatgcctggtaaagtcaatccgacacaaagcgaagcgttaacaatgatcgcagcgcaaatcatggggaacgatgcgacaatcggctttgcggcgagtcaggggaactttgaactgaacgtgtttaagcctgttattatttacaacttcctgcaatctgtgcagctgctcagtgacggcatgaattcattccatgataaatgtgctgtcggtattgagcctaataaagaaaccattcaggaaaacctgtcaaattcattaatgcttgttacggcgctgaacccgcatatcggttatgaaaacgcggcgaaaatcgccaagcttgcccataaagagggattgacgctcaaagaagcagctttgaagcttgaattgctgacagaggagcaatttaacgaaatggttaagccggaagacatggtaaaaccaaaggcgtaataggaagaacggctgctttttaagcagccgttcttctaaatatgttgctgttttaataaatatttaagctgttccgcatctttggcgagagcttcagactccgtcagattatgaatcattccttttatgatcgccagcttcggtgtttttttcttcatttctgcttcaagtatgtccaagctctccgataattcaagagaggagtttgtgtttaagctgttaattttgtcacgtaggcttttcacaattgattcagtcagcgggtcaggccgtccgtgcgtaagaggtccgaataaagagctcgcctcttccaatgtgatgaaaggcttatcgtttcgttcagacatgccttttaccatatcatcaattcgattcataatgatatcagctaattgagacggcttcacagtgtacccgagcaaaatcatgcattccaggtaaatctggctgatgccctctattaaaaaacaaagctcagcagtgtacggttccgctttttttccatagatgttcagcaggctgtcgatatgaaattgaagtgaggactggcggattttttttgcgcattgctccacttcttctgtgtaaggcagagaaccctccttcaactgcatgctgataaaatctttgtgttcaagaatgttttcatagaggacggtcagctgtttacggtaagccgttctggggctgtcgcccttcgttttaatatttaaaattcgggtaaacgttttatcataatagtagttcagcatagagagaagaagcgcttctttcgaaggaaaataaatataaaaagcgcctttagatattttgcattcttttgcgatttcctggactgatgttgagttgtatcctttttgggcaaatagttttaaggctgtttcaataatcagtttttctttttccttcaatggttccaccctttcggagcccggaggcctgctaggatatgaccatatagtcacaccgtctgttataaaattaaccttattgtaacttgtttttttatcatgtattatttatattataaattgagatgaccgaatggtcaaagctcaagcgaaagggtgaatctagaatgagagaattggacgaaatgatcagccgcttgcgaaacagaggaatcaaagtggagaaagtcaaatatccgaagcagaccttgtcagagaaaaaatgggttcatcaatgcaaacagccgctcaaaacaaattacagagattttaacggctattctttcacataaaaaaatagactgcaaaacatctacagtctattttggcactgctatgcggtatgttacacccgttttgtcattttcaattgagatagatgccttatgaagagttaaaattcgttttacgatgcttagaccaatgccgaattcgcctttcttccctttattaaaaggctcatagaggctggagagcatctcatcttcaatatgcggaccgtcatttttaatggtgatcacgatatttcgatcatcttgtttcatgctgatttctatttttgtctcagcatagcggatttgattttccaaaatgttttcgaggagtttgttccattgctccggatcgcccggcatcaaaatatcctcttctacatcaatttcccacgatagttctttccgcgcccacttcaatcgttcgatgacttcttctgtcacttccacaatactgaacatgtcgtgctgcactttttgcttcgctaaataatccagcttcgttaaatataataaatcctttattttttctccagcttaagagcttcgcattcaataacatctacagtgttttcaaggtctcctttaggaaaaatcccgtctttaattgattgtgtatagcctctgatgaccatgaccggcgtttttaaatcatgagagatattttgcaatagagttctttctgtttcatccttttgcacaagcttttggcgcatctcttcgatggtatggcccaatttgccgatttcatctttccggtccacttttactgggtcatcccaatcctgttcagaaatccgtttgacgtgtttttcaaatgatacaagaggccttgataaatactttgcaagccaaatagccggaatccagcttaataaaatgacgacagctataataaacagaagctgtttgaacaaggtataggccaaatcgtcccgataagaatcaagcgcgtaagagagcatcatcgctgattgtccattgacggaaagtccctttttaatgacaaaaaacactttctctccattgacgtcggcgctgtaacgtttctttttagcttcctgcttatcagccagcttgtacaccttgtggataaatgaagatgacagaatgcttaaatccttgtctgaagaagcctcttcattttcaggaaggagcacgtgctgtacggagcggacagttgtcggcgccgtcgcttcctcgctgtaatagcgcctttcaatcgaacctggcaggcggtactctgtcagaacatgctgctcattttcaatcgtcgtatacgtttcattagtgaaaaaatctcgcagcgtgtttgaaaataacacaagcagtaaaatcgatatcgctaacaggatgccggatatgacaacccatatctgaaacgcgagcggcttgtttttcatgatgacatcatcctgtagccgaaaccgtaaatcgtctccaccttcaattcaggcatctttctgcgcagtctccggacgagatcatcaacgacccggtctgttccgaagtagtcatgtccccacacttttaggaggatatcctcacgagagtatggatgccctttatgatggataaataatagcagcagatcaaattcctttgacgtcaaattgatgatattcccgttttcgtcatagacctcgcgggcgtcttcagcgacccgatacgaggagacggcaatttcatttttttggacaggaggagcttccttatatacgagctgcagcagcttttgcacacggataatcagctcccgcggcaaaaacggctttgaaatgtagtcattgctgccaagctctaagccaagcactctgtcaatatccgcatctcgggcggaaataaaaatgaccggcacgtcaggatctttcgccttgatttcttttattaatgtatagccgtcggtatccggcagcatgatatcgagaatccataggtggggagacggtgtcattttctttctggcgtcttcacctttcgtaaaagatgtaatgttccagccctcattctctaaatacttcgtcagcagttcattcaggttatcctcatcttcaactagataaatggtgtatgacaaggctcttcacatcctttcaacgtcattataaactagttttaacatacggcaggcaattttcataatttcacatattcttttcatttttatcccacaatgtttgtttatgatatggttaagggaagaaaggaagagaaaaagagcgaggaagatgtaggatgatcaaacatattctattttggtgctttgcttttctcctcattattgggacaattgaacttgtacatgcgatgaatatgtaacgataaatgaataaccgttaaaggagtgtaagaacatggattatcgacgtgatggccaaaacgatcaacatcaaactgaaccttcacatacagaacagcagaatacagaaaaccagaagctgattggacattctgaacaagaattgcttgacgcgcctgtgtcgtatgaagcgggacggcaggaaacggcttctgctttagaaatggaaaagcaagaaacggctgtgaaaaaagaaaagaaacggagagccgcatggctgagcccgattttaggcggtattatcggcgggggcctcatgcttggcatcgcgccttatctgccgtcagaccaaaatcaggcgaccgaaaccgcttccgcaaataaacaggtgcagtctgataattttacaacggcgccgataacgaacgcatcaaacatcgctgatatggtagaggatttagagcctacgattgtcggaatctcaaatatccaaacctctcaaaataacacattcggcacgggaggaggctccagctcagaaagtgaaagcggaaccgggtcaggtgttattttcaaaaaagacagcgataaagcgtatatcattacaaacaaccatgtcgttgaaggcgcgaacaagctgactgttacgctatacaacggagaaacggaaactgccaagcttgtcggcagcgataccattactgatttggcagttttggaaatcagcggcaagaatgtaaaaaaagtggcgagctttggtgactcttcacagctgcgcactggcgaaaaggtaatcgctatcggtaacccgctcggacagcagttttccggtacagtgacacaaggtatcattagcggactgaaccggacaattgatgtggatacaacacaggggacggtggaaatgaacgtgctgcaaaccgatgcagcgatcaatccggggaacagcggaggcccattaatcaatgcaagcggccaggtcatcggcatcaacagcttgaaggtgagcgaaagcggcgtggaatcacttggatttgcgatcccaagcaatgatgtcgagccgattgttgaccagctgctgcaaaacgggaaggtggaccgtccgtttttaggcgtgcagatgattgacatgtcacaagttcctgaaacctatcaggaaaatacgctcggcctgtttggagatcaattgggcaaaggtgtttatgtaaaagaagttcaagcaaattcgccggcagaaaaagcaggtattaaatctgaggatgtcattgtcaaactaaacggtaaagacgtggaaagcagtgcggatatccgtcagatcctttacaaagacttaaaagtcggagataaaacaacaatccaagtgctgcgaaagggaaaaacgaaaacgttgaacgcaacactgaccaagcagacagaaagcagttcaagctaagaaaaacaaaaagctgaacccgattaaggttcagcttttttgttaccctaaataagaggaaagcatccacacttgtttttcaacttcttcaattaatccgacaaacaagtccgctgtcgcattgtcttgattttcttcagccaggccgatcacgaatttagattcgctgctgatttgtttgtagtcgtttaccaatgcttgtaccatttctgatgctgatgtttcgtttccgccgtctgtgatagatgcatgctcagtgtattctttcactgtggcaacaggctgtccgccaatcgccagcaggcgctcagcgatggtatccactgtttcagccgcatggtcataaagttcttcaaatttctcgtgcaatgtaaagaaatgaggccctttcacataccaatggaaacggtggagcttagagtataaaagaaaccagtttgataattgtgtgttcagtgaattctcaactaatgtttgatttgtttttgcgttttcagttttcataagataacgtcctccttgtgatctgttgacttaattatatcatatactaaataaaaatcaatactaaattataataattataatttagatcagctgaatagctttttcttcaggatagactcccacgcagaccaaggaaaaagcgatcggaacagcagggtgagcttgatgccctttccgatcgggtatcgcaaattctttatgtgctgttttgttgccaattgataaatgaggtcggcaacctcttggggatctccgctttcttctccgtttttttgaacataggaaaggatctttttatagtattgatgataggctgaatcgtcagcaggcaccgacataaaatttgataatgacgttgaccagatcgatgtcttgtatgagcccggctcgatcaaagcggtttcgataccgaacggaagcagctcgatacgcaggctttcagaaaaaccttccaatgcatgcttggaagaaacatatggcgacagcgctgggaatcctgtcagtccgctgatgctgctcacgtttataatctttgcgccgccatgctttcttatgtaaggcagcacggtttttgtcacatggatcacaccgaagacattcgtttcaaattgttgtctgaaatgttccatcggcacatcctcgataaatcctccataagccgttccggcgttgttaacgagtaaatcgatcggggcgtaagcactaacagcttttccgaatgagactatagattgttcatcggtgacatcgagagctgtaatgtgaatagaatcagacacattgtgtgctgcagccaattctcgaagctgttccgctttttcaggctgtcttgatgtggctatcacgaaaaatgatcgggcaagctttacagctgccagcagaccgaagccgctggacgctcctgtcacgatggctatttttttattcatcctaaccctcctattaaactgctacagctattgtactatcctgaacacgaaatgacgcctgtaatagaaatttttatacaataattcagaattgttctataatagaacgaaagaaggaaaggggttttgtgatatggcgctgcaaggggtaggccaaagatgggatcttgattcattttttaagggcgggagccaatcggaagaattcaaaggttatattgagaagctgtcacaaagtctgcgtgcatttcaagacaggactgatgcgtttcaggtgcctgaatcgcctgaagaggctgaagggctgaccgcgttgcttgatttattcgaacagacatccgtcaagcttcagcaggccggcgcttttgttgcttgcctccaggcccagaatatcaatgatcaaaaggctatagagcatcaggcctcatgaatcggctttccgcagattttcaatcgtcgctcgttacattagatcataaacttgtggacattaatcaagacgtgtggaatgaattgttaacaaaaccgggattgcgcgatgtttcttacatattaaatgaaagaagacagagggttgccgaaaagcttagccccggtaaggaaaaactgatcggaaaccttgcggtggacggatatcacgcttggagtgacttatacaatatggttgtcgggaaaatgacgatcccgtatgaggaaaacggtgaaaacaagcaattgtctgtcggtcaggcggagaatatgatggatcatcaagaccgtactgtcagaaaaacagtatatgaacgtttccgccaagcttgggagagcaagcaagatattttcagcagcacgctgaatcatttggcgggattccggcttgaaacctataaagcgcgcggctgggagaatgtcctgaaggaaccgctgcaaattaacaggatgaaaaaagaaacacttgatacgatgtggcaggtcatcactgaaaacaagaagccgttcgttcagtttttgaaccggaaagcatccatgctcggccttgaaaaactcagctggtacgatgtcgaggcaccgatcggttctgacggaaaggtctattcgtatgatgaagccgcaaatatcattaccagccagttttcaacgtttggcaaaaagctgtcctcattcactgaaaaagcgtttcgggacggctggattgaggcggaagacaggagcggaaaaagagtcggcggcttttgcaccagttttccggacagcggggaatcccggattttcatgacattttcgggaagcgcctcaaatgtctctacccttgcgcatgaactcgggcacgcgttccatcaggaagcaatgctcaacgtcaggccgttaaaccgttcctacgccatgaacgttgcagaaacagcttcaacgtttgcagagatgatagtggcggacgcgactgtccagcaggccgagacgagggaagaaaagcttgttcttctggaggataaagtgcaaagaagcgttgcgttcttcatgaacattcacgcaagatttctatttgaaacgagattctacgaggaacgaaagcggggagtggtaccggccagccgcttgaatgagctgatggaagaggcgcaaagagaggcatactgcaatgcgttagaagaatatcatccgcttttttgggcatcaaagcttcattttcacatcacgagggtgccgttttacaatttcccttatacattcggctacctgttttctcttggtatttacgcgttggcgcttgaagaaaaagacacattcgaagagaagtatatggcgctattgcgcgatacggcttctatgacagtggaggatttggcgatgaagcatttgggcgctgacatcacaaagcgcgatttctgggagaatgccatcaagctggctgtgcgtgacgccgaaacctttttacaaatgaccgaatcttaaagaaaaagccgtggcgttaaatgccccggctttttcaattcttctctgaatgaggatttcattctctggatatacctaaaataaatggaatcctacaggggggaaacatatgcatttgatcagagcagccggggctgtatgtctcgcagtggttctgattgcgggctgccgtttcaatgaagaccagcatcaggcagaaggagaaaatacagccgtcacccagctgaagtccgttccctacagtaatttttcgcttcgtgtgagctacggggatggtgagcataaccgttatgaaggaatctatacaaagaacgggactcaggaaaaagcggaaatacaggataagctctccggtgtcaatcaggaaggagaagaagcgttagatgagatgaaaatgattttgagcgagctttccgtgacagaccaaatggctgaaacagaagtgatacacagtgtgctggcagcatttaatctggacagtcattatgatcatatcgatttaaaattgaagctgaaggacggctccatcagagaaatcaagaagtaatcttgtgataaaaaacccataaacgtcaattatgtccataaaactaattgaaaatgattttcaaagtcagtgttttctgctacaatgagggatatatgaccatatcaaatggctgaatatcggaatcatttgcattgatgacaattgacttaaaagcatgtatatagaaaacgtgcaatacatagtgctgctaaaaagccagcaaaaaggagcggttatgggtatgagtgcaatttctacagaaacgctgagcttaggatacggggatgccgttattattgatgagttgaatttaacaattcccaaaggtgaaattaccgtatttattggcagcaatggctgcggaaaatcgacacttttacgttcattagcgcgcctgatgaagccgagaggcggttcagtgctgctggaaggaagagcgattgccaagcttccgacgaaggaagtcgcaaaagagctcgcaatcctgccccaaggtccttcggctccagaggggctgacggtgcatcagctggtgaagcaaggaagatatccttaccaaaactggctgaagcagtggtcaaaagaggatgaggaagcagttgaaagagcgcttaaagcaacaaagcttgaggacatggctgaccgtgccgttgattctttgtcaggcggacagcgccagcgggcttggatcgcgatgacgcttgcccaggaaacggatatcatccttcttgacgagccgacgacgtatttagacatgacgcatcaaattgaaattcttgatttgctgtttgagctgaatgaaaaggaagaccggacgattgttatggttctccatgacttaaacttggcgtgccgctatgcgcatcatcttgtggccataaaagataaacggatttatgcagaaggccgtccggaagaggtcatcacttgtgatcttgtgcaaaatgtgttttctatgaactgtcaggttacacaggacccgctcttcggaacgcctctttgcattcctcatggcaggggcagatgcattgtccaggaagcggctttcacatcacatggataaataacgcagcgaaggagctttcaattgagaaagctccttgctgttttttcgaaaggaagatggaaaatggaacaaaaacttcaggagcagcttgatggattgctggagaagtatactgagcttctgcttggtgaaacaaacgatgagctaaaagaagaagtgaagcaatggattttgtacacccatatagccaaaagcatgcctccgctcgctaagcattggaatgcgacataccccgacgcgaagcagggcattaaagagatcattcagcatattaaggaattaaatgaagcgcatcgaaacaaacaatagccaaaaagcagtctgttcattatagcagactgcttttttgtgattcagccgttttaactggcgtaaaggaatccataaaggttctcagcgcgctgctgataaacgaatcttttcgaacaataaactctgttttcatctggctgagagcttcaggcagcgggtacaatcgaattgatccttctgcttcatgtttctgcacaaccgttcttggcagcaacgagatgccaagacctgctgtaaccccgccgataattgcttcaagcgtcccaaattccataatgaccggctgtgtgacaccgacggaacgcagccatttttcaagtgtttctcgatacgaacagcctgtgctgtaaacgagaatcggctttgtgatggcttcctcaacatcgggcacggaggcagccgaaacaactactggttcttcctcaaacgcaggataggattcgagctcaggatgatggcattcgcatccgataaacgcgccatccaattcataacgaagaactttatcaaggagaaattgcgtatgtcctgttgttaaagacagctggacgtttggatgttcttcataataagatgccagaagctttggaagccttaccgcggcggttgtctgagtgcagccgatcataagcggcccgcttggttctgcggaggatgagagcgctttagacgcttcatcaagaaggcctataattttatttgcgtagtccagcagcaattttccgcttgcagaaagtgtcatgccccgattatggcgcaaaaacagtgtggtacccagctcagcttccaattgttgaattctggccgtgacattcgattgtacatagccaagctgcagggctgctttcgtaatggtcccttcacgagctaccatttgaaacacacgtaaatctccgctttccattttgaactcctccgttcgtttactatcaatctgagtgatatctagtatctttaacaatcattatacgtaacatcaaagctggattacaatggaatcagaaatatactttagtcaacagcaaggagtggcggcaatgaatgtcttgaacaaaatagctctcgtaacggggggcggcacaggaatcggaaaagcagccagtatggaattggcaaagcgtggggcgattgtggcggtgaattattcacgctcgcaatcagaagcggaggaaacagtggaaatgattcaaaaagctggcgggcaagccttcgccatccaagcagatgtatccaaaaacagcgacgtgcaggatatgattcaagcaatcgtgaacacacacggcacggttgatattttagtcaacaatgccagcattacacggcatattccaatggatgatcttgaggctgcgacagaagacgtctaggatgagctgtatgccgtcaatgtgaaagggatgtttttctgcgcgcgggcagtggttccgttcatgaagaaaagcaaggacggggcgatcgtaaacgtcggcagcatcgcagggataactggtgccggctcatcaatgccttacgcagtatcaaaatcagcggtgcacggtttaacgaaatcattggcccacgccttagcgcctgaaatcagagtgagcggtgtagcaccaggagctgtggcaacgagatggtgggccggacgggaagaaaaaatgaaaagcatgatcggctctttgctgctgcagtgtattgctgaaccagatgatgttgccaaattgatttgttcactaattgaacaggaatcactcacaggccaaattatcacaattgacagcggacagacgctgtaaagaaagggatgcggggagatgccatttgtacagattcatttacggtcgggaagaagcgaagtgtggcttcaaaaactgagcaggactatccaccaatcgatgattgaagaaatcaatgtgccggaagatgactatttccaagtcatcagacaatatgaaaaaagcgaatttttttatgatccattttatctccaagtcgagcgtactgatgaactgatatacattcattttacactgaaacagtcaagaacaactgaacagaaaaaagcactttaccgctcaatcgcgagccggattcattccgagcttggtgtaagaaaagaagatgtgtttatcatgctggccggaaatcaggatgaggattggtctttcggaaatggaagagcccagatgattgaataaaaaaccccgcggattgatacccgcggggtgctctattaatgggaaggtgattcaacggcttttgccgccttctctttttcttgttggtcttccgctttcttatttgatagcttgataggttttaagaacaaggtgaatacggctccgactgcgataaagatcaggcccgtataaaacacgctgtggagcgaatccatcaacgatgtttttaaaaatcggcacaatatgggatgagaaagccgcagggatttgtttgaccgcgtccggactgaacagtgattgcagcagcccttgcggatttgtatcaatcataccctttagctgggcggcaaacgagcttgcctgtgccggaagagagtctaaatatggaaccaatttatctgttaatagatttcctgatctcgcattcattacggctcccagcatggtaatgccgaatgttccgccgatagaacggaagaattggctggatgaagtgacaactccaagctcctccttcgaaaagctttcctgtaaagccaatgtcagaatcggcataacaagacccattcccagaccaataatcgccataaaagatgtagcgacaagcttgctcgtgtcgagatccaatgtcgttaacagcaggaatccgccggccataaccagcatgcctgtaatgatttgcggtttaatcccaattttataaacaagctgtccgccgatgatacttgtgataatcatagaaatcatcatcggtgtcataattgtacccgattcagacgcacttacaccgacaattccctgcataaagaaaggaacaaacgtaatggcgccaaacataccgatactcataaagaagccgatcaagtttagaaatgtaaatgttctgtttttaaataaatacattggcaggattggctcttttgcttttgattctacgatgataaagctgacaatgccgatcagtgcgagagcgaacaacccaagaatctgccatgaatcccatgcataatcttttccgccaaagcttaaggcgagcaggaggctgaccacaccgacaatcattgtgaaaataccagcgatatcgaagttgatcggaccagtctgctggcgtccctgtaatcccctggcaataaaaataaccgcaataattccgactggcaggttaatatagaaaacccatttccagtttaacgagtctacaatccagccgccgatttgcggcccaatcactgaagccagcccgtaaattgcgccaaagacaccttggaatttagcacgctgttttcctgtgaacaagtcaccgatgacaatcatcgccatcggcatcatgatgcctccgccgatgccctgcagtccacggaagataatcaattccgtcatgttgttggccattccgcacaaagcagaagcggccataaaaataatcaaacctgatacatagacaatgcggcgtcccaataaatcagccagtttaccggcaattggaacaatggttgttgatgttaacaaatatgcagttgtcagccaggtcatcatgctcaaaccgcccagatcaccgacaattttcggcatggccgttccgacaatggtaccgtcaagggctgaaaaaaacatggcaataattaagcctgttattaataacgttcgttttgattgtttgccttctttactcattttcatccgtttcctcttttcatgttttgcttttcatccgtttctgctgcttgtgcgagttttgctgtaatatgcgccgcctgcagcatttcctcctccgtcaaaaaggaaagatagcgcgccattatggcttttctgcccgccaaaacctcctcgaactttatgtctccttcgtcagtaagactgagatcaatcactcgcctgtcttttgtgttgtgtgttctggcgataagatttttttgttcaaggcgatctgccatcagcgtcaccgcgcttggcttcacctccatacgctcggcaatttcagaaactttgaggctgccgtgtttctttaggctggccagcacaaacagctgcgctggggtgacaccttgtttctccatgctttccagcatttcaggctgtatcttttgaaagagcgcctgaagcgataattgaatatcggacattaactgatccgcactcttcatattcatttcccctctgttacatacactgtatatatattttaatgacaaaatagttaatgcttattaaatataaataagcgtaaatgaaaagtcaactgattttacacaaaaaaaggatagatgcccgaaagaacatcgtatcctttttactaatgttgttattgctgataaggagactgctgctgaatggtctgctggaatttttgataggactgctgcagcttttgtgaatcctccgcttcaacagaataccatccatattggaacatgagatcatatagttttctttgcgctttttgtgactcatcaaaaatggattgaatatcctgataaagagactcgtggctgaattcgtgcaaggcagtgcaataagctgttgtcatgtatttttcggttgtcagcaattcgttgacgaaatctctgtcattcatttccgatgttgtcggtacaggtgtctgcgggttgctgattttttgattttgctgattcattctggcgcctccttattggatgtagccggactgctgctggcctggctgcaggtgctttaatattctttgatagtgatcatgatgcatgtgtccgacgcggtcgagttcttgctttaacgtttgatcctggcactgctgcgccatgaaatgcgcttttttcatcgcgagcaaattccagttcagcatgtcattgagatacaaatgatcctttgtcgaaataacggaaggcggcatttgagattgctgctgattatccattgtgatcctcctttggtttctgttcattttatagtttccttcagactgggagttatatacaggtgttttgaagatgacggcgggagggagtcggatgttgagacatgtgtttttattcttatctcaaaataaaacacttaccaagttcgcaaaagcatacggaacgcggcttggagcacgaaggtttgtcgcaggggatacgattgaatcggcggttaagaccgtcaaaaggctaaacagatccggtttgtgtgcaacaattgattatttaggcgagtatgcagcttcggaaaaagaagcaaaccaagtcgcagaggaatgcaagaaagccattcaagccattgccgaacatcaattgaattcagagctttcacttaagctgacctcaatcgggctcgatctttcagaagaacttgctcttactcatttgcgcgccattctttccgttgcgaagcaatatgatgttgctgtgaccattgatatggaagactattctcattatgaacagacactttctatttacaggcaatgcaaacaggaatttgagaagctcggcacggtcattcaggcgtatttgtaccgggcggcagaagatatcagaaagatgcgggacttaaagccgaatctcagacttgtaaaaggcgcttataaagaatctgcggctgtagcgtttcccgacaaaagaggcacggaccttcattttcagagcttaataaagctgcagttgttaagcgggaactacacggctgtcgccacacatgacgatgacatcattgcatttacgaaacagctcgtcgccgaacatcaaatccccgcatcgcaatttgagtttcaaatgctatacggcatcaggccggagcgtcagaaggaactcgccaaggaaggctacagaatgcgtgtgtatgtcccatatggaacggactggttcagctactttatgagaagaattgccgaacggcctgccaatgcagcgtttgtgttaaaaggaattttgaaaaagtgaaagcagccgtgggaagcagctgcattatgattgtcccatgttatgttttttatactgctgattttgacttgtccgttttccgccgccgtaatgctgagtcggaccggcatctccctttacgctcgccgcgctgactgccgctgaagacggattttttttctctcgtaccattcccttcacctccgggcttaagttgcccgacttttataggcttcatacaaaaaaataacaaattagctattgaagtcgaaccggaaatcttttaagatgaaagaagaaacgggtttcattttttttagtcaaaaaatgaatgactattcattcaatgttcaagggggatatctcatgcacaaacacattcggaaggcagccgttttaggatcgggggtaatgggttccgggatagcggcgcatttggctaacatcggaattcctgtcctgctgctagatattgtgccgaacgatttgacaaaggaagaggaaaaaaaggggctgacgaaggacagttcggaggtgcgcagcaggctgagccggcaggcgatgaaaaaactgctgaaacaaaagcccgctcccctcacatcagcgaaaaatacctcctatattacacctggcaatctggaggatgatgcagaaaaactgaaagaagcagattggattattgaggtcgttgtcgaaaaccttgaagtcaaaaagaaaattttcgctcttgtggatgaacatcgaaagactggaagcatcgtctcaagcaacacatccggcatatcagtgcaggaaatggctgaaggccggtcggatgattttaaagcccattttcttggaacgcatttttttaatcccgcacgatatttaaagctgctagagatcattccgattaaggaaacggatcctgatattttaaagtttatgacagctttcggagaaaatgtcctcgggaaaggcgttgttacagcaaaggacacaccgaactttatcgcaaaccgcatcgggacttacgggcttctcgtgacagtccaagaaatgctgaaaggcggttatcaggtcggggaggttgattcgatcacaggaccgctgatcggcaggccgaaaagcgccacctttagaacgcttgatgtggtcggcctcgatacattcgcccacgttgcccgaaatgtgtatgacaaagctgatggcgatgaaaaagaagtgtttcgcattccaagcttcatgaacgatatgctggaaaaagggtggatcggaagcaaggccggccaaggcttttataaaaaagaaggaaaaacgatttatgagcttgacccagtgacgcttacttacggcgagcggacaaaaatgaaatcaccggcacttgaagcggcaaaacaggcaaaagggacaaaagccaaaatgaaagcgcttatttattcggatgacagggccggccgtttgctgtggaatatcacttctcaaaccctgctttactcagccgagctgcttggcgagattgccgatgatattcatgcgattgaccaagccatgaagtggggattcggctgggaactgggaccttttgagatgtgggacgccatcggcctcaagcagtcagcggaaaagcttgagcagcttggagcagatatgcctggctggataaaagagatgctggacaaaggaaatgaaaccttctacatcaaagagaacggaacggtattttattatgaccgcggcgaatacagagccgtgaaagaaaacaaaaaacgaattcatttacaagcacttaaagaaacaaaaggcgtgattgcgaaaaacagcggagcaagcttaattgaccttggagatgatgtggcccttcttgaatttcattcgaaaagcaatgcgatcggcctcgatatcattcaaatgatccacaaaggattagaggaaacagaacggaattacaaggggcttgtcatcggcaatcaagggaaaaatttctgcgtcggcgcgaatctcgccatgatcttaatggaagtccaagatgacaactttttggaagttgattttgtgatccgccgttttcaggagacgatgatgaagatcaaatacagtgcgaaaccggtcgtcgccgcgccatttggcatgacgctcggcggaggaacggaagcatgcctgccggcggcgcgcattcaagcggcaagcgaagcctatatgggacttgtggaatccggtgtcggcctcatccctggcggaggaggtaacaaagagctgtacatcaaccatcttcgccgcggccatgatccgatgaatgcggcaatgaaaacatttgaaacaatcgcgatggcgaaagtgtccgcttccgctcaagaggctcgtgagatgaacatcttaaaagaaacggatcagatcagcgtgaatcaagaccacctgttatacgatgcgaagcagctggccgcatctttatacgataccggctggcggccgcctgtaaaagaaaaggtcaaggtgccgggagaaaccggttatgcggcactcttgcttggcgctgagcagatgaagctgtccggctatatatctgagcatgattttaagatcgcgaaaaaactcgcttatgtcattgcgggcggaaaagtgccgtttggtacagaggttgatgaagagtatttattggagatcgaaagagaagcgtttttgagtttgtcaggagaggcaaaatctcaagcgagaatgcagcatatgcttgtgaaaggtaaacctttacggaattaggagggagcttatgaaagaggcagtcattgtgtcaggtgcaagaacaccggttggaaaagcaaaaaaaggatcgttggccaccgttcgcccggatgatttgggagcgatttgtgtaaaagaaacgctgaaacgggcaggcggctacgaaggcaatattgatgacttgattatcggctgtgcaacacctgaagcggagcaggggcttaatatggcgagaaatatcggtgcgctcgcgggcctgccgtacacggttccggcgattacagttaaccgctattgctcttcaggccttcagtctattgcgtatgcagcagaaaaaattatgctgggcgcctacgatacagcgatcgccggcggagcagaatccatgtcgcaagttccgatgatggggcatgttacccgtccgaaccttgctttggcagaaaaggcaccggaatattatatgagcatggggcacacagccgagcaagtcgcgaaaaaatacggcgtctcccgtgaggatcaagacgcgtttgccgttcgcagccatcaaaacgccgctaaagcccttgcagaaggaaaatttaaagatgaaattgtacccgtcgaagtgacggtgacagaaatcggagaagaccataagcctatggaaaaacagtttgtgttttctcaggatgaaggtgttcgcccgcaaacgactgcagacatcttatcgacattgcgcccggccttttccgttgacgggacggtgactgcgggcaattcctcacaaacgagtgacggagcggcggctgtcatgctgatggaccgggaaaaagccgatgctcttggcctggcgccgcttgtgaaattccgctcctttgcggtaggcggcgtgccgccggaagtgatgggaatcggaccggtggaagcgattccgcgcgctttgaagcttgccggacttcagctgcaggacatcggcttgtttgaactgaatgaagcttttgcctcacaggccattcaagtaatcagggaattgggaattgatgaagaaaaagtgaatgtcaacgggggcgcaatcgcgcttggacacccgcttggctgtacgggcacaaagcttacactctcactcatccatgaaatgaaacggagaaacgagcaatttggagtcgtgaccatgtgtatcggcggcggaatgggagcggccggtgtatttgaattatgctaaagggggaaaaacaaatggcaaaaaaagcggctgacgtacaaaaaggcggcggatttttaatcgaggatgtcacatacgatcaaatgtatacaccggaggatttcactgacgagcataaaatgattgcgaaaacaacagaggattacatcgagcaagatgttctccctcatatagatgatatcgaaaaccatcaattcgagcattctgtcagactgttgaagaaagcgggcgaactagggctgcttggcgccgatgtgccggaagaatacggcgggctcggccttgataaaatcagctcggcactcatcactgagaaattttcgcgtgcgggaagcttttctctttcttatggcgcgcatgtcggtatcggttccttgccgatcgtctttttcgggtcagaagaacaaaagaaaaaatatttgcctggactcgcttcaggcgaaaagatcgccgcttatgctctgactgagcctggctctgggtctgatgcacttggagcaaaaacaacagctgtgctgaatgaagcaggaacccattatgtattaacaggggaaaaacagtggattaccaactctgcttttgccgatgtatttgtagtttacgctaaggtagacggcgacaagttttcagcctttattgtagaaaaagagttcccgggtgtctccacgggaccggaagaaaagaaaatgggaatcaagggatcatcgacaagaaccctcattctggatcaagctgaagtgccaaaggaaaacctgctcggagaaatcggcaaagggcatgtcatcgcctttaatattttaaacatcggccgttacaaactggcggttggcacaatcggcgcatctaaacgcgtcatcgagctgtctgcggcatacgcaaatcagcgccgccaatttaaaacgccgattgctggtttttcattgacacaggaaaaaatcgggacaatggcctcaaggctgtatgcgatggaaagctctgtatacagaaccgtcgggctgtttgaagacaatatgagccagttcacggccgaagatctcaaggacggccggcaaatcgccaaatcgattgcggaatacgccatcgaatgctctctgaataaggtattcggctctgaaacgcttgattatatcgttgatgaaggcgtgcagattcatggaggctacggctttatgcaggaatacgaagtagaaagggcctatagggattcaaggatcaatcggatttttgaaggcacaaacgaaatcaaccggttaatcgtgccaagcaccttcctgaaaaaagcgcttaaaggcgagctgcctttattcgaaaaagcgcagtcgctgcaggaagaactcatgatgcttatgcctgaagagcctggaagcggcgtcttagagcaggagaaatatatcgtcaagcaagccaaaaaaattgcgttgtttgctgccggcctagccgcgcaaaaatacggaaaagcgatcgatcgtgagcaagaaattctcgtgaacgtagcggatatcgtcagcaatgtatacgcaatggaatcagccgtgctcagaacggaaaaggccattgccgcacaaggcgctgaaaaagcagcgcaaaaggtgctgtacacagaaattttcgttcaagaggcctttaacgaaatcgaagcgcatgcaaaggaatcccttatcgcaatggaagaaggagattcactccgcatgatgctttccgctctgcgcaagctgacacgcgtaacgcctaaaaacgtgattcagaaaaaacgcgaggcggcggcaggcatttttgaggctgagaaatatactgtctgattggccatgagctccgcatgcgcggagctcttttttaagaagcactgttttaggtttttaaaacaaactgtgttaaaataacctcgattattttattgagggggaagaagatgtcgttaactttttactggtaccctaaatgcggaacgtgccgcaaagcaaagaagtggcttgaagagcatgggaaagaaataaacgaaatacatattgctgagcagccgccaagcaaagaagaattaaaagcgctttatgaaaaaagcgggctggatctcaagaaatttttcaacacgagcggcatgaaataccgcgagctcaatctcaaggaaaagctgtatcatatgtcagaggacgaacagctcgaactgctggcttcagatggtatgctaattaaacgcccgcttacaacagacggcgaaaaagtgactgtcggatttaaagaagaccaatttgaagaaaactgggcttaatgtaaattttttttgaaaagtgtggtatcttcttattgtagtgctgtaaaaaatggagggattcaattgagcataccaaaagatttgcgttactcaggagaacacgagtgggtaaaagttgaaggagaaaaagccagaatcggaattacgcattttgcccagtccgaactaggcgacatcgtgtttgtcgaacttcctgaagtgggcgctgaaatcaaagcggacgagccattcggcagtgttgaatccgttaaaacggtatctgagctttatgcaccgattaacggaacggttgtggaagtaaacgaagatcttgatgacagtccggaattcgtcaacgaatctccgtacgaaaaagcatggatgatcgtcgttgagccatctgacgcttctgaaattgaaaaactgatgacagcagagcaatacgaagagatgacacaagaagactaaaacaggatagccgtaaaagcaattggacacgctaacgttatgggaggtgtccaatatggctttcgacaaacaaaagctcgatgtcaccaatgacgtgacaggccgctttcaaaatggccggctctcgttatatcatgataatgagatgatcggccaaatgacaagcatgaatgaatatgagcttaagtccggttattcctttgaaaatgagaaattttataagacagccgatgtggtctctggagacgacgcaaaatatgtagattgtgactacgaaaacggctggtgttaatgttggcggtgaatttcactgccttcttttacaatctgaacatttcaaatttgacgcggcaggtgaacaagatgaagatggatgagctggaaaaggttatgattgtcgaggggaaatcagataaagagaaaatcgaaagcgtcctgaatgaaccgatgcgcattatctgcacaaacggaacaatcagccagctgaggctcgaggaattggctgacgagctttatgataaagacgtctatatattagttgatgctgatgaatcaggtgagaaattgagaaaacagctgaagcgtgaatttaatgaagcctgccatctccatgtcgacagagcctataaggaagtagcggctgcgcccaggcaccatatcgcttctgtattgctgcgtgcgaatctgaatgtccatactatttttcttgaaagaaagtcccgaggtgtatagcatgaaagaactccaagaacacgaacttgatcacattgaagatgatgtgtaccttctatatttatatactccgttttgcggcacctgccagcttgcaagcaaaatgctgacagtggtgaaagaaatgctgccggatgtcgccttctatcaaaacaatgtcaattactctccgacattcgcaaaagcgtatcaaattgaaagcgtcccttgttttctgctgtttaaaggcggaaagatggtcgaaagaggatatgcatttcattccgtttcttatttatatgagctgatcaaacaaaaatcatcttccgcatcccatttatgacatatttctcagcatatccaatgaaattgtcgttcgttttataaaggggttcttgcgacaaagagagaaatgtgtatgtatgaccaacaaataggaggttgtacatatggagaaagcggaagttttagaagatgagtatcagcatctgtttttaaaaccccttttgaatgcctcaacattgctcattaccttccaaggagaagcagaagccttaaccgtctcaataaacgaacagggagaaatgaaaaaagtttctccgccccaaacgtccaacctgaccttttacggaaaccaaacggaaattattgatttattgcacggagacatttcccttcagcaccttattcagagcggaagcctcaaagtaaaggggtcattcagggccctgttaaagctggaagccattctctggctgacaaatggattttttcagaggattttaaaaaattaaaaataataaattattataatagtaaaagttgacatcatttattttattgacatttaatcattcgccgtgctattctacattaagaatttccggacgaaaaagactatatatttctcttatcaagagaggtggagggaagtgccctatgaagcccggcaaccatcaacactgttgaaatggtgccaattcacacgaagcgttcagctttgaaagatgagagaaaggcattttatataagcctttctgctcaagtgtgcagaaaggcttttcttttgcagaaaaaaccggaagatttcttagaatagtgttaaggcaggtgattgctttgatcaatcttcaggatgtttcaaaagtttacaagtcgaaacatggagatgtcaatgctgtccaaaacgtctcgctttccattaaaaaaggtgagatttttggaattataggatatagcggagctggtaagagttccttaatccgtctgctgaacggccttgagaaaccaacctcaggaaccgtggaagtggcgggaaccaagattaatgaagtaaatggacgcggtttaagaaaagcacgccatgagatcagtatgattttccagcatttcaatttgctttggtcgcggactgtcagagataatatcatgtttcctttagaaattgccggggtgaaaaagagcgagcggatcaagcgcgccaatgaactgattaaactggtaggtttagaaggaaaagaaaaatcttatccgtcccagctgagcggcggtcagaagcagcgtgtcggaattgccagagcgcttgcaaacaatccgaaggttcttctttgtgacgaagcgacatcagcattagatccgcaaacgacagattcaattctggatctattgtccgatattaatgaaagactcggtttgacgattgtgctgattacgcacgaaatgcatgtcatacgcaaaatctgcaacagagtcgccgtcatggaaaacggcaaggtggtcgaagaaggcgaggttctcgatgtcttcaaaaatccaaaggaacaaatgacaaaacgatttgttcaacaggtgacagagccggaagaaacgaaagagacgcttcagcaccttcttgatgatacagcatcaggaaaaatggttcagctcacatttgtcggtgagtcagctgaacagcctctgattacagagatgatcagaaacttcaatgtcagcgtcaatattctgcaagggaaaatttcgcagacgaaggatggggcttacggttcactgttcatccacattgacggggacgaggaagaagtgcaaaacgtgatccgattcattaatgacaaacaggtgaaagcagaggtgatcacgaatgtttgaaaaatacttcccgaacgttgatttaactgaattatggaacgcgacatatgaaacactttatatgacgctgatttctttactgtttgcttttgtcatcggggtcatcctcggcttgctgctctttctgacgagcaaaggaagcctctggcagaataaagcggtcaactcagtgattgcagccgttgttaacatattcagatcgattccgttccttattttaattattttactattaggttttacgaaatttttagtcggcacgatcttagggccaaacgccgcattgccggcgctggtaatcggctcggcaccattttacgcgcgccttgttgaaatcgcgctgcgtgaggtggataaaggtgtgattgaagcagctaaatcaatgggcgcgaaaacgtctacgattattttcaaagtgctgattccggaatcaatgcctgctcttatttctggcattacggttacagccatcgctttaatcggttcaacggcaattgccggagccattggttcaggaggccttggaaaccttgcgtacgtagaaggatatcagtctaataacgctgatgttaccttcgttgctactgtgtttattttaatcatcgtgtttattattcaaatcatcggtgatctaataacaaatattatagacaaacgataagggaggatttacattgaaaaagctatttttgggtgcattactgcttgtatttgcaggagttatggctgcctgcggttcgaataacggcgctgaatccggcaagaaagaaattgtcgttgcggcaacaaaaacaccgcatgcggaaattttaaaagaagctgaaccattgctgaaagaaaaaggctatacgctgaaagtgaaagtgcttagtgattacaaaatgtacaataaagctttagctgataaagaagtggacgcgaactacttccagcacattccttaccttgagcaagaaatgaaagaaaacacagattacaaacttgtgaatgccggcgctgttcacttagagccattcggtatttactctaaaacatacaaatcactgaaagaccttccagacggtgcgacaatcattctgacaaacaacgttgctgaacaaggccgtatgcttgcaatgcttgaaaacgctggattaatcactcttgattctaaagtggaaacagttgacgcaacattgaaagacattaagaaaaacccgaaaaaccttgaattcaaaaaagtagcgcctgaattaacggcaaaagcatatgaaaacaaagaaggagacgcggtcttcatcaatgtaaactatgcgatccaaaataaattaaatcctaaaaaagacgcaattgaagtagaatcaacgaaaaacaacccatacgctaacatcatcgcagtaagaaaaggcgaagaagattctgcaaaaatcaaagcgctgatggaagttcttcactctaaaaagatcaaagacttcatcgagaaaaaatacgacggagctgtgcttcctgtatctgaataagactgaaaccccggatgagaattccggggtttttttcgcgtattttcctaaaagctgttcataataaaaaggaatgttaaacagatggagggattttctttgaatcaagacagaggaagcatgcaggacgcgttaaaacaatataaacatggtttaggcacatttgaacaaaagatgccgctgatgggaagaaaatttaacgaatttactgaacagtgctttgccgggaattctctgactgaaagagaaaaacagctgatcgccctcggaattgccatcaatgctcaggacgaatattgcatgatctatcatacaaaaggctgtcttgatcagggagcgtcagaagaaaacattctcgaagccgtcagtgtggcagcggcatttggaggcggcgcagctttcagccaaggcgtgacagtcgttcaacagtgcattgaggaattcggaaacaccacgcattaagagaaggaatattccgaaaaaccattctcatttgttctgaaaggatgctttcgtctcatctgccgctatttcacgccaaatcgtttttgcggcatccaacgcagcactggtacaataaaaagcaaatatatgaagggattgattcattatttgcagcagccaggacagactgaacctcgattatacgtcagaaatggaaaaagcgatgcagctgtcacacggaattggatacgaggaatatggacgccggctggaaacaagaatgaaagtagagcggcagagagagcttgattatgaaaaaagcaagcggatttctgcgggagcttattgagaaaatcaatcttttaaaaaagggtgggaatccactctttttctttttcaatcgctttaataaagtgctgatctttgttaaacttgaggaatgtgcaaggcacgataaaaagttgtatttacttttcatttgttataaaattagaatgagaataaaatgagaataatgattatatatttttggaggtatagatatggctgcttcaacattaacgatcaaagatcttcacgttgaaatcgaagggaaagagatcttaaagggtgtaaaccttgaaataaaaggtggagaattccacgcagtaatgggcccgaacggaactggtaaatccactttatcagctgctattatggggcatcctaaatatgaagtaacaaaaggcagcatcacgcttgacggcaaagatgtactggagatggaagtggacgagcgtgcgcaggcaggcttattccttgcaatgcagtacccaagtgaaatcagcggtgtgacaaatgccgacttccttcgctcagcaatcaacgcgcgcagagaagaaggcgatgaaatttctctcatgaaattcatccgcaaaatggacgaaaacatggagttccttgaaatggaccctgaaatggctcagcgctatcttaacgaaggcttctcaggcggggagaaaaaacgcaacgaaatccttcaattaatgatgattgaaccgaaaatcgccatccttgatgaaattgactcaggccttgatattgacgctttgaaagttgtatcaaaagggatcaacaaaatgcgcagcgaaaacttcggctgcctgatgatcactcactatcagcgcctgttaaactacatcactccggatgttgttcacgttatgatgcaaggccgcgttgtaaaatccggcggtgcagagcttgcacagcgtcttgaagcagaaggttatgactggatcaaacaagaacttggcattgaagacgaaactgttggccaagaagcgtaagcgttagggggattaatatgacactaggtacaaaactatccgtagatcaggagtatctcaaaagcttttccgaaaagcaccaagaacctgcctggctgaagaacctgcgcttacaggctcttgaacaagctgaggatctgccgatgccgaaacctgacaaaacaaaaatcacaaactggaacttcacgaatttcgcgaagcatacagtggataacgaaccgctttcttcattagaagatttgactgatgaagtaaaagcgctgatcgacattgaaaacgaagataaaacattatacgtacagcgtgaccagacgccggcacatctttctctttctcaagaattgaaagacaaaggcgtcatcttcactgatattctgactgctgcacgcgagcacagcgacttggtggagaaatactttatgaaggacggcgtgaaggttgacgaacataagttaactgcacttcacgcggctcttgttaacggaggagcattcctttatgttccgaaaaatgttcaggtggagacgccggttcaggctgtttatgtccacgaaagcaatgatacagctctattcaaccacgtgctgattgtggctgaagaccacagctctgtaacatatgtagaaaactacatcagcactgtaaacccgaaagacgctgtcttcaatattatcagtgaggtcatcacaggtgataatgccagcgtgacatacggtgcggtggataatctgtcaagcggtgtgacaacttatgtgaaccgccgcggtgctgcgcgcggacgcgacagcaaaatcgagtgggctctcggcctgatgaacgatggcgacacgatttccgaaaacacaacaaacctttacggtgacggcacatacggcgatacgaaaacggttgttgtcggaagaggagagcaaacagaaaacttcacaacacaaatcatccatttcggtaaagcttctgaaggctatatcttgaagcacggtgtgatgaaggattccgcttcttctatctttaacggaatcggcaaaatcgaacatggcgcttctaaagcgaatgcggagcaagaatcacgcgtgctgatgcttagcgaaaaagcacgcggagacgcaaaccctattcttttaattgacgaagacgatgtaactgcaggacatgcggcatctgtcggccgtgtggaccctattcagctttactacctgatgagccgcggaattccgaaagaagaagcagaacgcttagtcatttacggattccttgcaccggtagtaaatgaacttccgattgaaggcgttaagaaacaattagtttctgttatcgaaaggaaagtgaagtaatgaatatcacagatattcgtgaacagttcccgatccttcatcagcaagtgaacggacatgatctcgtttatctcgacagcgcggcgacttcccagaagccgcgtgctgtcattgaaacactggataagtattataaccaatacaattccaatgttcaccggggcgtccatacacttggaaccagagcgacagatggttatgaaggagcgcgtgaaaaagtccgcaagtttattaacgcgaagtcaatggctgagattattttcacaaaaggcacgaccacatcactgaatatggtggcgttaagctatgcgcgcgccaacctgaaacctggtgatgaagtggtcatcacctacatggagcatcatgcgaatatcattccgtggcagcaggctgtaaaagcaactggcgccacattaaaatatattccgttgcaggaagacggaacgatttctttagaagacgtcagagaaacggtcacaagcaacacaaaaattgttgcggtgtctcatgtatctaatgttctcggcacggtcaacccgattaaagaaatggcgaaaatcgctcatgacaatggggctgtcattgtggtggacggtgcacaaagcacgcctcacatgaaaattgacgtgcaggatctcgattgcgacttctttgcgctttcttcccataaaatgtgcggacctaccggtgttggtgtgctgtacggaaagaaagccctgctggaaaacatggagcctgccgaattcggcggtgaaatgatcgactttgtcgggctttatgaatcaacttggaaagagcttccgtggaaattcgaagcgggtacgccgattattgcaggagcaatcggcctcggtgccgccattgattttctcgaagaaatcggtcttgatgagatttcccgccatgagcacaagcttgcagcttatgcgcttgaacgcttccgccagcttgacggcgtaacggtttacgggccggaagagcgtgccgggcttgtcacatttaaccttgatgatgttcatccgcacgatgtggcgactgtgcttgatgcggagggaatcgcagtcagagccggccaccattgtgcgcagccgctgatgaaatggctggatgtaactgctactgcaagagcaagcttttatctgtataatacagaggaagagattgataagcttgtggaagctcttcaaaagacaaaggagtattttacaaatgtcttttaatgcaaacttagatacattgtacagacaggtgattatggatcattacaaaaacccgcgaaataaaggggttttaaatgacagcattgtcgtggatatgaacaatccgacatgcggcgaccgcatcagactgacaatgaagcttgacggagacatcgtggaagatgcgaagtttgaaggggaaggctgttccatttcaatggcatccgcttcgatgatgactcaggcgattaaagggaaagatattgaaactgccctttccatgtctaagattttctcggatatgatgcaagggaaagagtatgatgattctatagatctcggggatattgaagcccttcaaggcgtttcaaaattccctgcccgtatcaaatgtgcaaccctgtcatggaaagcacttgaaaaaggagtcgcgaaagaagaaggcggcaattaaaaggattggagtgaaaatggatggctaaaaaaatgcctgatattggtgaatacaagtatggttttcacgacaaggacgtttccattttccgttcagagcgcggattgacaaaagaaatcgtagaagaaatttctcgcatgaaagaagagcctcaatggatgcttgacttccgcttgaaatcacttgagcatttctacaatatgccgatgcctcaatggggcggagatttaaactcactgaactttgacgaaattacgtactacgtaaaaccgtctgagcgttcagagcgttcttgggatgaagttcctgaagaaattaaacaaacattcgacaagctcggtattcctgaagctgaacaaaaataccttgcgggtgtttctgctcagtacgaatctgaggttgtataccacaacatgaaagaagatcttgaagcacaaggcatcgtctttaaagacactgacagcgcgctgaaagagaatgaagatattttccgtgagcactgggcaaaagtaatcccgccgactgataacaagtttgcggcgcttaactcagctgtttggtccggcggttctttcatctacgtgcctaaaggcgtgaaggttgaaacaccgctacaagcttacttccgtatcaactctgagaacatgggtcagttcgaacgtacactgatcattgttgacgaagaagcaagcgttcattatgttgaaggctgtactgcgcctgtttacacaacaaactcacttcacagtgcggtcgttgagatcatcgtgaaaaaaggcggctactgccgttatacaacgatccaaaactgggcgaacaacgtttacaaccttgtaacaaagcgtacagtctgtgaagaaaacgcaacaatggaatggatcgacggcaacatcggttctaagctgacaatgaaatatccggcttgtatcctaaaaggcgaaggcgcgcgcggtatgacgctttctatcgctcttgcgggtaaaggccagcatcaggatgcaggtgcgaaaatgattcaccttgcaccaaacacatcatctacaatcgtatcaaaatcgatttcaaaacagggcggaaaagtaacgtaccgcggaatcgtccacttcggacgcaaagcggaaggcgcccgctctaacatcgagtgtgatacgctcattatggataacaaatcaacttctgacacaattccttacaatgaaatcttaaatgataacatttcattggagcacgaagcgaaagtgtctaaagtatctgaagagcagctcttctacttgatgagccgcggtatttctgaagaagaagcaactgaaatgatcgtaatgggctttatcgagccattcacaaaagagcttccgatggaatacgcagttgaaatgaaccgtttgattaagttcgaaatggaaggttctatcggttaatgatgaaaactcctttgtttatcaaggggtttagagatagttatcaactttaaaatggccggcgtgccgaatttgattgtagaagacgaacttttgaagttcgtcttcttttatttttcagagacatatccactgttattttaatggttttaattccttatcgattagaatatttcagacctgcgccggataggttcagtttctatatcacgcaaccatacagttgcttatacttgacatgcaactaatgggttgcttatactcaatatatgaatgggaacaaagacgctatattcaaagcactcggcgattcgactcggcggcttatattagacgaattatctgaacgcaacgagctgacgttgtatgaacttacgatacgtcttattacaaagtacgacctttctattacgcgacaggcgatagctaaacacctttctgtactggaggatgcaggactcgtaacatcaaaacgaaagggaaaatatcgagtacttatattcaacaacgaaccgcttaaaaatttgctgaaaggatggatagaataattttataaaatcagaacagggcctctgataaatgtgtgggttgttttgcttgtagccagattgttagcatagtaccatgcttcattcatatcgaaggagggaaaaacagtatgaaaatcgttgttaccagtatatttgtacaagatcaagacatggcactggagttttatacagaaaaacttgggtttataaaaaaggaagacgttcccatggggaaattcaggtggataacgcttgtttctccagatgatcaagacggaaccgagcttttactcgaaccgaatgaacatcctgccgccaaggagtatcaaaagaagatattctccgaaggcctcccggccacaatgtttggcgttgcagatattcaaaaagagtacaaccgattaaaggaaaaaggcgtgacgtttacgacggaaccgacaaaaatgggcgaagtcacaatagctgtcttcgacgatacatgcggtaaccttattcaaattgtacagaagtaaccgattcagtcgcgtcctttttgtatgcagaagaaaaaccgctggccgaggggccgcggttttttactcttcttctgtctcttgattgataatttgctttacagatgatctgctgttattttctctgttcatctctcgcaattgagtataagccatatcgaattcctcttttgtcatctgctttgcggctaatgcagagcataatatagcaaaagcaattggcattgtatcaatgtgaatgtcgatatggacctctgagttgccgctgtttttgataacagattcagtagtgggtatctcttgagtatgtctgttaagaggaatgatgttttcgttcattagtcttctccgtcttgtgactgcgcctgtgcctgatcctgatctgtgttcacgctgaccacgacttttgcattaccgctgttttggacttttgccactgccgcatcgcgtctgttttcttcattttcatgacgattttcgctcatggtatcatcctttctctattgatagtgacaggatattcgataggagagtaaagagattggacgaacttcgcggtttttccacattagggcaaaaggtcgaaggaaagcatttgatttggtaaaatgaatagacattataatagaaaaggtgtttgcatatgaaatcgtacatcatcgtcggcgcagggattctgggcgcgtcgacggcttatcatctcgcaaaaacaggcgctcgcgttactgtcattgatcggaaagagccgggacaagcgactgatgcggcggcggggatcgtctgtccttggctctcgcagcgccgtaatcaggattggtaccagcttgctaaggggggagcgcggtactataaggatttaatccatcaattggaaaaagacggtgaatcggatacaggatacaaacgtgtcggtgccatcagcattcatactgacgcgtctaaactcgataaaatggaggaaagggcgtataagagacgggaggatgcgccggaaatcggcgacattacccgcttgtctgcaagtgaaacgaaaaagctgtttccgattttagctgacggctatgaatcggttcatatcagcggtgccgcccgtgtgaacggaagagcgctgtgccggtcgcttttaagcgctgcagagaaacgcggcgcaacggtcatcaaaggaaatgcgtccttgctttttgaaaacggaacagtcaccggcgtgcaaacagatacaaagcagtttgcggctgacgcggtcattgtgacggcgggagcatgggccaatgagatattgaagcctcttggcattcattttcaagtgtcatttcaaaaagcgcagattatgcattttgaaatgacagatgcagatacaggatcgtggccggttgtaatgccgccgagtgatcagtacattctgtcgtttgataacggcagaattgtagccggcgccacacacgaaaacgatgccggtcttgatgatcttcgtgtgacagccggaggccagcacgaagtattgagcaaagcgttagccgttgcaccgggtcttgctgatgcggctgctgttgaaacaagagtgggcttcaggccgtttacaccgggatttctgccggtcgtaggggccgtgccgaatgttcaaggcctgtacgctgcaaacggtttgggtgcttctggactgacgatggggccgtttttgggtgcagagctcgcaaagctagttctcggaaagcagacagaattagaccttagtccttatgatccagccggagcacttgcataataagtaagagcatgacaaacaaatataataaagctgttctagcttttcttttctgtatgtgttagcatttatctttaatgaaaaagaggacgtgaactgattttgataaaaattgatatacccgcaccgaatgtcaccatcactgaacgacagcagtcagctaatgataacgagccgaagataaaaccgattcacggattcatcgactttcaccagatcccaagggacaaaggcggcatttttatgttttacaacattcatgacgagctgctgtttgtcggtaaagccagaaagttaagacagagaattaagaagcatttcgaagacactgtttcaccgatcaaacatcacagagatgaagtttataaaattgaggtatgtgtagttgatgatccaatggaaagagagatttacgaaacatatatcatcaatacacagcactcgaagtacaatatagacaaggtattttttaaataagacgtcagtctgcggattgaacagcgaagccagagcttaagtcaagttctggcttttgatttgggcattttttcgcatatagaccctttgtctgtcatccgaataaattattgagaaatttcagaaaataatattgacaatcctacccgcggactttaatataacaatatataatgttatataacgttatataataaaaacgaggagtgaaggatttgagtcaggccacagcaaaagtaaatcgtgaggttcaagctttcttgcaggatttgaaagggaaaaccattgatcatgtattctttgtcgcatgcggagggtcttctgccattatgtatccgagtaagtatgtgtttgacagagagtcaaaatcaataaactccgatctctacagcgccaacgaatttattcagcgcaaccctgttcagcttggtgaaaagtctcttgttattttgtgctcgcattcgggaaataccccggagacagtcaaagctgctgcgtttgcaaggggcaagggcgcacttacgattgcgatgacgtttaaaccggagtctcctttagcgcaggaagcgcaatatgttgcccagtacgattggggtgatgaggcgcttgcgatcaatacaaactatggcgttttgtatcaaatcgtttttggaaccctgcaagtattagaaaacaatacgaaatttgagcaagcaattgaaggcttagatcaattgcaggctgtatatgaaaaagcccttaagcaggaagctgacaacgccaagcaatttgcaaaagcccatgaaaaagaaagcattatttataccatggcaagcggtgcaaactacggtgtcgcttactcctacagcatctgcattctcatggaaatgcaatggattcattcccacgccattcatgccggagaatattttcacggaccgtttgaaattattgatgaatccgtgccgtttatcatcctgctcggtttagatgaaacaagacctcttgaagagcgggcgcttaccttctcgaaaaagtatggcaaaaagctcactgtgcttgatgctgcatcttacgacttcactgcaattgacgattcagttaaaggctatcttgctccgctcgttctcaatcgtgtgctgagaagctatgcagacgagctggcagaggagagaaatcatcctttatctcatagaagatacatgtggaaagttgagtattgatctgaaaatgaagaaccattatgcattagactataatgttatataacattatagtctaatgtccagaggaggccaaccctttgaagaaaatgttgttgttcttgatcattgcagctgtcagtatgctcaccatcgcaggctgttcgagccaaagcagttcagcggacggaaaggtgacattgaaatttttccacagatggccaaaggagccggaaaaaagttattttgaagaggttgttaaggaatttgaaaaagatcacccagatatcgacattcaaattgaagccgttttaaatgactcctataaagataaaattaaggtcatgctgggaaccaccagccctcctgacatttacttctcttggagcgatgagtttgcttttaaatttatcagaggcaataaagcacttgatctctcgtcctactacaaaaatgacaccgattggtcatcacagctcgttcaatcgcaaattacaccatttacttatgaaaacaagcaatatggcgtaccgtggcaaatggacgctaaatcattcttctataataaagacattttccaaaagctgaatcttgatcccccgaagacgtgggatgaattaatcgatgtgtcaaaaaagctgaaagaacatggctacacaccgatcagctttggaacaaaggcgacttggacaatctcgcactatatcggcacgcttaatcagcggatggtcgatgaaaaaacacgggaaaaggactataacgccaaaacgggtgaatttactgatgaaggctacgtaaaagcacttgaaaagcttcaagagctgatgccttactttaataaacatgtaaactccgtcgaccacgaatatgtgagacagcaatttaagagcggaaagtcggcgatgatatatgcggaaacagcggaaatcaagctggttgaaccggttaatctcgggatgttcccatttcctgaaatcagcgggcagaaaggatcttcagaagcgttaacgggagcgccggaaggattcatgatctcctcaagaacaaaacatccgaaggaagcgatggaatttttgcagttcttgacgtcgaaaagaatgggcgaaaagctcgtgaaagatgtcgggaaatacagtgcagtgcaaggtacggctactgaagaaaatgcaacagccattcagcgtgaagccgttcagcatattgttgatgccaaatcaatggttccatggtttgatatggatgtcgatgttgaagtcgcagatgcgtacctaacgggcgtccagcaaatgcttggcggcgacatgacaccgcagcaggtgatgaaagccgttcaaaaggcagcaaagcaggtgagggcgtcagctgaataaatcaaagaaaaggtgaagcttcgcaccttttctttttataaaggagatgagatacccttggtcaatcagaataaaataatcccctatttgtttttggtgcccgctctcgtttttttacttttcgtttatatcccgatttttgagaatgtattcctcagcctgtttcagtggagctcattttctccggaaaaaacgtttatcggcttaaaaaactatgttgaattatttcatgatcctgtcttctatcaggcacttaccaataatgtgctttatgcagtgatctcaattgtatgccaggtatttggcggtttgattttggcggcggtgcttgaggataagctggtcagaaaatggtcgccgttttttcgtaccgttttctttttgccggttgtcatctcaatgacggtgatcgcgcttttgtttgattttatttacaatccggagacagggcttttgaatcagctgcttcaggccatcggtcttgatcagctgacgagggcctggctcggggatgacagcacagctatgctttctgtcatttttgtgtcccagtggcaatctgtcggttatattgcgatgctgtacatcgtgtcgattcaaaaaataccggatgaactgtatgaagcggcccggcttgacggcgcgggtaaaattcagcagttttttcatattactgttccccagacgaaagagatgtcttttgttgcggtggtcatgacgctgaccggagcctttacggtctttaatgagccgtacattttgacaggcggcgggccgggaaaagcgtcagaagtcttgagcacgtttttatataaaagcgcctttacaaaggatatgatgggctacgcctcagcgattgccactgtcgtgttaatcattacgcttgcattatcgctcatgcaaatgaagttctttaaaaccggaaaggaggagtaactgatgctgcctcagaagaagacagattcgttcagattggagccggtgcctgaccagcacattgaggtgaaagataagcctagacgaaaatggtatatcggagaaacgtctgtgtgggtttttctgtttctttatctgattgcgattgcctatccgcttctctggatggtgatgagcgcctttaaaaactctgacgatatttttgagcacagctggtcgctgccgtcttcgtggcatccggaaaattttgtttccgcctggaatcaggggatttcttcttattttatgaacagtgtcatcgttacggcgctgacgtgtgtgatcactgtctttatcagtgcatgggcagcgtatggcctttcccggtttgagtttaaaggaaaaggattctttttggtgctatgtcttggcggattgatgctgacgccgcaggtcagtcttgtgccgctttattctattattcagtcgctgggcctgtacaatacgtattgggcgttaatcttgccgtatgcggcttatcggatcccattcaccatcattttgatccgctcttattttctttctatttcaaaagaattggaggaggcggcctatttggatgggtgtacaagttttggagtatttttcagaattttcttaccaatgagcgtgccgattttggtgacatccggcattttgacggcttaccatacatggaatgagtttatgtttgcgattattttcatagatgatgagaatttacggaccattccagccgggctgatgcagttcagagacgcgctgcagacagactggggcgtcctgctggcggggttaacgatttcagccgcgccgattattattctatttttattgatgcagaaatattttgtccgcgggattgcaagcggcagtgtaaaaggataaaggaggaagcgctatgaaattgattgcggttggagataatgttgtagattactaccaggatcaagaaacattttacccgggaggaaatgccttaaacgttgctgtgcttgccaagcggctcgggcatgagtcttcctatatcggaatcgtcggcaatgacgaagccgcggcgcatctgttgaacgttctcaagctggagcaggtcaatgcagattatatccgccaggcgcacggagaaaacgggatggcgattgtcacccttgatgaacagggggaccgcatttttgtcagatcaaataaaggcggcattcagtcccggcttcgcctcgcgtttcaggagaaagatgtatcttttatcagcgggcatgatctgctgcatacgagcgtgtacagcaggcttgagaacgatcttccgcagctgtgcgggctggtcccggtctcatttgatttttcaaccaatcgggaggatgattatttgaggagggtctgtccttatgtgacgtatgcgtttttttcaggaagcgatttgagtgagtcggaatgcggtgagcttgccaaaacagctcatgggtacggagccaaaatggtttgtatgacccgagggggccaaggagcaatcctgtctgcgggtgatcgagtctatcatcagccgattgtggaagctgatataatagatacacttggagcgggagattcttttatagcaggctttttgactgccttttgcgtgaagcaggatataacgtatgctttgcgccaggctgctgaaacggctgcgaaaacttgcggtgtgtacggagctttcggctatggctatccttatcgcttggaggacgggggaagcagtgaaaaaacgagaatactataagcagtgtctcgttttttatgcctgttatgtgtaggggctgttgatggtaaaagtgacacggtttgtgtgcatcaaaaacaatgagcaatagattggctggtcgtttgatgtaaaagccgttttatcaatttcaaacagcgcatccccgatatcacaatccaggtatttgctttcctcctgttgggcatatacaacgtttaatagcttcgtattgtgcgtgggtacaactttgtattgctgtttcaaaatatcatgcatggagacgccgtcagcaataaaggtatcaatgccgggaaacaaatcaagcggataatgcgtcacttcaaaggtgagaggctgatcatcattatataaaatccgttttaattcaaccacagggctctcgggttggatttgaagcttttcggcgatgggttttgacgctggaatgatgtcatgggacagcacatgatgcttcggttttttgccggttgattccataaattccgagtagccgtttacagcgatcagctctcgttttaatttagggcttttaacgaacgttccctttccctgctgcctgatcagatagccttcttcgactaaatcgagaatggctttcctgacggtgatgcggctgacgttatacttggtgcaaagctcgttttcggtaggcagcttggcagttggggaatacacgccctttttgatgtcatcagtgatgatttgttttagctgaatgtataaaggtgtagaacttccgttgtttaacaaagggtagcctccttttaacctattatttatattataatgtattatgacgttataatacaaatttacattttttattttagaaatatagcaaaaatgggaatcgattactctaaaaataacagaaagaccaagttgtttccagtgacgaaataacgggtcaaaagatagggggacttttctgatggcttcattaacatttgaacacgtcaaaaaatcatatcactcacaattaaccgtgaaggactttgatttagatgtaaaggataaggagcttttggtgctggtggggccgtcaggatgcggaaaatcaacaacgctgcggatggtggctggattagaaagcatttctgaaggaaatcttcttattgatggggagcgggtcaatgatcttccgccgaaagaacgtgatattgcgatggtattccaaaactatgcgctttatccgcatatgacggtttttgataatatggcgtttggattaaagctcagaaagatggcgaaacaggaaattgccgagcgggttcatgcggcagccagaattttagaaattgaacatttgctgaagagaaaaccgaaggcgctctccggcgggcagcggcaaagggtggcgcttggcaggtcgattgtgagggagccgaaggtctttttaatggacgagccgctttctaatctggatgcaaaactaagagtgacgatgcggacagaaatcagcaagctgcaccagcgattagaggcaacgatcatttatgtcacgcatgaccagaccgaagcaatgacaatgggagatcggattgtcgtcatgaatgaaggggaaattcagcaagtggcgaaacctcatgacatttatcattacccggccaatttgtttgtcgcaggcttcattggctctcccggaatgaactttttgaaaggcatcatagaacagcagcatggcgagctgtttttcacaaattcttcgatccggcttcatattcctgaagaaaaagcaaagcggctgaaggaaaagggatatgccggagaacagatgattgccggtgtacggccggagcacatcacacaaatgacaggaaatgaccagttgtttgattcagtgtttcaagcgaacgtggaagtgaatgaaaatctgggctcggagctcatagtgcatgtcatggctggggacgagcggctcaaggtccgcctggacggaaacacgcgaatcgatgcaggcgattcaatccagctctcagtgaaaatggaccacgtcgtctttttcgatgcggaaacggaagaggctgtgtattagaaaaaggtgctcctcaaaaggagcacctttttcttacggccaaatctcatccgcccattcagggtggtcgataaatggattgcggttgtgctgatatttttcataaatgatttcatttcttttccgctcgcggtcgtcaaccggatcctgcttattccattcgagcaggacagattgtttgccatgataaggagctgagccgttgcctgtcttatcattaagctcaagatcaggatagccgtcatcaccctcgtaacggacagccatgtaaaacagcatgcgggcaacatcgcctttcacatcatcgcggggctcccatgaatcgccgtcataataatttccgggtgccttcgcatattcagtgccgccattgtcaaaatccatatttcctctggcgctgttaacttgaacatcagccgggcgcaaatgatgaatatcagtaccaggtcccttgctcgtaccaaaatcgccatgggatttcgcccagacatgctcgcggttccaatcgccgacattgccgccgttcaggtttttggaacgcgattcattcgtatagagcaggatgacgttattcggatttcttgggtcttcatccgtttctttcagcgcgttccacacttcgctgtaggacagcatcgtgtgtccgctgataatacggtgcagggtgctttttagcgagtctcctgttttaccttcagccccttcataataggtatctgtgtcagcatagggtgcagcgggggcggctaatgagagaaggcttcccgttcctgaaggggaagacgccaatcggtcattaaggcttaatgtggtttgcgcgcttgctgaagctgctggcgcaagccatccggaaatcagtaatacacagacgagcggcagaaaccatgctttttttgtcatcacttgccctccttttatcagatcatatctattatctaaaattgaaataaaggatagaagtgtcattttgtatatttttcattaaaattgtaaattagtccctttggaggaggcggaaatctcctgtttccatatctttaggtcctgtttttgcgggctgccggcatttctgttttcatccgttccgcgaacatcgcctctccagcttagcttgttcatatgaaaggcattttgaccctctctttcgctcttgctggctctcttccttaccgtgttttcttttgacctttacatcaaaatagttgtgacatgtagggtgtatctggttgctggatggatactgtggctaaaaaataaacgtttttttggttaatctgtcaatgaactatcatgttgctccttctataatgaagtcaccatagcggccagaggggggagtacatggaaaagcagaagctttcagtaaaaaacagcatcacagattatattgaatggctcgcccaatacggtgcgtctgcggatggcggcgtaacgaggcttttatacacaaaagagtggatggacgcacagcttgctgtgaaaacggaaatgtcttctttcgggcttgaaacaagattcgacgatgtcggcaatgtgtttggaaggctttcgggcacccagtctccggatgaagtcattgtaaccggttcacatatcgatactgtcatcaatggaggaaaatacgacggcgcctatggcgttctggcggcaatgctcgcgttaaagcagctcaaggaaacatacggagcgccaaaaaaaacgctcgaggcggtctccttatgtgaggaggaaggcagccgttttccaatgacctattgggggtcggggaatatgacgggtgttttttcagaacaagatgcaaaagagccaagagacgagtcgggagtctccctccaaacagcgatgcatgagagcggttttggcaaaggtgtgtttcagtcagcatataggacagatatcagcgcgtttgttgagctgcatattgaacaggggaagacgttggaaatgtcaggccgggatctcggcatcgtgacaagtattgcggggcagagacgatatctcgtcacgctcgaaggagaatgcaatcacgcaggaaccacctccatgaaatggcgcaaggacccgctcgcagccagcagccgtatcattcatgagctgctgctgcggtcggatgagctgccggatgagctccgtctgacatgcggaaaaataacggcagagcccaatgtagccaatgtcataccgggccgcgtccagttttcaatcgatattcgccatcagcatcagcatgtgctggaacagtttcatcaagacatggttgctttgatcaacggcatttgcctacaaaaaggaattcgcgctgtgattgatgaatatatgcggatagagcctgtgccgatggacgaaaggctgaaggctgcggcttttgaaacagcattagaaaacggcttcagctgtgaggaaatggtgagcggagcagggcatgacgcgcaaatgatcggaaggcgctatcctgcttgtatgctgtttgtgccgagccgaggcggcgtcagccactcaccgaaggaatatacgtcagccagacagcttgagatcggcgtccgcgcactgactgatttattatacaaactggcttactgataaaggaggaatggctgtgtcaggcagaagagaattatgcaccccgttaagaacgattatgacaccggggcctgttgaggttgatccgcgtgtattaagagtaatgagcaccccggttgtcggccaatttgatccggcgtttacaggtattatgaatgaaacgatggagatgcttcgggagctgttccaaacaaaaaaccgctgggcatacccgattgacggcacttcacgggcgggaattgaagcagtgctggctagtgtgatagagccggaagatgatgtgctcattcccatttacggccgtttcggttatttgctgactgaaatcgccgagcgatatggggcaaatgttcatatgctggagtgcgaatggggaacggtttttgacccggaggacatcatacgggagataaaaaaagtgaagccgaaaattgtggccatggtgcatggagaaacatcgacaggacggattcacccgctgaaagccatcggcgaagcctgccgcaccgaggatgcattgtttatcgtcgatgcagtcgcaacgattgggggctgcgaggttaaagtcgatgaatggaagattgacgctgccatcggcggaacgcaaaaatgtttgtctgtgccttcaggaatggcgccgattacatataatgagcgggtggcggacgtgattgcagctcgcaaaaaggtggaacgcgggattgcgacacaagctgacagggcagcactttcgggaaatcggccaattacaagcaactactttgatttgagccagcttgaggattattggagcgaaagacggctcaatcatcatacagaagcgacgacgatgctgtacgccttacgtgagggagtcagactggtgcttgaagaaggtcttgagacgcgtttcgagcggcatcggcaccatgaagccgcattagcagcagggataaaggcaatggggctaagattgtttggagatgacagctgcaaaatgcctgttgtcacctgtgtcgaaattcccggcggcattgacggcgagtctgtccgtgacatgctgctggcacaattcggcattgaaatcgccagctcattcggcccgcttgcagggaagatctggaggatcggcacgatggggtacagctgcagaaaagaaaacgtgctattcgtgcttgccgggttagaggctgtgcttctcagacataacgcaggaatcgaagcaggaaaagcgctccaagcagcgctggatgtgtatgaaaacgctggccgccaggcagcggtgtaaagaaaagcttgcggaactccgcaagctttttaacgatatgatttcgtgttttctccaatctgattttcttcgtttgactctttttacaaatcctctttctatgtgtttcattttctgacaaatcatgagtcattttttcttccatcgtctattctttatacaagttacctataaaatcacgctgaactagttgtttctcacggcaattttcgagaggaggatgcggcattggggaattttcacacgatgttagatgcgctcctggaagaccaggaggaggctgtactggcgacaattgttcaagttgaaggctccgcgtatcgaaaagcaggcgcctctatgctctttaagaaaaaaggcagacggattggcttgctgagcggcgggtgtgtggaagaagatgtattccaaagaatcagtgcgctgggcgatcagctcacatcaacgctgattccctacgacatgcggtcggaggacgatctttcttggggcatgggagccgggtgcaatggcattattcatgttcatgcagagcgaatcactcaggaaaaaaggcggcactatgagaaagtgagggactgccttcattcaggcaaagctgtcacttccgttataaagattgaatcctcccattatttatttctgacggagaacggacattttgggaactggccggacgcgcctctgcaagatattcaacgtactgtttcaacgcttcatttaccgcatttcgatcaaaccactaacatgtttattcagcgaattgaaccgaagccgcgtctcattctgtttggggcgggaccggataatgtaccgctggccaatttggcggctgacacagggttttctgttatcgtgacggattggcggcccgcttattgtacatcctctctttttccaaaagcggatcagctgatcaccgcttttccggaacaaatgcttagcgaatttcaattttttccgcatgatgcagctgttgtggcaacccatcattatcagcacgatcaaacgatcatcaacttcttattttctcaaaacctccattatattggactgttgggttcggcaaaccgcacgaaacggctgctgagcggaaaacatcctccgtctcacttttacagtccggtcgggctgaaaatcggtgcggaaggtcccgaggaaattgcggtaagtgtagttgcagaaatcattcaaacaagaaaacgggtggcggttgtatgagaagcccctatctgatcggcgtgtttctcgctgccggcaaaagcagaagaatgggacaaaacaagctggctttgccgctaaaaggagaaaacataggctcactttccttgaaaactgctctgtcgtcccgccttgatcacgtgctggtcgtcgagcggacagaacatgcctcccttgagtggataggagcgccgtatcacgctccgccttttcaaaaacgctggagcctgcacgtttgccaagacgcagaaaagggtcaggggcattcagtcagcagcggggtgagaaaagcagaaagcatgggggcggacggcattgtcattttgttagccgaccagcctcagctttccgtcgatcatctcaatgcccttgtggctctggctcctgagtcatttgccgtgtcatcgtttttaggggcgttcaccccgccaatctacttctcgtcgacatgttttccttatgtaaagggattaaagggagatgaaggggctcgcaggctcctgaaaagcggacagcttggagcaggagcggttttggaggcaaaggatagcggtgagttggacgatattgatacacccgaggaatatgacatggtaaggagggcgatgtcttgaacggccaagtgacaaaagcaaggatgaatattcaattatggagaccggcagcgcttgatgaggcctattcgcttttagagaagcttgctccggatgtgtgtgccgcatcgggaagcacgctccttcagcttcagtgggacaaaggaactctaccgaaacagcaccttgtcagccttgaagggattgacgaaatgcgagggatcagcaccagtgacacccacgtgtcgatcggggggctcacatcactgaatgaatgcagaaagaaccctttgattaagagagcgcttagctgtttcagtgacgctgcttccgctgtcgctgcaccggggattcgcagccgtgccacgattggcggcaacatagcgagtaaaatcggtgatttcattccgcttctgcttgtgcttggtgctgagcttatcgtatatcaaaaggagctaatcaggctgccgcttggcgcttggctcagtgaggaagactttagaacggctatcgtcacgcgtgtcatcatcccgcgggcggagggagagcgtgtattttatcacaagcttggaaggcgccaggcttttaccggagcggctgctgttgcagctggacgttttttgaaagacggcagcattcgcctcgccgctggccatgccgatatcactcctaggagattattggacagcgaagcgaaatggatggcaccagggtgggacccgcatgagctgtacaaaacacttatccatgagctgccgttttcctcagatgtttttatgtcagcggcatacagaaaaaaagccgctgccaacgtcatcatggcagagctgatggctgagggaggggaataaatgatcatcaacaaaccgtcaagagtcaggccggatggaaggggtaaggtcacaggggaattgaaatatatgaccgatctcagctttccaggaatgctgtatggcaaggtgctgagaagtgcttatcctcatgcagagattgtgtcggtttgcaccataaaagctgagaaaatggaaggcgtgcaggccgtcgtcacacataaagacgttcccggcttaaaccgatttggcattgtcatccctgatcagccggttttatgtgaggacagggtgcggtatgtcggggatgcgatcgccgcagttgctgcggaaacggaagaaatcgcggaagcggcgctggagctgattcaagttgagtataaagagctggaagtcatggattcaccagaaaaagcgcttcggccgaatgcgcaaagactgcatgaggacgggaatatcctgcaccgcgcatttttttcaaacggtgatgtggaagaagggtttcaagcatctgacacagtctttgaagaaacctatgagctgccgcggcagatgcatacgtatatggaaacggagggaggtgtagccgttccggaagacgacgggggttttacgatgtatgcaggaacccagcacggctataaagaccgtttccagcttgcccgtatttttgatattcctgaagagaagatcagaattgtgtcaagtccgatgggcggctcgttcggagggaaggatgagctgaatattcagccgtatgctgcgcttttggccctgaaaagcggacgccctgtcaaaattcatcagacacgaaaggaatctgtacgttctggcattaagcgccatccgatgaagattacgataaaaacgggtgcagatcattcgggaaatctattggcgcacgacgtgaaaattgtggcggacacaggcgcttacgctacgctcggaccggctgttcttgatttttctgtcgagcatgccgcggggccgtaccgtattccgaatatccggactgaaggaatatcagtatttacgaacaacggggtggcgggggaatttcggggctttggcggcaaccaaatcacatttgcactcgaaacccatctcgatcgtctcagcggcatgcttggcatcgacccgctcgagctgagaagaaaaaatatcagaaaaccgcatgacttggggccgcttgagcatcgaattgcaccaactgacggagcggcacaggtgttgaatgccatatctaaatctcccattcttaaaaaaacaagccggaactgcgggtatctgcaaagaggcacgggagcggcaattacaatgcacggcggcgggctggggtttggccgaatggatgcggcaggaggccgtttgtctctttcgagtgaaggcaaaatcactgcttcgtttggatttgaagaatgcggacaggggattctagcagcgattgaacagattgtcatggaggagctgggttgtgccgcagaggatatttccattgttattggggataccgcaaaagtgccgaagtcaggctcctccacagcatcccgcggcacaagcatggtgtggcacgcgatccagcgtttgaagaagccgtttctatctcagttgaaaaaacgggcggcagaatggagcggctgttcagcggaaaaccttattcccggcgctgcaggcttgcgtgacaaaaacacaaaggcgctcgtagttacgtataaggagctggctgaaaaaggccctttggcagaggaaacggcctttgactttccaacaacgcctgaccctgtggtgggcggccatttcctctactcatttggagcggctgccgttgaggtggaggtagatctgttaacaggcgaagtcaaattgatagattgtgagcacgctattgcggcaggtccggttgtcagtccgcagggatatcgaggtcaaattgaaggcggcgctgccatggcactcggctatacgctgatggaggaagcgaaaatgacggacggccgttatgccgcagaaaatctagatcactatttgatccctggagtcaaagacgttcctgacatgaaggtgatcgcaatagaagaactaatgaagggtgatgcatatggaccgcgcggtgttggcgaaattggaacaatcgccatcactccggcgattgtaaaggcagtacatgatgcggtcggatgctggataaacaagctgccaatttcaagagaagagctgcttgaagcgatcgacagaaaggggctgaagcaatggacgtaaaagaggccgggccatttcctgtaaaaaaggaacagttccggatgaccgtgaatgggcaggagtgggaggttgctgccgttcctacgacacatctgagtgacttgcttagaaaggaatttcagctgaccgggacaaaggtgtcctgtggaatcggccgctgcggagcctgctctattttaatcgacggaaaactggccaatgcgtgtatgaccatggcttatcaagtggacggccactccattacaacaatcgagggcgtacaaaaagaggaactggatatctgccaaaccgcttttctggaagaaggaggcttccaatgcggctactgtaccccaggaatgataattgcgcttaaagcactgtttcgggaaacccctcaaccttctgacaaagatatagaagaagggctggcggggaacttgtgccggtgtaccgggtatggcgggattatgcggtcagcttgcaggattagaagagagttgaacgggggtagtctggagtccggcttttaagagccggacttttttagcctcagtcagacagcgcgatcaagtcgcagaagcgttgtgggaaaacacacgataaatctcgtagaacttgacagcttctggattagaaaatgattagtgaatccatagcaaagacgccataaaaacttcttatggcgtctgtcggacagggaggtgttggatacggcggaggcaaggaaagttaaacttaataattaaagatagctgctccaacaatgatcaacaaaatgaatagcaccacgatcaaagcgaaggagctcccgaaaccgtttgagtaaccagagtttccactgtatccaccagaattgtagaatcccataatgtcacctccttagtggagatagtataagatatgccaacgatcattttcgacatagatttaagtctaaaaaagaaaaaatgaatattttgtctaaaggtgtaagagagaacgcgttatcaaaactattaaaaacgcagcaattgtcttcagagtattttttcgagaaaaaacgcggtctgtttataggattggagaagggagctcggctgctaagagctgacttattagtttgaaacctcgatttataaatgaaaggactacaggatatttttctcgtaggcaattatcctgaaaaatataggtgaatgtttattctagctgttgtttcactaagtgtggggatcacttcaagtactgtcctaggatcaaaagtttattgaagtgcaaatagaagcccgccggtgaggcgggcttccttcttaactccccctatacacctgataaccaaacggcgacagcaagagcgggatatgataatgtgcatctggatctgctagctgaaaacggacggtgactatggttaaaaacggctggtcgaccgtattcacgtttttattcgcaaaatagtctcctgcatgaaattccatcacatactctccggaaaccagctcttcaccagccagcagagggacattggctctgccgtcattgttagtgtaaacctctttcataatactttcgcccagccgcttcaattcaatttttacgttcgccgctggtttgccgctggttaaatctaaaatatgggttgtcagttttcccatcaggctttcaggctccgacatttttcagcggctttctgtttttctttctcggcgtcttctcttgtcacggtaaaatgttggaaaccgtatggcgggcgcggttcggtgtagacttttccttttgagcccgggatttcttcgacaaccgtatcccacgtgtgattttgagattggaagctgacatcagtgagctgcgggaacctcgctaatattctgcagccgatatgatagattaagttttggattgaaggggtttcgagctcgtgaaaaacggtgctcgccaagtcgcggacttgttcagccgcgacgtagcgggctggatcaaaagcgtatgcgtcattggtattttcatattgccagctgatgtttaaatagacaaacagcgggcggttgccgtcttcggggagagtcgtatattcgtcccggatgaagccgacgaaggagttgccgctcaccttgacgagctgaagatccatgatttcgctgtattgctctgtaatcgttatggtattcccgcttcgttctgctttcagcacagagcggcttcgttcattacgcgatcttctgaagacgaggcggcttgtgctgagctctttctcctcgtatgcaggcattgcttcaaacggaatgtcttcgccagtcagagtgatcgtgtccatatgagaataggtatctaaaaatcggtgagctacatagtgtaggaacccctcggttgtcgttccttcataggatgcgagatggcgctggataaagtttttcattgaatccgttgccacgacgagagtgttgtctccgtctgtaaatgatggcaggaaggcttctccgccaatttcgcatgtcacatcaacgccgacaacggtattatctcttccggcaaaagatgattccgggatttgcttcactccagtgagcggttttaaatacgttcggtatgcaaatacatttcctttgccataagacatggttcttttcatttgcgtctctcctttttcagtgatgatgtcagccagacgaaagcgggcgattcggtaaatttctataagggcctgctggaactccgtttctcgttcgctctcaagccttgccagcagggcttggtgaatgtcctgtttcgtctttcccttcaccgctaaaataaaaggaaagccgaagcgatcataatagtgttcattcagcatgagaaactcctcgtattcctgctgttctaatttgccgagccctgcgttctgctgctctcgtaccgagtcatcgctcattgttttctttgttccgagccggggatgctttttgattaaatcaagctgtgtctcgcgatccgcagcttttacaatgccagtcattttgcggtgaagatcagaaagggacgaaaacggccgtagtgctgcggatctctccgcaatccatgaagagtgttcaaaaatagagccaagtgtgtctgtcagtgtttgtgtgtccatttggttcaggtcatccattgtgaacattggcatcttcctttacgtttttatgtctgcgctattcggctgtttggtttgaaaaaaagcgtgcagtgcaatggccgtcaaactgccgatcacaattccgcttcctgccaagacagaggccgcgcccgaaagagatgaaaacaacgcgggaactgttgtagcgccaagccccaagctgacggaagaggcgataatcagcaggttgccttgcgaatcaaggtcaacgctggatagcattttgatcccgtaagaaataaccatgccgaacatgacgatcattgcgccgccgagaactggggtggggatcactgttgtcagggccgctgcttttggaaccagcccgatcgcgaccagtatgattcctgtgatggcgatgacgttgacacttttcatctttgagagctgaacgatgccgacattctgcgagaaagctgtatagggaaacgcgttaaataagccgcccagcaaaatcgcaaggccttctgcccggtagcccttttccagatccttctccgacagcctgcggtttgtgatatcagcgagggcaaaataaacgcctgtcgattcaacgaggctgacaatcgcaacgagaagcatcgtgacaacagccggcagctcaaaggttggcggtccgaaataaaacagagacggaacatgaagccaagacgcttccaagacctcagaaaaatcgacctttcccatcaaatatgcagccgttgttcctgcgataagactgagtaaaatcgctatggagcggataaagcctttaaagaaataaaatagcaataagataaaagctgtgacgccaaacccgaggagcacgttgtcgagtgagccgaattctttgcttccttcacctccggccaggttattcattgccgttggaatcaggctgatgccgatgatcatgacgactgatccggttacgacaggcggaaaaaaacggacaagcttcccgaagaagcccgcggctaagacgacaatcagtcctgcggcgataatggcaccatatatcgctgggacaccgtaagtgcttccgatggaaatcatcgggccgactgcggtaaacgtgcatccgagcacaacgggaaggccgatgccgaaatatcggtttctccagagctgcaaaagagttgccgccccgcacataaacaaatcaatcgcgattaaatacgtcagctgccccgcattcagcccgatcgctgctccgacgatcaacggaacgagaatggctcccgcatacatggcaagcatgtgctgaagccccagcatcattagctgtaaggcattgtgctgttccttcatcttttttacacctctttttctaatgcgagtgtatgttctaataccggaagttctgtttgctgtgctgttaattcttttttgtcgcgcaagctgaaaaatagattcaaaaagatggcggttaggcttccggtgatggtgccgtcactgaccagaatccggatcggagcggggaattcagcaaaaatcccgggggccgtgctggcgccgatgccgagtgcgattgagcatgcgatggtcaggaggtggtattgatttttgagatccgctgtgctgagcattttgacgccggaggcaatcaccatgccgaacatgacgacggtcgcgccgccaagtacagcagcaggaacggcagatgcaagggcggcaatcttcggaatcagtccgagacagacaaggatacagcctgcggtaacgacgatgtttcttgttttcactttggtcagctgcaataagccggcgttttgcgcaaaggtattataaggaaaggcattgaacagcccgccgatgagaatggcgattccttccgctcgatagcctttgacgagatctttgtcagttaaaggtctgccgcatatctttccgattgcgtaaaaaacgccggttgattccacaataatgacgattccgacgatcagcatcgttaagatcggaccgatttcaaacgcaggggctccgaagtaaaaaggcttcgggatttggaagaacggtgcttctgtaacagaagaaaagctgactttgcccatgatcgctgctgccgctgttccggcggcgatgccgatcagaacggatagtgttcgggcaaatcctttgagaaagcggttgaggactaagatcagaacaaggacaccgacagagagaagaaggttttcgagcgaaccgtattcggggttggcgctgccgtttattttttcgccgccagccatatttttcacacctgttggaacaagtgaaaggccgatcaaggtcacaacggtacctgttacgacaggaggaaataacacagtcagcttgccgaaaaaacgcgcaaacaaaaagatgaacacaccggccgcaatgatggaaccataaatcgcgtgaatgccgtaattgctgccgattgcaatcattggggtgacggccacaaatgaactgccaagcatgacgggaagcccgatgccgatgtatgttccgcgcaaggtttgcaaaagcgtagcgacgccgcatgttaacaggtcaatcgccaataggtaggacagctgttcagttgttacattcagcgccctgccgacaagcaggggcaccaaaatcgcacctgcatacatggcgagcacatgctgcaggctaagtgtaaacaccttaaacgatctttttttcactatagtccctccctgtatgtgaactttagtaacataatatcgttccggtcgaggggtgtcattggatacagtagctgaaaaagacaggtgtgattgctgaaagtgacgaaaaacgattcgttttgtaagaaaatgtaacaaactttagctgatcagccgctgcatacgtaatgcaagccgcaaacgcatcgttgtttcaggatcttttaagcttttccccagaagctcttcgcatttttcaaggcggtatatgaccgtattgcgatgaacgtacagacgctttgccgtctctgaaatttggcagtgtgtctctaaatagacggaaagcgtatgaagcaggctttgatcctcctgctgtttttcagcgaggctctgaagcgtggagttgtaaaatttcttcaaatcctcaactgggagcaagcgcagaagctcaggcacatctttggcgtgatacacctggataaatgcggtgcttcttgacaaatgccccgattgcagagcatcagaagcttctgtgaaagcgtcgggaacatcaatgagcttttggcagatattgctgatgccaaaggacacggttcgtttaaattgagcgctgacctgtgtttgaaactgttctaaaaagctgatcaccgaggcgtgcatttcactccagctgtctgtcgcctcgattagaataatgccgacatttcctttcataaagaagtgaggtggaaacgggaaggctgataattcaccttcaagaaattcgaatacgctgtcggaagcgagctgattttctgtaaagctgattgattcgtcattgcgatcgagtttgccggcgatgcacatgtatttttgatcccagcgcagcttgaattctttcgcccggtttttgatttcgtcatctgaagaaaaggtccgctcaataaaattgttgaaaaactcattgcgggcccgccggctgaactgcttcagcgcattttccttcagcagttcaaaggaaatgacgttggccgcttgttcaatcgtgaggatcaatcctttgtcgcctgcctgcaccatgtcgggtatcagcaggtagccgcagtttttttcgtgattataaataggcaggacagaatatgttttctgatctgagattgtagagaaacaagtgaaaaatggcccggatacggtattcagggtgcctttcagcttttcggtctcaactgaaatctgatgagacgcagacagcattttggcatgctggtcaagcagcagcacgggaagctgaaggatgtctgacacctttttgaggagggattgcagccccttgccgctcataatgtggtttgtgaattttttgtgcgcgtaaatggcttgctgcagctcgttagaacgcatatcgagaatatggctgagtgtggcattcacaatatcgccgagtcggatgtgttccggaagctcaatgatcggaaacgcatatgaatcggccagttcgatgatttccttcgggatatcttccagatagcgctttgttttaatgccgaggcccgcgcagccgcgttttgccatttgccgaatcagttcagataattgatgcgggtgatccttcaggtgataggcggtggtgacgagcaattcattcttatgcaaaaagtctacgatatccggagcgtccatcatattgacatgctgaacctctctttcccctcctgcttttccagcgattaaattggcgttttcaaaagccggtattttcatcacatcaagaatattcatagcgcattctccttttctataaaaacattggttaaggtgaataattttcaataggaattctagcggttttgctgatgtaatacgatcatagtagcagtaaactgttgaaaatagaactggttgtgttacataaactgacatggaaaatcgtcatcctgacatggggggatcaatatggcttacgatatggtgataaaaggtgcgaaggcagttacgccagatggcgttatagaagctgatattgtagttcaaaacggtgtcattgccgagataggttctgacattgaagcaagcgggacggaaatcatccaggcagacgggaaatacgtgtttcctggtgtgatagattgccatgttcattttaatgaaccgggcagggaggattgggaggggtttgaaacaggttctcaaatgatggccgcaggcggttgcactacctattttgatatgccgctcaactgtattccatcaaccgtgacggcagagcatcttctcgcaaaagctgagctaggcaggcaaaaatctgccgtggattttgcgctatggggcggccttgtgccaggccatatcgaggacatccgtccgatggctgaagcgggagcgatcgggtttaaagcgtttttatcaaagtcaggcactgatgagttccgctctgttgatgaacggacattgctcaaaggcatggcagaaatcgcggctgcaggaaaaatcctcgctctccacgcggaaagcgacgcgatcacaagctacttgcagatggttttggccaataaaggaaaggtggatgcggatgcgtacgccgcctcccgcccggaggaagcagaagttgaagcggtgtatcgcacgattcagtatgcgaaggtgacaggctgtccggttcattttgtccatatcagcacggcgaaagcggtccggctgatcagagaggcgaaacaggaaggtcttgatgtttcggttgaaacatgtccgcattatgtcttgttcagccatgacgatttacggcaaaggggctctgtcgcaaaatgcgcgcctccgctccggtcacggcaatcaaaagagacgctgatcgagacgctcattgccggggacattgacatggtttcctcagaccattccccttgccgtccatccttgaagcgggaggataacatgtttttatcatggggcggaatcagcggcgggcagttcactttattaggaatgctggaactggcgcttgagcatcagattccatttgaaaccatcgcagaatggacagcggcggcccctgcaaaacgattcggccttcagaaaaaagggcggcttgaggcggggtgtgatgcagatttcgtgctcgtcagcatggagccgtacactgttacaagagaatcgatgtttgcaaagcataaaaaaagcatttacgaaggacatacatttccctgcagcatttcggccacttacagcaaaggccggtgcgtgtacaatgatggggaaaaagtcactgaaattgacggagctctggtcgttccttcgtaagcccggcggattttaccgccgggttttttgatttcctccgttctagtttttaaaatctcatcaacgtggtatctttttttaaaggaggcggaggcaatggagcatgtcaaatacatacttaagcaatcctggtcgcgccattcgagctctaaatggacggaagaatgcccgtcatgcggccaatgcggcgtgacggcattggtgattcaagaccatttcggcggcacgattttcaaaacaagagtcgatgagagctggcatttttataacagcatcaatggtgtggtgtacgattttacgagtgagcagtttcaggcgcctattgaatatcagcacattccttcctcaagagaagaggcgtttttagatacgaatgaggaacaatatcagcatttgcgtgaggcattttcccgccatatgaacagcatttccgaggaaacctgaaaacacgtgtgataaactggaagagaggtgaatgagtgtgatttatatcggactgacgggatggggggatcatgacagcatctatccgccgaaaacggccagccagaaaaaattgcaggcctattcctcccattttccgatcgtggaattagacgcgagcttttacgcgattcagccggcgcgcaataatgaaaagtgggtgaaggaaacgcccgaaaccttccaatttatcgtgaaagcatatcagggcatgacagggcatcagcgcggcgaaattccctttgactcaaaagaggagatgtttgatgcgtttaaggtgtctttaacgccatatttacatagcaataagctcgccatggtgctgtttcaatttccgccgtggtttgactgcaagaaggagaatgtcgcctatttgagatggtgtaagcaccaaatgggagatattccttgcgcgcttgaattcagaaaccgttcctggttctcgccgccattttatgagcagacgctttcatttatgaaagcggaaggctggattcacagtgtctgtgatgaaccgcaaatcggagaaggcagcgttccgaccgtgttgcgcgcgaccgatgaaaacaaaacgctcgtcaggtttcacggacgcaacaagcagggctggatgaagcctgatggcgggaaaaactggcgggaggtcaggtacttataccgctacaaccaacaggagctggaggattggaaaaagcacctgaatgaattgcagcagcaatgtaaggatgtttttgtcctgttcaacaacaattccggcggtgacgctgcggataatggcaagcagatgcttgaactgcttgatatcgagtacagcggacttgctccgagacagctcgatttattttagaaaagaggttttgattgatgtcgtttgtgattttggtcgtactgggattaatcgcaggtacggtaggaagtctgatcgggcttggcggcggaattgtcattgtgccatctctgatgtttttaagcacagtgacgcagctgtttcaggatgtgacgccgcaggttgcgattggaacttcgcttttggtcattatttttacgggcctttcttcaactttggcttatattaaatataaaacagttgattataagagcggactcattttctttatcggttcgggtcccggcagcatgatcggggcttacgtgtcaaagctgttcaattcaaactcgttttccgtttggtttggcatttttatgattctgatttcattatccttaatgctgaaagcgaaagcccggccaatcaacaaagcgcacaaaggaattatccggacatttcaggatgatgccggtgagccttatacgtactcatatcaggcctctgtcggtattgccattgcctttgttgtcggttttttaggcggacttttcggtataggcggcggatcactgatggttccggcgatgatgctgttatttctgtttccgccgaaggttgcggtggcaacgtccatgtttattattttcctgtcttctatgacagggtctgtttcacatatgatttccgggcacgtcaattggctgtacgccctcgcgcttgtgcccggcgcttggttcggcggaaagcttggcgccgccatcaacagaaaaatgcagacgaaaacgatcgttatgatcatgcggatcgtattgattttgatcggctgccagctcatttatgaaggcattttcagctgaacgattagggagagatattatgaaggagaagctccgcttatatcatacaaatgatttgcacagccattttgaaaactggccgaaaattgtagattatatcgagcagaaaagaaaagagcatcagtcagacggcgaagagacgctcgtttttgatattggcgatcatcttgatcgttttcaattcgtgacagaggcgacattcggaaaagcgaatgtcgatctcttaaaccgccttcacattgatggagcggcgatcggcaataacgaagggattacgcttccgcatgaagagcttgctgccttatatgatcatgctgaatttcctgtcatcgtctctaacctgtttgataaaaatggaaaccgtccgtcctgggcggtgccttaccatatcaaatcattgaaaaacggtatgtccattgctttcttaggtgtaactgtgccgtattatcctgtatatgacaagctgggatggacagttacggatgcccttgaaagcataaaggaaaccattctggaagtgaaagggcaggctgatattatcgttctgctgtcacatttaggcattcttgatgatcaagcagtggctgaagcggtgcctgagattgatgtaatcctcgaatcacatacccatcatttgctcgaagatggacaagtggttaatggggtactgctggccagcgccgagaaatacgggcattatgtcggctgtgtagaaatcatggtggacagcgtacagcgaagcatcaacagcaaaacggcttctgtgcagaacatggcggaatggacaggagaatccgcagaaactaaagcgtttctcaatgaaaaagaacgtgaagccgaggagaaactgtccgatgccgttgcagagcttgcacaagatgctgaggtgaagtggtttgaagaatcagagctgcctttgcttttggcatacgccttaaaggaatggtgcgagacggacatcagtatggtcaattcaggtgtcattctcggtccgctaaaagcaggtcctgtgacaaagctggatctgcaccgcatctgtccgcatccgatcaacccggtggctgtccgcctgacgggagaagaactgaaggaaaccattgtccatgccgcttccgaacaaatggagcagctccggatcaaaggactcggcttccgcggagaagtgatggggaaaatggtgtatgccggcgttgaggtagaaacgaaacggctcgatgacgggatcacccacgtcactcggatcacactgaacggggaagatattgaaaaacataaacaatactccgttgcggtgcttgatatgtttacgctcggcaaactgtttccgttgattcgcgacgctgcagaaaaagaatattttatgccggaatttttgcgggatctgcttgcttggaagcttgcacaataaggcagtcagcccacaacaagctgtgcccttcatcataaagtgatgaatgaagggagtggttgacgtggtaaacctgacaccgatcatgatagaaggacagccttttacagctgtgacagtaaagcttcccaaaacgaattttatggccgtcgccaatgatcacggatacattatgtgcggcgcgcttgatgtggcgctgctgaatgaaaaattaaaggagcgcggcatcgtggcgggacgcgcagttggtgtccgcaccattgaccagctgttagacgcacctttagaatccgtcacgtacgctgcggaagatcttggcatcaaagtcggcatgagcggcagagaagcgcttttaaaaatgatgaaataaaataaattggccccggctattactatgtcccctcttacaagcatacattgtgatatgtaaggggggattttcttgccaagatatcgcggcccttttcgcaagagaggacctttgcctttccgttacgtgatgctcctgtccgttgtcttttttatcctgtcaacaacggtcagcctttggatgatcaatggctcgataaaacctgttttaatggacatcggcgagatggaaacgaagcgtatagcgacagaggtgatccaggattcgattgaggactatatgtctgacagtgaaaatatgaaagatatgtttcaaatgaattctgatgaaaacggaaacttaacgacaatcgattttaatacacaggttgtaaacagtgtgaaaacaaaagtgacaaagcagcttcaggctcatttgaaagagatggaaacccataccggacacagcggcgccagtgaaaacattatgatcaacattccgctgggacaggtaaccggcaacagccttcttggaaacctcgggccgaaaatcccggtccggttcaatttaatcggtgacgcttttacagatgtcaaaaccaaaatcaagccgtatggcataaataacgcacttattgatatcagcatctttgtcgaaattaaagtgaaggtcatcattccatttgccagcaaaaccgctgtcgtcacaaataatgttcctgtatcgattaaagcagtgcagggcgaagtgccgcagttttataatggaagcggcggctcgggtgtcacgccttctgtccagcttccgagcagcaaagaaaacggtgccgattcaaaaaaagaaaaaagcagcaaataagccgcctgttgaagaggcggctttttgttacttctttttttggtattcatatcgctcccacgccctcaaatgcgggtatggatcaaatgaccattcggttcttccgttatctttgtacatgccatagtgcagatgcggcgggaacttcccggcggttcccggcgggccgtatccggagctgccgactgatccgatcacttggccaggctcaacgatttgtcctgttttaatccctttggcaaacccattgagatgggcaaaataatgatacgtattgttaatgtccctgatgccgattctccatcctccgaagcggttccagcccttcatttcaactacgccgtaacatgtggatttgacaggaaggccgtaatgggcaaagatatccgtaccttcatgaatccgccttccaccgaagccgcgggcatctccccacgtgcttcggtagctgtaatcggttctgatcggaagcgggaatgcatgctcgcccagatcaatatggccgtaggctttaaacagcttcatgaattcagatataatccccactgtctgatcacgccggtaataattccaaagcccgatccggatgttgtcttcatctgtgccatacgacagtaagtattggctgaacgtatacaagatatcttcatcgttgctgacctcggctttcccgtctccatcgccatccattccgattccgtcaaacactttaatgcttaacggcgcatcgtctttcggattcgggttttcaggcccgctccagatatcatcgggtatatagatgctgatgattcccgccttttcaggcagatctttccggttgctccgcacgttttcttcgtattgatcaacagcggcgagcgcataccaagggatctgcgtcacagcttcgattttatgatataattccatccgtttcgacagcactggatctgaaagtttttttccagacgcagaaggctcaaatgcaaacaaaaggagaagaagagcggataacaaaactttcacaaaataatctcctttcatattgaatacacatagtttgcggcaacccggcttaaaaatgtcagtaatcatcttcccttgtcgagaaatttttcctatgttaaagtgtctaaagaaaagactttctttagttagaaaaacattatttttgttgcagaactaaaacctgcacctttctcgttttcagaatgtttcgtgtcagaaattgagtatattggatattggagatgatgggaattggcaaagaaagacgaacacctcagaaagcccgaatggcttaaaattaaattaaatacaaatgaaaactatacagggctcaaaaaactcatgcgggaaaacaacctgcataccgtatgcgaagaagcaaagtgtccgaatattcatgaatgctgggcggtcagacgtacagcgacatttatgattttaggttctgtttgtacaagagcatgccgtttctgtgctgtcaaaacaggccttccaactgagcttgatctgcaagagccggaacgcgtagcggattcagtcgcgcttatgaatttgaaacacgcggtcattacggctgttgcgcgtgacgatcagaaagatggcggggcaggcattttcgcggaaactgtccgtgcgatccgcagaaaaagcccgttcacaacaattgaggtgctgccgtctgatatgggcggaaactacgataacctaaaaaccttgatggatacacgcccagacatcctgaatcacaatatcgaaacggttcgccgcctgacgccaagagtccgcgcgcgtgcgacgtacgaccgttcattggaatttttgcgccgtgcgaaggaaatgcagcctgacattccgacaaaatcaagtatcatgatcggactcggcgaaacaaaagaagagattattgaagtaatggacgacctcttggcgaacaacgtggatattatggcaatcggccaatatctgcagccgacgaagaaacacttgaaagtccaaaaatactaccatcctgatgaatttgcagaattaaaagaaatcgcgatgcaaaaaggcttcagccattgtgaagccggtccgcttgtccgttcctcttaccatgcggatgaacaagtaaacgaagcatctaaaaagcgtcaagcacaagcataatgccaaaacgccagatcatctggcgtttttgtcattcctatcgattttcatgtcctgacgcgtttctccattggcattttcattctctgagacagggcttccttgcggggaggttttcatttcttgaatcgtccccgacatgatctctctaatatcccttgaaccagagccgagattgctgtaattttcgacggattgcatatggtttggattatcggaaatatacacgtgatagtatcgcggtatcacagaagccgctgtttttttcacctgatcggcggtcagctcccggtttttagaatcggttttgtatacgacaagcgcttctcggtcagtcaccaatgtcgcagcatcttgaatatgggggagctgaaccgttaaacttgatatcatgtgagcggtttcttcccggttcatcaccggcgttttctgctgttctccgtcaaattgttctttttgatagcggacatagccaaattgttcgttctcattatgcctgttaaaagcctcgttgcggtccgacacatgaatgggtttggtttgattctgcgtctgattccggacattttgggcattatccaatcctgcgcctccgcacccggataatagtccggtcagcaggcagaggctgacagcggttcgtttcatttatcaatccctcctcatgtgtagggtagccaaatcgcatgatttattctttagcaattgatggggacggggcaatgaattatgataggaatgagtgaaaaaagaggtgagatcatgattcttattcaaaatgccgaatttgaattggtgcacaatttcaaagacggcttcaacgaagaggcttttaaagcccgctactccgatatattaaataaatacgattatattgtgggagactggggatacggtcagttaaggctcaagggcttctttgacgaccagaatcaaaaggcaaccttcgaaacgaaaatcagcacattagatgaatatatttacgaatactgcaatttcggctgtgcgtattttgtcttgaaacggatcagaaaataaatatacacaaaggggatgctgtcatgtattttgttgacagaagcaaaatcgaaaaaacactagggttcttcgagcaccagctggcgctatttgactcacaaacagactggcagtctgaaatcggggaattggcacttcagcgtataggccatctgttaatcgaatgcattttggatacaggcaatgacatgattgacggctttattatgcgggacccgggcagctatgacgacattatggatatacttgttgatgagaaagttgtcacggaaaaagagggtgatgagctcaaaaaattgatcgcctaccgcaaaacgttggttcaacagtatctgctcgctgacagcggcgagctttacaggctgatcaaggcgcatcaaacagctcttcaggacttcccgaaacggatcagaagctatttggaaacagagctaggacctgtttccgcgtttaaataacaactggaaagccacaggagtgttggatatgaaaacatataaagggtatttaattgatttagacggaacgatgtacaatggcacggaaaaaatcgaggaggcgtgtgaatttgtcagaacgctgaaagatcgcggcgttccttatcttttcgtgacaaacaactcttcgcgcacaccgaagcaggtagcggacaagctcgtgtcttttgatattccggcaacagaagagcaggtcttcacgaccagcatggcaactgcccagcacattgcacagcagaaaaaagacgcgtctgtgtatgtgattggggaggaaggaatccgccaggcgattgaagaaaacggcctgacatttggcggagaaaacgcggattttgtcgttgttggcatcgaccgttccattacatacgaaaaatttgctgttggctgcctggcaatcagaaatggcgcccgctttatttccactaacggagatattgcgattccgactgaaagagggctcctgccgggaaacggctcactgacatcggtgttaaccgtatctacaggtgtacagcctgtatttatcggcaagccggaatcaattattatggagcaggcgatgcgcgttctcggcacagatgtgtctgaaacactcatggtcggcgacaactacgccactgatattatggccggcattaacgcgggtatggatacgctgctcgttcacacaggcgtaacgaaaagagaacatatgacagacgatatggaaaaaccgactcacgccattgactctctgactgaatggattccatacatttgaaaaaagggcgccctaaaagggtgcccttattctgtatgccgcgcgcggtgagcaagtctgcttgaagccgcggcggaaatcgctccgacgatgtcatctaaaaaggtatggcattcaccggttgatttatcattcaatcgtttaaggattccgggtttttctttgtcgatgtaaccgtagttcgtaaacccgatcgatccgtaaatgttcacaatggaaaatgccagaacttcatctactccatataggctttcatctatttccagcatcgtttgcagcggttcagacaattttttctgctcagcaagaacatccaattcaatgcccgttaaaatcgcgttttgcacctcgcgttttgcgagaacacgattgacgttcagcgtgcattcatcaatggttaaatccggatgatattttttctgcagaaaaaagacaagctcggcaatgtctgatacctcaacgccgcgctccttcatccgtgctcttgctttagcttccatctgactgaattgttcgttttctgacatcagcttcacccaatcttttttactagtttatacaaaatgcttgagaagtttacgactttttcttgcgccttcttcggattaaaatatgtattcataattccggctgtgtatgactacgatgtgatgagccctaattcaacaggcaggtgatcatggtgaaaggtacaataaaagaaaaatacggcattcacatcaggcagctttccatgtaccagcacacatatcaatgctttcagacgcctaattcatactttctgattgtccccgtttcccaattctcagaaacagagctggcggagctttattacatgagtcagtatttacaagaacaaagtgacccatacgtttcggtttttatctttacaaaagaaggtgaactgacatttgaacatgagggaaaaacgtacgctctgctgaaggcggcccccccttattcaaacagggcgttctccattggagcggagcttgcggaatttcaccgaaaaggccgaggatatccatatgaggtgaaggcggccggaagaatcggccagtggaaggatctgtggggaaaacgaattgatcagctggaagcattttggcagagaaaggttcagacccctccgcatgagccattcgataaaaaaatgatcgaatcatttccatattatttaggactgtcagaaaacgcgatacaatatttagtggacactgagctggatgacaagccccaagccgctgattcaggaacgatatgccatcagcggatggaaaggcatacatggtcaccggaatcattgatcaggattccggcggattgggtgtttgaccacgcttcccgtgatttggctgaatatatgaggcatacgtttttgcatcacagacaagattttaatcagcagggctttctctttttacaggaatacgagcaagtcacaccgctgtcttcattttcgaaacgccttttatacagccgtctgcttttcccgcttcattattttgaaatcgtagaaagctattacatgtcatcagaatcagaaaagcattattttgaagaacagcttgacttcattcttaatgactgtgggcgttatgaacaatttctcaatacagcgcaggaattcatgaatatgcgggcgcagaagctgtttgttccacgcgtcagctggctcggcaaaggcagctcaaggtgaggagaaaatctgacaaaaataattagaaaataaagaatcttgtcatatcaatgcgttaagcgtttacattcgcaaaattcagcctaatgatgtcttgtcaaaacaggagcgggcttatataatgtttgtaacttatatgtctgtgttgagttaacaattgtcttttccaagaggacaatcaaaagaaaggtggagtttttttgaaagcgattcgtgtagggcttttaggtttaggtaccgtcggaagcggtgtcgttaaaattattcaagaccatcaggataagcttatgcatcaggtcggctgtccggttacgataaaaaaagtgcttgtaaaagatttagagaaaaagagagaagtagatttgccgaaggaagtgctcacgacagaagtgtatgatgtcattgatgatccagatgttgatgtcgtcatcgaggtgatcggcggcgttgaacagacaaaacaatatttggtcgacgcgctgagatcgaaaaagcatgttgtcacagcaaacaaggacttaatggctgtgtacggctccgagctgcttgccgaagcgaaggaaaatggatgcgatatctactttgaagccagtgttgccggcgggattccgattctgcgcacgttagaggaaggcctctcatcagatcgaattacaaaaatgatgggaattgtgaacggcacaacaaactttatcttaaccaaaatgatcaaagagaaaagcccatacgaggaagtgctcaaggaagcgcaggatctcggttttgccgaagctgatccgacttctgacgtggaagggcttgacgccgcacggaaaatggcgatattggcgcgcctcggcttctcgatgaacgtggatctggaagacgtcaaagtaaaggggatctcccaaattacagacgaggacatcagcttcagcaaacgcctcggctatacaatgaagctgatcgggattgctcagcgtgacggcagcaaaatcgaggtcagcgtacagccgacactgcttcctgaccatcatccgctttctgctgttcataatgagtttaacgctgtttatgtatacggcgaggctgtcggtgagacgatgttctacgggccgggagccggaagcatgccgacagcgacatccgttgtttctgacctcgtcgctgtcatgaaaaatatgcgcctaggtgtaaccggcaacagctttgtcggaccgcaatatgagaaaaacatgaaatcgccgtctgacatttatgcacagcagtttttaagaattcatgtaaaagatgaggttggttcattctcgaaaattacatctgtgttctcagagcggggcgtgagctttgaaaaaatccttcagctgccaattaaaggccatgatgagttagctgaaatcgtaattgtcacacatcatacatcagaagctgatttcagtgatatcctgcaaaacctaaatgatttggaagtcgttcaagaagtcaaaagcacatatcgtgtagaagggaacggttggagctaatgtggaaaggacttatccatcaatataaagaatttttacctgtaacagatcaaacaccggcgctaactttacatgaaggaaacacacctcttattcacctgccgaagctgtctgagcagctcggaattgagcttcatgtcaaaacggaaggcgtcaatcctacgggatcatttaaagatcgcggaatggttatggctgtggcaaaggcaaaagaagaaggcaatgacacgattatgtgcgcgtcaacaggtaacacttccgctgctgcggcagcatatgcagcccgtgctaacatgaaatgcattgtcatcatcccgaacggaaaaattgcatttggaaaactcgctcaagctgtcatgtacggagccgagattatcgcaattgacggaaactttgacgatgcgcttaaaattgtccgttccatctgtgagaaatcaccgattgcccttgtcaactcagtcaacccttaccgcattgaaggccaaaaaactgctgccttcgaagtgtgcgaacagctgggggaagcgcctgatgttttagcgatcccggtcggaaatgctggaaacatcactgcgtactggaagggcttcaaggaatatcatgagaaaaacggcacaggccttccgaaaatgcgcggctttgaagctgagggtgcggcggcaatcgtgcgcaatgaagtgattgaaaatccggaaacaatagcgacagccattcgtatcggaaacccggcaagctgggacaaagctgtaaaggcagccgaggaatccaatgggaaaattgacgaagtcactgatgatgaaatccttcacgcatatcagctgatcgcccgtgtagaaggcgtgtttgcagaaccaggttcttgcgcgtctatcgcaggagtgctgaaacaggtgaaatccggagaaattccgaaaggcagcaaggtcgtagctgtgttaacaggaaacggactgaaagatccgaacacagcggtcgacatttcagaaatcaagcctgtcacattgccgactgatgaagacagcatccttgaatatgtaaaaggagcggcccgtgtatgaacgaagccgacatgctgttctctgtcactgttcccggaagcacagctaacctaggccccggctttgattcagtcggaatggcgctcagcagatatttgaagctgaccgtctttgaaagcgacaaatggtcttttgaggctgaaacagaaacagtcgccggaattccggcgggtacagataacctgatctaccaagtggctaaacggaccgcagatttgtacggaaaagaaatgcctcctgtccatgtgaaggtgtggagcgacatcccgcttgcacgcggccttggcagcagcgccgcagcgattgtagcggccattgaactggctgatgaattatgcggcttaaagctgtctgaagcggacaagctgcatttagcgagtctagaagaaggacacccggacaatgctggcgcttctctcgtcggcggacttgtgatcggcctgcatgaggatgacgagacccaaatgatccgcgtcccgaatgctgacattgacgtagtcgttgtcattcctttttatgaagtgctgacaagagacgcgagagacgtgcttccgaaggagtttccatatgccgatgccgtaaaagcaagtgctgtcagcaatatcctcattgctgcgatcatgtccaaggattggccgcttgtcgggaaaatcatgaagaaggatatgttccatcagccgtaccgggcgatgcttgtgcctgagctgtcaaaagtagagcacgtcgccgagatgaagggcgcatatggaacggctctcagcggagcaggcccaacgattctcgtcatgaccgaaaaaggaaagggagaagagctaaaagaacagctcgcgcttcatttccctcattgtgaagtagacgctttgaccgttccgaaagagggaagtataatagagcgaaatcctttatatcaagtaaaaagtgtatagatcatgccaagcgttcctcagcgtcagcggagggcgcgttttttttgctggagataaaggagtttttatttagaaaaacgaaatacatgtaaaaaggaggagatgaatatgaaaaagctgataaccgcagacgacatcacagcgattgtctctgtgaccgatcctcaatacgccccagacggtacccgtgccgcatatgtaaaatcacaagtaaatcaagagaaagattcgtatacatcaaatatatggatctatgaaacgaaaacgggaggatctgttccttggacacatggagaaaagcgaagcaccgacccaagatggtctccggacgggcgcacgcttgcctttatttctgatcgagaaggcgatgcggcacagctttatatcatgagcactgaaggcggagaagcaagaaaactgactgatatcccatatggcgtgtcaaagccgctatggtccccggacggtgaatcgattctggtcactgtcagtttgggagagggggaaagcattgatgaccgagaaaaaacagagcaggacagctatgaacctgttgaagtgcaaggcctctcctacaaacgggacggcaaagggctgacgagaggtgcgtatgcccagcttgtgcttgtcagcgtaaagtcgggtgagatgaaagagctgacaagtcacaaagctgatcatggtgatcctgctttttctcctgacggcaaatggcttgttttctcagctaatttaactgaaacagatgatgccagcaagccgcatgatgtttacataatgtcactggagtctggagatcttaagcaggttacacctcatcgcggctcattcggatcaagctcattttcaccagacggaaggtatcttgctttgcttggaaatgaaaaggaatataagaatgctacgctctcaaaggcgtggctctatgatatcgaacaaggccgcctcacatgtcttactgagatgctggacgttcatttagcggatgcgctgattggagattcattgatcggtggtgctgaacagcgcccgatttggacaaaggacagccaagggttttatgtcatcggcacagatcaaggcagtacgggcatctattatatttcgattgaaggccttgtgtatccgattcgtctggaaaaagagtacatcaatagcttttctctttcacctgatgaacagcactttattgccagtgtgacaaagccggacagaccgagtgagctttacagtatcccgcttggacaggaagagaaacagctgactggcgcgaatgacaagtttgtcagggagcatacgatatcaatacctgaagagattcaatatgctacagaagacggcgtgatggtgaacggctggctgatgaggcctgcacaaatggaaggtgagacaacatatccacttattcttaacatacacggcggtccgcatatgatgtacggacatacatattttcatgagtttcaggtgctggcggcgaaaggatacgcggtcgtttatatcaatccgagaggaagccacggctacgggcaggaatttgtgaatgcggtcagaggagattatgggggaaaggattatgacgatgtgatgcaggctgtggatgaggctatcaaacgagatccgcatattgatcctaagcggctcggtgtcacgggcggaagctacggaggttttatgaccaactggatcgtcgggcagacgaaccgctttaaagctgccgttacccagcgctcgatatcaaattggatcagctttcacggcgtcagtgatatcggctatttctttacagactggcagcttgagcatgacatgtttgaggacacagaaaagctctgggaccggtctcctttaaaatacgcagcaaacgtggagacaccgcttttgatactgcatggcgagcgggatgaccgatgcccgatcgagcaggcggagcagctgtttatcgctctgaaaaaaatgggcaaggaaaccaagcttgtccgttttccgaatgcatcgcacaatttatcacgcaccggacacccaagacagcggatcaagcgcctgaattatatcagctcatggtttgatcaacatctctaataaaaaagccaggctgatcaaatatcagcctggctgctttattaaaagacttgttctacttcaacgacacccggcacttcttcaagaagagcgcgctcaattccggctttcaacgtaattgttgaacttgggcagctgccgcatgcgcctagaagacgaagcttaacgataccttcatctacgtctacaagctcacagtcaccgccgtcacgaagtaaaaacggacgaagtttgtccagtacttcctgcacctgttctttcatttcaacttcagtcatgacattcgctcctttcgtcgtcataaaaccattatattcagtgtaacaataaaaatctattgtttggtttgcaaagttgctttccctattatagcacattcagacttcaacacaaaaacggtttttttctataaaaacgcccttaggctctgtatacttaaaagaaaggacttacataggagaagggggcgtctacaagtgatgaaaccagtcatgctaagcgtgtacggggcagaaaacgtttgtgcgagctgtgtaaatatgccgacagccaaggatacatacgagtggcttgaggctgcgctgaaaagaaaatatccaaatcagccttttgagatgcagtacatcgatattcatgagccgcctgacaatgaacatgcgaaagagcttgcggaaaaaatcagaaatgacgagtatttttatccgcttgtgcttgtagaagacaaaattgtcggtgaaggcaatccaaaattaaaagacgtttatgaggaaatggagaagcatgggtatacagaaaaccgctgacttgatcagcggttcttctctatcattaaccgttatggtgtttatacatccacagcaagccggatttcagcatacgcggaacacggccgatcagcggacggtcagcaacaagcccgaagccggctttttttccgagtgaaccgaggacgcctttcagcttaaactgcggcattgattcaggcagggcttctccattccagcgtttttgcaagatttggacaatctgctctgcttgagcctctgccagctgggcgctcggtgcatgaggaagactggcgcaatcgccgacaacgtacagatgttcatcacctggaagattatgatgaggcgttaatacaatacgcccttgtgcgtccttctccacatctaagtctctgacgactttgtttggctggatgccggctgtccacacgatggcgtctgcagaaatcggatcatcgtggttatacacaacgccttcttctacttttgtgatatttgccctgttaataatgcggacaccgtgctcttcgaaccatttttgcacatatttgcttaaacgctcgggaaagcttgataaaatgagattaccgcggtcgaacaaaataatgttcaggtcatcacggctttctctcaattcacttgcaagctcaacgccgcttaagcccgctccgacaatggcgacggtggcattagcgctcagattattcagcttttggtaggtttcgcgggactgatcgatggtttgaatactgtaggtgaattcaggcgctcccggcacgttgtgatatttatcctcacagccgagcccgattatggcgtcatcgtaagaaatcggttcacgatcttggaacagcacttgtttttgtacaatatcaattgatgtgatatcaccgtattggacatccaggcgagggtgctctgggaatgacactctgatatgatggtcagaaattgtgcctgcggcaagggcataatattctgttttcaagcagtgataaggatttctgtcaattaacgtgattgaaacatcatcaggcagctggtttggcaataagcgatgaagaacgcgcatgttcccgtaacctccgccgatcaagaccaattttttcatttgaattcccctttaatccgaagagtatgatagatacattgaagaaaatacgaactatgtaaaataacatctagaattatatcgaatttgatctaaaatcacaataatagtttcaaaataacctacaatttagcctgaaaacacaaattagtaaaacgttatttgagaaataatatgttacgataataaattttgaatcatccgttgtctttgacgaatagtgaaaaattcgcgataatggacatatgtgaggtgaaaccgcatgaatccaatgattgaattttgtgtcagcaatctggctcacggctctcaggaagcccgggcgattttggagaaggatcccaaccttgatgtccttgaatatggctgcttaagctactgcgggacatgtatggaatcgcttttcgctctggtaaacggagaagtcgtcatgggtgaaacgcctgctgagcttgttgagaatatatatacctttattgaagaaaatccaatgttttaaagaaaagggcctggacaggcccttttttattttgccgtacaaaagaactaaaaaaatgtgtagacatcaaaaaatattattgttatcgtataaaagatatttttttaaataaaatttaagaggtgtacgagtattcatgaatgttctgtgggggctgctgggcgcagttgcgatcattgctatcgcgtttttattttcagaaaagaaaagcaatattaagataagaaccgtcatcgttggtttatgcacacaggtggcgtttggatacatcgtgttgaaatgggaagcgggacgcgctgtttttttatggttttcaagccgtgtacagcttctgattgactatgcgaatgaaggcatcagttttatttttggaccgcttctaaaggtcggagacagtccggcatttgcattaagtgtactgcccgttatcattttcttctcagcactgattgcagttttatatcatttgaaaatcatgcagctcgttttccgtgtcattggcggcggattgtcgaagctccttggaacaagcaaaacggaatctctggcggctgctgccaatatttttgtaggacaatcagaatctccgttagtgatcaaacccctgattgccgggctgacgcgctctgagttgtttacgattatgacgagcggtctatcggcagttgcgggatctaccttgtttgggtacgcgcttctcggtattccgattgagtacttgctggcggccagctttatggctgctccagctggactagtctttggtaaattgattatacccgaaacggaaaaaacgcaaaccgtaaaaagcgatttcaaaatggatgaaggcgaaggcgcagccaatgtcattgacgcagctgcaaagggagcgtcaacaggactgcaaattgcgttaaatgttggggcgatgctgcttgcgtttgttgcgttaatcgctgtagtaaacggtattctcggcggggctttcggcttgttcggtttaaaaggcgtaacattagaatccattctcggctatgtgttttctcctatcgcctttttgattggcgtgccttggcatgaagcattgcaggcgggaagctatatcggccagaaattggtgctgaatgagtttgtcgcttattctaacttcggttcgcacatcggcgagttttctaagaaaactgctaccattatcagtttcgcgttatgcggattcgccaatttttcatcaattgcgattatgcttggtacgcttggcggtttagcgcccagccgccgttcagatatcgcacgtctcggcctgaaggctgttcttgcaggaacattagccaatctgctcagcgcagccattgccggcatgtttatataaacgataaaagctccttgcgtcagtgcaaggagcttttatgtatgaaaaacgggggataattgtattgtgtccgcttataatagcttttatactaagaaaaagaaaaaaagttggaggcacctatgaactcatttcgatttaccaaaatgcacggcctgggaaacagttatatttatgtgaatcaatttgaagaacagcttccagaagaaaaactgtcagagattgcaattcaggtttcttctgtttatacagggatcggatccgacggaatgatcctgatatgcccatcagaccaagcgcctgttaaaatgcggatttttaataatgacgggtctgaagggaaaaactgcggcaacggcctgcgctgcgtcgcaaaatacgcatatgagcataagctggttgaggaaacatcttttctgattgaaactctctccgggcttgtgaaagcggaggttcaagtcgaaaacggaaaagtgaatgtggtcactgtcgatatgggcgaaccgcgcttgacaaaatccgagcttcctatgcttgacggcggggaagagcacacaatcaatgaaacgatggcatttggtgaagtagaactaacaggcactgccgtttcaatgggaaatccgcatatcgtttttccgatcgcagacattgaacaggcacccttaacgacactggggccggtgattgagaaagatccgagatttccggaaggcatcaatgtggaattcgttgaaaccgtgaatgaacaagaattgcatttccgcgtctgggaacggggatcagggattactcaggcatgcgggacaggagcatgtgcagcggcagtcgcatctgtattaaacggcgtatcaaagcgaaatcaagacatcacggtgcatttagcaggcggggatttggtgataaactggaaagataacggccatgtaatgatgacagggccggctgaaaccgtttgtgagggtgtctatttcttgtaaaacaccttgtttgagaattggaacgatcatgtttataataaaagacagcaaccggtttttaaaaggaggttcataatgatgagcaacccggtaacaattacagaagcagcagctttgcatataaaagatatgatgaaagagcatgaagaagaaaacgcgtttctgcgtgtaggcgtcaaaggcggcggctgcagcggactttcttacggcatgggctttgagcatgaaaagagtgaatcagacagtgtgtttgatcagcacggcatcactgttctagttgacaaagaaagccttgacatcatgaacggcaccgtgattgattataaacaatccatgctcggcggcggcttcaccatcgacaatccaaacgccatcgcttcatgcggctgcggttcttcgttcagaacagcaacgaatgcaggcaagcctgaagagtgctaagcactaaaaacggatagcaactattactgacgcttttcttagcgataaatcatcgttaagggaggcgtttttattatggggaaatgatgcagagagttccgggaacttcggcaagagaaacgctgctttgttgtttgatttttgttgtaaatacagcaaagttacgatatatttaatgcggagtatattttattgcatttacaacaaaatcacgatagggagttggtgatgaagaagatttttggaatggtaacaaggtcagtatgtgttccgtgtttaaatatataaaagggacacaagacaattgaattttaaataaaggggctgaatccgaacaatgagtgtaaaaatgaaaaaatgcagccgggaagatttacaaacacttcaacaattgagtattgaaacattcaatgacacttttaaagaacagaactcacctgaaaatatgaaagcctatttagaaagcgcatttaacactgagcagctggaaaaagagttatctaatatgtcttcgcaattcttttttatttactttgatcatgaaatcgctggatatgtaaaggtcaatatcgatgatgctcagtctgaagaaatgggtgctgaatcacttgaaatcgagagaatttatataaagaacagctttcaaaaacatgggcttggcaaacatctgctgaataaagcgatagaaattgcgctggaacgtaataaaaagaacatttggctaggtgtgtgggaaaaaaatgaaaatgccattgccttttataagaaaatggggtttgttcagaccggcgcccactcattttatatgggtgatgaagaacaaacggatttaatcatggctaaaacactcatataatatttttcgaagggtggatgatgatgtatattccaaaatattttaaagtcacaaatgctgaagaaatttggaattttgtacaagaaaactcctttggtacggttgtcacaacagaacaaggaaaaccaattgccacacatttgccgttaggattcaataaaaaagacgatcattactatattacggggcatttcgcttatggaaatcctcagtggagaacgtttgaagcctgtgaagatgtgcttgtgatgtttcagggaccgcacgcttatatttcttcttcctggtattcgcgcgaaaatgttccgacgtggaattatcaggctgtccacatgtatggaaaagcaagtatgttagagaaagatgaattagcagaagaattaacaatcatgttggagaaatacgaaaaacatcgtgacaatcctgtgttatgggataagctttctccaaaactcttagaaagtgaattgaaaggtattgttggatttaagattaaggtggaagacattcaagcggcatataaattaagccagaaccgaaatgaaacggattatatgaacgtcattgaacagttgcaaaatgaagaaaatccaaatgcaaaacaaatggcagaactgatggaagataaactcaaaaagcaaatataagcttactttgctgaagaagtagcagaaaacgccaactcaagcggagaaccgctgacttggcgtttttttatgattaatatttatccccattaaaaatggaattcttcacaatcacataatccacattgcggatggcgttaagctttgttccgcctgcataagaaatagaagattgaagatcctgctccatttcaatcagtgtatccttgattgagcctttatgcgccacgtgcatttttttgccttcgacatttttcttttcgcctttttggaattcagaggctgagccgaagtactccttgtaaagctttccgtctttttcgatcgtttggcctggcgattcttcgtgtccggcaaatagtgaaccgatcatgaccatcgttgcgccgaatcggattgattttgcgatgtcgccatgggtgcggatgccgccatccgcgataatcggtttgctggcagccttggcacaccagcgcagcgctgctaattgccagccgcctgtgccgaagcctgttttgattttcgtaatacatacttttcccggtccgatgccgactttagtggcatccgctcccgcattttcaagctctctgaccgcttccggcgttccgacattgccagcaataacaaagctgtccggcaaatgttttttaaggtgctggatcatttcaatgacagcatttgagtgcccgtgagcaatgtcaattgtcacgtattcaggagtcagattttcttctgccagctggcggacaaattcatactcctcatctttgacgcccacgctgatagaagagaataacccgcgtgcgttcatatctttaataaaatcaattcgtgtctcaggctcaaatcggtgcatcacataaaagtagccattttcggctaatgaaatcgctagtttttcatctataatcgtctgcatattggcagggacgacgggcaatttaaatgtatgtccgcctaaacgtacggatgtatcacattctgaacggctattcacaatgcattttgcaggaattagctgaatatcttcgtaatcaaatacgttttccatggttttcactcctaaaaacgaatatttaaaagtataatatatgaaatgttcgccttatataatgtactctgttttatttaggatgtcaaacattatgatttgctggcaggtgtggtgcaagtgccgaagcttgtcatgcagggtgagtttaggtatcatagttttaacgaatggtcttagagagcggatcaaaacgcgaatgatatacgttcagcaaagcttggtcgttcagcaccaggctttctttatggcatggacatgggaaaggagcgaataagatggcccaaaacgaagaaaaaacaccgaagtcccaaaagattcaggaccgcattattatggcaatgatctgggtagtcgcagcccttgtgattgcgctggttgtaggaactgcattgaattatataaatatcttcaaataaaaaaggagctgtgtcgcagacacaagctcctttttttattatttattttcaaaaagacttgttgagtgaagaggctgtacgcgggctttcgggtccatgtaagccttggcgttgttcactgctgtcggtgcctcgccgaagccgctggcaatcaggttgacttttccttcgtatgtacaaatgtcacctgctgcaaagaagccttcgatatttgtttccattgttgatttcacgacaatggaatttttctcgatgtccaggccccagtttttgatcggtccaagagatgaaacgaaaccgtagttgacgattaagtcatcaatttctaaaatctctttgcggtcgcctttcacttcttcaagcactagctgttcgattttgtcttcgccgatcagctccgcagggacgaatggtgtcaggacattaaccttcgacgcatgaaggttttccacactgtgctcgtgcgctcggaacttgtcgcggcggtgaatgatcgatacttcttttgcgattggctcaagcataagcgcccagtcaaccgcggaatctccaccgccaaggatcgcaacgcgtctgccggcgaatttttgcagatcatcaacgaagtaatggaggtttttgccttcatactgctcggcattttcaagttccagctttctcggtttgaatgcgccgtttcctgcagttatgatgaccgttttagagtagtgggtttcttcatttgttacaagcttaaacacgccgtccgcttgtttctcaacagattcaaccgcttgctccagacaaatggtttggtcgaatttcgccatttgctcttttaggttattgataagctcttgcgcgcggattttcgggaatcccgctacatcatatatatacttctcagggtatagggcgctaagctgtccgccgagctgaggcaggctttcgataattttgacgcttgcctgtctcatcccgccgtaaaaagcggtgaataagccgaccggtcccccgcctataattgtaatatcataaacctttgtatcctctcgcatacgaaaattgcctcctaaatgaaaattgttattaattataccatattgccgttcaaattgacgagtcagcagaaaaaatcgtaaggatctaacgtgcccatccgttcttgaaaatatttccgcaggccgctacgataataaccaaatgaaatgatctttttctgaatgtttcttgggccagccggataaacatgataatagtgctacgggtaaggacttcacaaaaaacttttcaatatatttcataaaatcccgccaataagctgaagctaacacaaatgatgattttattatgggtctaacaaaagcaaaaaaagagaaggtggatgtgatggcattgaataagcccaaaatcgtgattttaggtgcaggatatggcggattgatgacggtgacaaggctgacgaagtatgtcgggccgaatgatgctgacattacgcttgtaaataaacacaattatcattatgaaacgacatggatgcatgaagcgagcgcgggtacgctccatcatgaccgctgccgttatcagataaaagatgtaatcaaccagtcacgggtgaattttgtacaggataccgtaaaggcaatcaaaattgatgagaaaaaagttgtgcttgcgaatggagaattgcagtacgattatttagtcatcgggctcggcgccgtgcctgaaacgttcggcattaaaggcttaaaagaatatgcgtttccgattgccaacatcaacacgtcgcgcctgctgcgggaacatattgagctgcagtttgcgacttacaatacggaagcggaaaaacggccggacaggttaacgatcgttgttggcggtgccggatttacgggaattgaatttcttggcgaactggctgctcgcgtgccggagctctgtaaggaatatgacgttgacagaagccttgtccgcatcatttgtgtggaagcagcgccgaccgttttgccgggctttgatccggaacttgttgattacgccgtacattatcttgaggaaaacggagttgagttcaagatcggaacggctgtacaagaatgtacaccagaaggagtcagagtcggcaaaaaagatgaagaaccagagcagatcaaatcgcaaaccgttgtatgggcggcaggtgtccgcggccatccgattgtggaggaagccggttttgagaatatgcgcggccgagtcaaagtcaaccctgatctccgcgccccgggacatgacaatgtctttattctcggcgacagctcgctgtttatgaatgaagatacagagcgcccgtatccgccgactgcgcaaattgcaatgcagcagggcataacggtcgctaaaaaccttggcaggcttattaaaggcggagagcttgaggaattcaagccggacattaagggaacagtggcttctcttggcgagcataacgcggttggggttgtttatggcagaaagctgaaaggcacgcccgcttcgtttatgaaaaaagtcattgataaccgctcactgtttatgattggcggactcggactgacattgaaaaaaggcaagttcaagtttttctaaaaacccgcggaagcgggttttctttattaaaaaacgccaaaataaaaagagaacgagaggaaaacaagtatgtttccgcttacatcaaaagatttgtcacatgatctgactttattgttgacagcttgatatggtatattatcagaaaattaagaaaaagggtgatgattagatgaaaactgcaacgacaaccgcttcacatgcatgcccattttgttcagggaaaggatattttcaattgattctcggcggttcagagacttgtccgtcttgccaggggacaggaaaagacagtcattctttttccagccgttgactttatttcagcccccgcgttacactaaaaacaacgcaggggggtggaataggttgattagtctgccagtcgtaatcatctcaattgttttgttttttgtcttgttttttggaatcggtttcttattaaacatgctgctgagaatgtcttggattatggctgtgatttatccaattgtatgccttttcattatcagcaaagaaaagctgatcagctatgtccagtcgccgggagaatcctttgccagcctgtttcatcgtgtcttatcattagcggctgctgatgtgctgattttagtcagcggtttggccggcgccatcgtgtccggtatagcgatcaacatgcttagaaaaagaggatatcaaatgttttaaatgccgctttcttctaaagaaagctttttttatgcgttcagctcattcaccattttgaataatgctctctccacttgggaacaatgattcggaggagaggtgaatgatgttgaatatgatcagacgtttgctgatgacctgtttatttctgcttgcatttggcacgacatttttatcagtgtcaggaattgaagcgaaggacttgtcaaaatgggtgcaggaacatcaggaaaagcacttgaagcatgcaggactgagattaaaagcattgcagcagaaacaaacacaaaccacgtccgcggctgaggataaaacaaaaccgttagaagaggcatttgattgggatgaatatccagtccaaagagtaacagcaacaggctacacagcaggagctgagtcgacgggcaaaaatcccggtgatccattatacgggcttacatattcaggtgtgaaagtgaaacgggatttatattccacggttgctgctgacccgtccgttttcccgatcggaacaattttattcattccgaactacggtctcggagttgtggccgacacaggatcagctattaagggaaaccgccttgatctgtactttgagacagtcaaagatgtatacaatgaatggggcaaaaaaacccttgatgtatatgtgattaaaaagggaacgggaaagattaccgaggatgagcttgagaagctcaatgaaacaaaatctttgcaagtgttcagaaatcaatataaaacggtgaaagaataaaacgctccagcgaaagcaggagcgttttttttacatgaaaaagtaagcgagtaccaatgtcagtaaaatacctgttaatcctccgaaaaagacttcgatcggctgatgtccgagaagctctttcagcttttttttgcttttctttctctgcagccttagggaagtccttcgcttcatttacgaaacggttaaaatcaataacaagcttattaatgactgttgcctgctcaccggcgtgacgtctgacgccagttgcgtcaaacatggttatgacggcgaaaatggcggaaaccgcaaagagtgaggagtctaatccatgctccaaggctacgcctgtagaaagcgcagtgaccgctgcggagtgagagctaggcatgccgcctgtgcttgtgaccagcgaccagtccagttttctggacacgataaactgtatgggcactttgatgacctgagcaaaaataattgcggccaggcttgataataaaggaaaattcgttaaaagttccatcggcgacatcctttctatttgaaaaatccttcgtgtttcaaaagaaaaaagcaagtcttagactgttgtttgttaaaataagtatagtggaaagaatgtttttcctattataccattgttcattacaaatacccattacgttaggagtgtaagcctcatgttttatgcggttcaacaatcagagcatacagaaacccttgttgtcgggctttttcaaaaaagccagctgacaggaaaagcgttggaaattgatgaaatgctcgaaggccatctgacacagcttttaaaagagggtgatgtctctgcgaaaccgaatcaagtatcaaaagtattccctccatcttctgcgggtatgaaacggatttatttcgttggcctggggagagaagcaaattattcgtttgaacaggcgaaggaacgttttgctcatgtttttcaagccattcataaagatcgaaaacaagaaactgctgttctgcttgatacgtttatttcggaagacgtgcctccagccgatgccgctcatgctttagctgagagctgcctgcttgcttcctatgaggtgcaggattataagcataaatcaaatgagcctgacaaacaaattgaagccgtgtatgttgtaacagatgaagatacacaggaagtgcaggcagggcttcgcgtcggccaggcatacggacaagggacaaattcggctagaacgcttgtgaatatgccgggaaacatgctgacagcgactgacctcgcttcgtatgctgaagagcttgcggcgaaatatgattttgagtgtgagatattggagaaatcagagatggaagagctcggtatgggcggaatacttgcggtaaaccaaggctccaccgaaccgccgaaaatgattgtgttgaaatatcagggcaaaaaggaatgggaagacgtcgtcggactagtcgggaaaggaattacctttgacacaggcggctactccattaaaacgaaatctggaattgttggcatgaaatcagatatgggaggagcagctgcggttctcggggctatggaaacgatcggagagcttcgtcctgaacaaaacgtgctgtgcgttattccatcaaccgataatatgatctccggcggggccatgaagccggatgacgtgatcgtatctttaagcggaaaaacaatagaaatccttaatacggatgctgaaggaaggctagtgcttgcagatggcattacatacgcgaaacagcatggcgcatcagttcttgtcgatgtagctacgcttaccggcggcgtcgttgtggcattaggaacagaaacaaccggtgcaatgacaaatgatcaaagcttttaccagcaggtagctgatgctgcacaagagtgcggcgaggcgatctggcagctgccgataacagagaaggataaaaaacgcgtgaaaagcagccaaatggcggatctcagcaattcaccgggacgcgagggacatgcgattatggcaggaacgtttcttggtgaattcgctgagtcaacaccttgggttcaccttgatattgcaggcacagcgactgccaataaagcaacctgcttcggaccggccggggctactggcgttatggcaagaacactggctacacttgcggagcgatttacattggaagaagataaaaacgagtaatgaaaaatccctgctgtatgatgcggcagggattttttcttccgaaatctttagttgactaaagtggatcggttatgatacgatacgttcgtactttatttatctactacattagcaaactaaaggatttttggaggggtatcatcatgaatgcagtcgtcatcgcagtcctgcttatgcttgtattaagcctgctgcgtgtcaatattgttatcgcattaattataggcgccttggccggcgggttaacaggcgggctcggtcttggcgaaacggttaaagctttcacagacggtctcggcggaaatgccaccgttgcagttagctatgccatgcttggcgcgtttgccgccgctttgacgaaaacgggtcttccggacgcaatggtggaagcctccgttaaattaatcggaaataaagaagattctcgaaaaaaagcactgtctaaggtgctgattgtgctgattattttaattgtatcttgtttttcgcaaaacgtcgttccggttcacatcgcgtttatcccggtgctgattccgccgcttttgaaaatctttaatgaacttgaaatggaccgccgtctgatcgcgtgtgtaattacatttggcttaacggctccttatattttgcttccggtcggtttcggccaaatcttccaaggcatgctgaaggacaatatggcggatgccgggttaaacgttccgcttgctgatattccgtacgcactgattattccagttgcaggtatggttgtcggccttattttatcagtgatcgtataccgtaaaccgaaacaatatgaaacaaaagacatttcaggtgcagaagcatcgccatatacgagaaaaagtattggtatcgcggttctagccattgttgtgtcactcggcgtccagctttacttatctcagactttgggagtagaaggaatgattatgggggcgctcgctggtctgattgttctgtttgtcagcggtgtgatgaagcgtgatgaagcggactcactgattactgatggaatggttttaatggcctttatcggctttgtcatgcttgttgcagccggattttcaaacgtattgacgaaaaccggagatgtcgagtcactggtcaaaacgtcagctggttttatcggacacagtcagtccttgggcgcattgctgatgctcattgtcggcttattaattacaatggggatcggatcttcttttgcgaccattcctgttatcacaaccattttcgtgcctctatgcatgcagcttggattcagcccgatggcaacgattgcgattatcggggctgctgctgcgcttggcgatgccggttcacctgccagtgacagtacgcttgggccgacttcaggtttgagtgcggacggccagcatcaccacatttgggatacttgtgtgccgacatttatattttataatattccgcttgtcatctttggctggattgcagcgcttgttttataggaaaaaggctcccctttactggggagccttttctcgttatgataaaaaaaccgtccaatagaacggtttttacgtagatgatatgtgatttctgttaaagccggttgctttatgaatagagcggtagattgctggtgcgataaacgacagtatcacagccagcgctgtatcttttaccataaaccaaatcataaagccccaagccgtgccgtagctcactggcgtatgaatccacagcttcagtgcaagatacatataggtagtgccgatgagatacatgatcgccgttccgataagtgaagcaatgagaaatcgaattttacttggctgaatgtttcgttctaaaaaccatcccgctgcaaatgctgccggaatgtatgagataataaacccgccgcttttccctgcaaacggtgcgaagcctgctgaaaattgagcaaacacaggcgctccggccaatcccacaagtgcatatacaatcatggcaatcgctgcccgtttgctgccaagaagcaaagctgccaagagacagaaaaacggctgcatcgaaagcggaatgccggctacttgtaaaaagggtgctactgatgtaatgttggccccgacagccataagtgcggcgaacatgccaatcagcgccatatctcccgcacgaagtttacgttgtttcatcgttgttcccccttaggttgacatacacaatcatagagtaataaagaacaaaaagattgtcaacatgattttaaattaggttaacaaaaaggaggcccatatgtatttcggaaaaacaagacagtccgatcaatctggaagagtgccgccaaatcaaaacgtcaccacttcatttcctgtgcttcataccggagatgtcccatattacgaagatatgacgaaatggaatcttcaagtatacggtttggttgaccatccgatgctgctaagctttgaagatgtcaaagcctttccacggtatgaatcgaaaaacgacattcattgcgtcacgggatggtcaaggcttgataatgtgtggcaaggcgtgcgggcttgtgatatagcggaaaaagcgggtgtaaaagaagaagcgggctacgtcattttacatgctgaagagggctggacgaccaatctgccgcttgatgatttcttagcggaaacttcccttctggcttatgcgcataatggcgaacctttaacccctgaacacggctttccgctgcggggtgtatttccgcatctgtatttttggaaaagcgccaagtggctgcgcggcatccaatttacgaaagaaaatcaccctggcttttgggagcggaatggctatcacatgagaggcgacccttggcaaaatcaaaggtttacatgggattaaggttctatttcaaataggacaatacgcatctttattaggtttttacttccatattgatagtctgcaggtaccttatttgatcaaggtgccttttttattcgggaaaaagttgactttctttggaagaaaacctattatttgaggtgtctagttgatagtgaaaatcattatcatacattgcggtttagtttaaggagaggaatgtcgtactgcatgaaagaacaaacaacagaccggacaaatggcgggacatcaaacgcatttacgattcctggtacggaagtgcgtatgatgtcttcacgcaatgaaaaccgtacctatcacatttttatctcgaaacctagtacgccgccgccacccgctggttatcctgtgatttatctgctggatgccaattctgtcttcggaacgatgacggaagccgttcgaatacagggacgccgacccgaaaaaaccggggtgatccctgcagtgatcgtcggcattggctatgagacagcggagccgttctcctcagcacgccaccgggattttacaatgccaacagcccaatcgaagctgccggaaaggcccgacggcagagaatggccggagcatggcggagcggagggctttttcagatttattgaagaggatttaaaaccggagatagaacgagattaccagattgataaaaaaagacaaacaatctttggccattcgctcggagggcttttcgtgctgcaggtgctgctaacaaagcccgatgcgtttcaaacgtatatcgcgggaagtccgtccattcattggaataaaccgtttattctcaagaaaacggaccatttcgtctctctcaccaagaaaaacaatcagcctatcaatatcctgcttgccgcaggagaattagagcagcatcataaaagccggatgaatgataatgcaagggagctttatgagcggctggccgttttatctgaacaaggtatacgggcagaattttgcgagttttcaggagaaggacatatttcagttcttcctgttttggtcagcagggcgctgcgttttgcgcttcaccctgacggaccgcatctatcaatgggctgagacatactcagccttgcctttaaaaaaatatttgtcactgaaattatatttgactgtcacatgacatttggatatgattatttttataattgataatgataatcattatcaatagattgcgtttttcaaggcgcagcagtctttttcgctggatgtctgtttggcatttagagcgaagaaaggaattgatgatatgaatgcaaagggtatagagggaaaaattgcttttataacaggggctgcccaaggaataggcgaagctgttgcgcggacgcttgccagtcaaggcgcacatattgcggcagttgattataatcctgaaaagctggaaaaaggttgtgagcagcctcaaagcagaaggccgccatgcagaagcttttcctgcggatgtgagagacagcgcggcgattgacgagatcacggcgcgcatcgaacgtgaaatggggccgattgatattttagtgaatgtagcgggtgtccttcgcccgggactgatccattcgcttagcgatgaggaatgggaggcgacgttctcagtgaattcgactggcgtatttaacgcctcgcgttcagtcagcaaatatatgatggaccgaagatcgggttcgattgtaacagtcggatcgaatgctgccggtgtaccaagaacatctatggcggcatatgcgtcttcaaaggctgcggctgtgatgtttacgaaatgccttggccttgagcttgcagaatacaatattcgctgcaacattgtatctcccggatcaacggaaacagacatgcagtggtcattatgggccgacgagaatggagcggagcaagtcataaaaggatcacttgagacatttaaaacagggatcccgctcaaaaaactagccaagccttcggatattgcggatgcggtgctctttttggtttctggccaggcagggcatattacgatgcataatttatgcgtagatggcggcgcgaccttaggcgtgtaactgaatttaaaggaggttcatgagaatgttggatcaaaacgttataacagaaacaaaagcggagcatttgcttcatgaatatcagccgggcgcctttttcttagcgtctcctcatcgtgtactgttagcgaaaggcatatgtgaaattgtaccggaggcagacgggcaaaaccaaatggaaaccctttctggccgaattgcagaggcgttacgtcaggcaaaacaatcagggcaaagccggccgcttgttgtcggggccgttccttttgatcaagtaaaagcagcgcggctcgttgtacctgaagaagtgcgctggtcaggaccgcttcaatttgatcatgaggaaaaggaacagcaggctgggcatacataccacataaagcctgttcctgaacctgaggattataaaaatggtgttgaacaagggctggcacgcattgccgatggaacactcagcaaaatcgtcctgtccaggtcgctgcatttgacatcgcctgaaccgattcagacggatgaattgcttcgccatctggctcagcataactcgcatggctacacgtttgccgcagacgtgtccagtcaggaggaaacgtctccccgccgaacattgctcggagcaagtccggagcttctcgtttcaaggatgggaacacaggtcgtttccaacccattagccggctcaaggccgcgcagtaatgatcctgttgaagaccagcgccgggcagctgaattgctttcttccgcaaaggatcttcatgagcacgcggttgtcgctgacgcggttgcggcagcgctgagacctttctgccggacgctggaggttccggagaagccttcactgatcaaaacggaaacgatgtggcacctgtccagcgtgattaagggagagctttccgatccgtctgtaaccgcacttgaattggcggcggcgctccacccgacgccagccgtctgcggaacaccgactgatcttgcaagagaagcgattctcagcattgaaccatttgaccgcggtttctttaccggcatggtcggatggtgtgacgatgccggtgacggagaatggatcgtgaccatccgttgtgcagaagcagaagaacgctcactccgcctgtatgctggagctggtgttgtggccggttcaaagcctgaggacgagcttcaggagacgtccgcaaagtttcggacaatgctgcgggcaatgggcgtggatcacatatgaacagaatgaattgctggagggatacaacatgctgaaaggatttacgccttggcctgatgagttagctgagacctatcgaaagaacggctgctgggccggtgagacgtttggagatttgttaagggaccgggcagccaaatatggtgatcgcattgccattacatacggaaacacccattggagctatcgagagcttgacacaagagctgatcgcctggctgccggatttcaaaagctcggcattcaacagatggatcgtgttgtggtgcagctgccaaatatcaaagagttttttgaagtcattttcgcgcttttccgtctgggggcgcttccagtcttcgcactgccttctcatcgaagcagtgaaattacatatttttgcgagtttgctgaagcggctgcatatatcattcccgacgcttattccggttttgactaccgtacgcttgccagacaggttcaaagtaagctgccgactttgaaaaacatcattgtcgcaggtgaggcagaggaatttttaccgctggaggatttgcatgcagaacctgtaaaactgcctgaagtcaaatcatcggatgtggcgttcctccagctttctggcgggagcaccgggctatcgaaactgattccgaggacccacgatgactacatatacagcctgaagcggagtgtggaggtctgctggctcgaccacagcacggtgtacttggccgcgctgccgatggcacacaattatccgctgagctcacccggcgttctcggcgtattatacgctggaggaagagtggtattatctccttctccaagtccagatgacgcatttcctttaattgaacgggaaaaggtcacgataaccgctcttgttccgcctcttgcgatggtatggatggatgcggcatcctcacgccgtgatgatttatccagccttcaagtgctgcaggtcggcggtgccaagtttagtgctgaagccgcgcgcagggtaaaagctgttttcggctgcacgctgcagcaggtgttcggaatggcagagggtctcgtcaattatacgagattggatgatcctgaggagatcattgtcaacacccaaggaaaaccgatgtctccatatgatgaagtgcgtgtttgggatgatcatgatcgcgacgtaaaacctggtgaaacaggccatctgctgacgcgggggccgtatacaattcgaggttactataaggcagaagagcataacgccgcttcatttactgaggacggtttttaccgtacgggtgatatcgtcaggctgacacgagacggctatattgtcgttgaaggccgggcgaaggatcaaattaaccgtggaggagaaaaggttgcggctgaagaggtagaaaatcatctgctggcgcatccggctgtccatgatgcggcaatggtctccatgcctgatcaatttcttggcgaaagatcttgtgtgttcattattccccgggatgaagccccaaaagccgcagagcttaaagcatttttgagagagcgcggactggcggcatataaaatccctgatcgagttgaatttgtcgaatccttcccgcagacaggagtaggaaaagtcagcaaaaaagcgctccgtgaagccatttccgagaagcttcttgcaggattaaaaaaataaaacaacaatttgagaggaagtgttcatatggctatacctgccattcagccgtatcaaatgccgacagcatctgatatgccgcaaaacaaagtatcatgggtgcctgatccgaatcgggctgtcttgttaatacacgatatgcaaaactattttgttgatgctttcacagcgggagcgtctccggtaacagagctttcagcgaatatacgaaagctgaagaatcaatgtgttcagcttgggattcctgttgtctataccgcacagccgggaagccaaaatccggatgaccgtgcgctgctgacagacttttggggcccgggattaaacagcggtccttatgaggagaaaattataaccgagctggcaccagaggatgatgatcttgtgctgacaaaatggagatacagcgcgtttaagagaacgaatctgcttgaaatgatgcgcaaagagggacgcgatcagctgatcattacaggaatttacgcccatatcggctgtcttgttacagcatgtgaagcatttatggaggatattaaagccttttttgtgggagatgcagttgctgatttttcattagaaaaacatcaaatggcgctggaatatgcggctggacgctgtgcgtttaccgtgatgactgacagtcttcttgatcagctgcagaatgcgccggcagacgttcaaaaaacgtcagcaaacactggcaaaaagaacgtgtttacatgtgagaatatccgtaaacaaattgctgagcttctacaagaaacaccggaagacatcacagatcaagaggatttgctcgatcgtggtcttgattcggtaaggatcatgacattggtggaacaatggcgccgtgaaggggcagaggtgactttcgtggaattggctgaacgcccaacgatcgaagaatggcagaaattgctcacaacccgcagccagcaagtgctgccaaacgcggattatttataaaaggagggtaaacaaacggatgcctgatacaaaagatcttcaatattctttgaccggggcgcaaactggcatatggtttgctcagcagcttgatccggacaatccaatctacaatacagcggaatatatagaaatcaatggaccaatcaatattgctctttttgaagaagctttgcggcacgtgatcaaggaagcggaatcgctgcatgtccgcttcggtgaaaatatggacgggccttggcagatgataaacccgtctccggatgtacagctgcacgtcattgacgtcagctctgagcctgatccggaaaaaacagcattaaactggatgaaagctgatttagcaaagccggttgatttagggtatgcccctttgttcaatgaagctctgtttattgccgggcctgatcgtttcttttggtatcagcgcattcaccatatagcgatcgacggcttcggtttttccctgatagcccagcgtgtggcaagtacatatactgcccttataaaaggacaaacagctaaaagccgttcctttgggtctctccaggccattttggaggaggatacagattatcgcggatcagagcagtatgagaaggatcgtcaattctggctggaccgttttgcagatgcacctgaagttgtgagcttggctgatcgggcgccaagaacatctaacagttttcttcgtcatacggcatatctgcctccgtctgatgtaaacgcgttaaaagaagcggcgcgctatttctcaggaagctggcatgaagtcatgattgcggtgtcagctgtttatgtgcaccgtatgaccggctctgaggatgttgtgctcggcctgcccatgatgggtcggatagggtccgcgtcactgaatgtaccggctatggtgatgaaccttctcccgctccggctgacggtaagctcttcgatgagcttttctgaactgattcagcaaatttcccgggaaatccgcagtattcggcgacatcataagtatcgccatgaagagcttaggcgcgatctgaaattgataggagaaaatcatagattatttggccctcaaatcaatcttatgccgtttgattacggtctcgactttgccggcgtccggggcacaacgcataatctttcagccggtcctgttgatgatctatcaatcaatgtatatgacagaacagacggcagcgggctgcgaattgatgttgatgcgaatcccgaggtatacagtgagtctgatattaagcttcatcagcagcgtattttgcagctgctgcaaacggcttctgccggagaggacatgctgattgggcaaatggagcttctgttgccagaggagaaagaaaaagtcatttctaaatggaatgagacggcaaaatccgagaagctggtcagccttcaggacatgttcgaaaagcaggcagttcttacgccagaacgtatcgctctcatgtgtgatgacattcaagtcaactatcgaaagctcaatgaagaggcaaaccgcctcgcgcgtctgttgatcgaaaaagggattggtccggagcaatttgtcgctttggcgctgccgcgttcccctgagatggtggcttcaatgcttggtgtgctcaagactggtgcggcgtatctcccccttgatccggagtttccagccgaccgcatttcttacatgctggaggatgcgaaaccttcatgcatcataacgactgaggaaatagcagccagtctgcctgatgacctggctgtacctgagcttgtgcttgatcaggctgttacacaggagattataaaacgctattcgccggaaaatcaggatgtatcggtttcgcttgaccatcctgcgtatatcatctatacctcaggatcaacaggaagaccgaagggagtcgttgtgacacagaaaagcttaagcaattttctgctgtctatgcaggaggcattttctctaggagaagaagacaggctgttggctgtgacgactgtcgcttttgatatttcagcattggagttatatcttccgctgattagcggagcgcaaatcgtgatcgcaaagaaagaaacgatccgtgagccgcaggcattagctcaaatgattgaaaatttcgatattaacattatgcaggcgacaccgacactgtggcacgctttggtaacgagtgaacctgagaaacttcgggggcttagagtgcttgtaggaggcgaggcgctgccgagcggtcttttgcaggaacttcaagaccttcattgttcagtcacgaacttatacggtcccactgaaacaacgatttggtctgccgcagcttttcttgaagaagggctgaagggcgttcctccgattgggaaaccgatttggaacacgcaggtgtatgtgcttgataatggattgcagccggtgccgccgggcgttgtcggagagctttatattgcaggaaccggcttggccagaggttatttccatcgtcctgatttaacggcggagcgcttcgttgcagatccatacggaccgccgggaactcggatgtatcggaccggagaccaggcccgctggcgcgccgatgggtctttggattatatcgggcgggcggatcatcaaatcaaaattcgcggattccgaattgaacttggagaaattgatgccgtgcttgccaatcacccgcacattgaacaggccgcggttgtcgtacgggaagatcagccgggagacaaacgattggcggcttatgtagtcgctgatgctgctattgatactgcagagcttcgtcgttatatgggggctagtcttcctgattatatggtaccgtcggcgtttgtggagatggacgagctgccgttaacacctaatggcaagcttgaccggaaagcactgccggcaccagacttcagcacatctgtcagtgatcgggccccgcggactcctcaggaagagatattgtgtgacttgtttgcagaggttctcggtttggcacgcgtcggtatcgatgacagtttcttcgagcttgggggccattctcttcttgcagcccgtctgatgagccgcattcgcgaggtaatgggagccgaacttggtatcgccaagctctttgacgaaccgacagtagccggactcgctgcccatcttgatttggcgcagagtgcatgtcccgctttgcagagagctgagcggcctgaaaagatcccgctctcatttgcccagcgccggctatggttcctgcattgtctggaaggaccgagtcctacttataatattccggttgctgtccgtttgtcaggtgagttggatcaaggattgctgaaagcggcactttatgacctcgtctgccgtcatgaaagtcttcggacgatcttccctgaatcacaggggacatcctatcagcatattttagatgccgatcgagcctgtcccgagttacatgttactgaaattgctgagaaggagctttctgatcggcttgccgaagctgtacgctacagctttgatcttgcagctgaacctgcttttcgtgccgagctttttgtgatcggtcctgacgagtacgtgctgcttcttctcgtccatcatattgtcggggacggctggtccttaacaccgctgaccagagaccttgggacagcttatgcggctcgctgccacggacgatctcccgaatgggcgcctcttgctgtgcagtatgcagactatgcgctttggcagcaagaactgcttggaaacgaggatgatccaaatagcttgattgccggacagcttgctttctggaaagaaaccttgaaaaacctgcctgatcagcttgaactgccaaccgattattcacgtccggctgagccgagtcatgatggagatacgattcattttcgtattgagcccgagtttcacaagcgattgcaggagctggctcgcgcaaatagggtgagcctgtttatggtgcttcaatccggtctcgccgctttattgacaaggctcggggcgggcaccgacattccgatcggcagtccgatcgcgggacggaatgatgatgcgctgggcgatcttgtagggctgttcattaatacattggtgctcagaactgatacgtccggtgacccaagctttcgtgagcttctagacagagtacgggaagtgaatctggccgcctatgacaatcaggatctgccgtttgagagacttgtagaggtgctcaatccggctcgttcgcgtgcgacgcatcctttattccaaatcatgcttgcgttccaaaacacaccggacgctgaactgcatcttcctgatatggagagcagcctgcgaatcaacagtgtcggttctgccaagtttgatttgacgctggaaattagtgaagatcgccttgctgacgggacaccaaacggaatggaaggactgcttgaatacagcactgatcttttcaaacgggaaactgctcaggctcttgctgaccgattgatgcgcctgttggaggctgccgagtctgatcctgacgagcaaatcggaaatctggatattcttgcgccagaggaacacagcagcatggtgactgattggcaaagtgtatctgaaaagattccgcacgcatgtttgccagagcaatttgagaagcaggctgctttacgtcctgatgccattgccgttgtatatgaaaatcaggaactgagctatgcagagctgaatgaaagagcaaaccggcttgcccgaatgatgattagtgaaggtgtcgggccggagcaatttgtggcattggcactgccccgatcgttggaaatggctgtcggcctattggcggtgctaaaggccggggcagcttatctccctcttgatccggattatccggctgatcgaattgcttttatgctaaaagatgcacagcctgcgtttatcatgacgaacactaaagctgcaaatcacattccgccagttgaaaacgtgccgaaaatcgtgctggatgatcccgagctggcagagaaactaaacacgtaccctgcaggtaatccaaaaaataaggataggactcagccgctttcccctttgaatacggcatatgtcatttatacatccggctcaacaggtgttccaaaaggtgtgatgattcctcaccaaaatgtaacacgtttatttgcagcgaccgagcactggttccgtttcagctcaggtgatatctggaccatgttccattcctatgcgtttgatttttcggtgtgggagatctggggtcctctgctgcatggcggacgtcttgtaatcgtgcctcaccacgtcagcagatcgccagaagcgtttctgcgcctgcttgtcaaagagggggtgactgttctgaaccagacaccgtctgctttctatcagtttatgcaggcggaacgggaacagccggatctcggacaggcactcagtctgcgctatgtcatttttggcggagaagcgcttgaactcagccgtttagaggattggtacaaccgccaccctgaaaatagaccgcagcttatcaatatgtatggtattacagaaacgacggtgcatgtgagctatatcgaattagaccgaagcatggcagctttacgggcaaacagcttgatcggctgcggcattcccgatcttggtgtatacgtgctggatgaacgcctgcagccggtcccgccgggtgttgccggagagctgtatgtatcaggagcggggttagcacgaggttatctaggccggcctggtttaacatctgaacgcttcatagctgatccgttcggtcctccaggcacccggatgtaccgcactggggatgtggcccgcctccgcgctgacggttctctcgactatgtcggccgtgcagaccatcaagtgaaaattcggggattccggattgaattgggagaaattgaagccgcgcttgttcagcatccgcagcttgaagatgcggcagtgatcgttcgtgaggatcagccgggagataaacggttagcagcttatgtcatcccttcggaagaaacatttgatacggcggaactgcgcagatatgctgctgagagactgccggattacatggtgcctgctgcctttgtgacgatgaaagaattgccgctgacaccgaatggaaagcttgatcgtaaagcgctgcccgctccggatttcgcagcggcagtgacaggacgaggaccgagaacgccgcaggaagaaattctctgtgacctctttatggaggtgcttcacttgccgcgtgtcggcattgatgaccgtttctttgatttaggcggacattccttgcttgctgtacagctcatgagccgcattcgtgaagcgctcggcgttgaactcagcatcggcaacttgttcgaagcacctactgtagccgggctcgctgaaagacttgaaatgggatcaagccaaagcgctcttgacgttctgctgccgctccgaacaagcggagacaagcctcctttattctgtgttcatccggcaggggggctcagctggtgttatgccggtttgatgaccaatataggaacagattatccgatctacggcttgcaggcacggggaatcgggcagcgcgaggagcttccgaaaacacttgatgacatggctgccgattacattaaacaaatccgaacggtccagccaaaaggcccgtaccatctgctgggctggtccctgggcgggaatgtcgttcaagcgatggctacccagctgcaaaatcaaggagaagaagtatccctgttggtgatgctggacgcctatccgaaccacttccttcctataaaagaggcaccggatgatgaggaagcgcttattgcccttctggcgttaggcgggtatgatccagacagcttaggggaaaaaccgctagattttgaagcggcgattgagattcttcgccgtgacggcagtgcgcttgcgagcctggatgaaacggtcattttaaatttgaagaatacgtatgtaaattctgtcggcattttaggttcctataagccgaaaaccttccgcggaaatgttttgtttttcagatcaacaatcattcctgaatggtttgacccgattgaacctgactcgtggaagccttatattaacggacagattgaacaaatcgacatcgactgccgtcataaagatttatgtcagcctgaacctctggctcaaatcggcaaggttctcgctgtcaaattggaagagttgaataaataagggaggagaaatagaatggcaaatccttttgaaaatgcggatggcacatatttggtgctggtcaatgaagaaggccaatattccctatggccgggttttatagatgtgccgagcggctggacagtcgttcatgagcaaaaagggcgtgaagcttgtttggactatatccaatcgcattggagcgatatgaggccaaacagcctaaagactgttgaaaatgtgtaatcttatcaaaaagagactgcttgccgcagtctctttttctatcttacgcagacgtttgggtatgatcacaatctctgacagggtttccgttttcatcggtacaccaagattgggataaaaacgctaaaaacacagcggcccactgatctgcaaactgaatcagaatacccccgtcatgccaagagccgttgtcttttttccagcgggtatccattgcattcccttgattcatatggatattgtgcattccgttagtcggggtaaagccgaatattttatctgcagcctgttcagggccgaattttgaaccgaatatataaaccggcgttttctcatcttgtgctttcttcatataggtttcaataaaatcatttaaatcattatcaggtcccgtgatttcatgaggcaaaggcttcatttcccgcgggtcaaacaaattgccccgcacataatccagtgccacttcacggtttgcttcattgatccttgtatatccatacggcatgttcggaaggatggtaattgagcccgaatcaaactgatcgtcagccaaatacaatacttcagattcctcagaactggacatcacattgatggcgcacctgtaatacgtattctcttcaccgagcattttgacttggaaatgaggactgtcatcatctgtttcccgcttcatgtctaatactatgccttttaacacgccatattgctgaacagccatatgaatcctcctttatgatcaacttcatagtcataattcgtgaaatggtctcttttttccttttaaaaaataaaaaagcctgcagaaatctttctgcaagcttattgtgaattaagcacccgccacagatgattcatcctgtaaagctttctcggcaggaacatactcatagcctagatctcttgctacagcttcataggtcacgtgtccgtttgcggtgtttaaacccgctctcagtgccgtattgtctgcgagcgcttttactgcccctttgttcgcgatttgcagcgcgtatggaacagtaacgttagtcagggcgattgttgatgtacgagggactgcgcctggcatgttcgctacagcataatgcacaaccccgtgtttttcatatgttggctgatcatgtgttgtgatatggtcgacagtttcgacgatgccgccttggtcgatcgctacatcaacaataactgaaccgggtttcatttgttttaccatttcctcagtgacaagagtcggagctttagcacccggaattaataccgcgcaaatgaggagatccgcttccgccacagcatcagcaatattgaccggattagaaattaacgttttaatctgatggccgaagatgtcatcaagctggcgcaagcggtctgcgtttaagtcaatgatcgtcacatctgcaccgaggccgacagccattttcgccgcgtttgtcccgacaacgcctcctccgataattgttacttttccgcgggaaacgccaggcaccccggcaagcagaatgccttttccgcctttaggcttttctaagaattgagcgccgatttgcgctgccattctgcccgcaacctctgacattggcgtcagaagaggcaatgtccggccttcactgaccgtttcatatgcgatggcagttactcctttatccttcaaggcctgtgcaagctcaggctcagctgctaaatgaaggtacgtaaacagcacaagtcctttgcgaaaataaacatattcttccggcagcggttcttttactttcatgaccatttcggcgtcccagacctgcttcggatcagcaatgatttccgctcctgctgactcataggcttcattttcaaatccgcttccaaggcccgcgcctgtttcaaccagcacccggtggccgtttgaaatgagctgagaaacgcccccgggtgttaatgcgacacggttttcattgttttttatctctttaggaacccctatgatcatatctgtctcctcctgtatatgtgatatttttagtgtagcttgatattttggaaaattctttgtttgattaagaaaataaaaaaacatggatttgtgaaatttcacaaatccatgtgccgaagtttgatatctaaatagatggtgaatttttgattcacatttttcaaatcaatttcagcgatctggctgatccgcttgagtcggtaattcaacgtattaacgtgtatatttaacagcttggaagcggtattcacgttgctgtccgcttcaataaagcgctctagcgtctctaccatatttgactggtgatcccggtcatattgttccagtttggaaagcgagtaattataatggcccgcctgtttccgtttttcatttaagacatctaagtattgataaatgcctaactcagaaaagctgaaaagatgtttggtctcttcagcgaaccgttccttcgtttttaagacggacaatgcttcctgataggagcgggagacaaaagaaatagagttgtatattccgccaaaagcgatagaaacgtcttctattttataccgctccttcagctgtttttgcgtacttaaagcaaactgttttaaatcttgaaaaggatgatctgttttgggtgaggttaatataataagttcattggaatctacggtcgccagcagcacgtaaacctgctgggtcgtttcctgtaaatattgcagctgctgttcgattttttcagtcagctcgccatttatgcggatgatcataacggaaaactctgaaggagcggccattccaagcttatggaacccatccgccatatcatcctcctgatggatgtgtccggtcagcattttccagaaaaattcttggctgcgttcttcatttttcgttttctgatttgaagtttgagaagcttgtttttcactgcttttgctgccatttgcaatgtcagcagatcttcatcggacaatgttttttggatctcaagcgcccatatgaagccaagtacttgcttgtttttccaaatcgaaatagcgacgcgattgctcagcccgacttcatcgatttgcttgactctgatcggctggtccgtttttaagagagcaggaattgtcccgtctttccacagcttgttaatcaccttctccggtacccttctgccaataatggtagacgtccgggcagggtctgtgcagtcgctgtgtgtactgtaggcaagcagcttgtggttaacatcctctatggtgatcgggcaccgcagaacgtcgctgatatgatcagccacatcttcaagtctgtcaaaactatatttaaacggatcattcggcatggtcataaatctccctacttttcgtgcttgatttctctttgacatctcatccccttccttttattatgattgttgttgtttgtgaaaatcaacaacaaagaacagaagcaaaaaaacaatttcatgagagaaacgttctatatacatttggcggtgtaatcgcctttttgcaggacagtgtatgtctcatataatacgacagcttatcctattaatcttctaagaaagtcatcggaggcaagactaattaaggaaagaaaaaactgaacctttcagaaatggtgctgtagcatcaaattttctgaaaggtttttttgggagttggagagttatttgggtcttttggattattcggagaatgaagagaagattaagaaaataaacctatttactttacagtatatgtcatttttgagtgattcggggtaaaccattggactcattttgtaaaattaaaacatatttgtttgactatgccgaaaaactgtttttataataatgacgttctaaaaataagtgaattagcccatatttaggctgatggcacaggaggtaatgaggaatatggcaggattaattcgtgtcacacccgaagagctaagagcgatggcgaagcaatacggcgttgaaagccaagaagtattaaatcaggttgatcgtttaaaccgaatgatctctgatttgaaaagcatgtgggaaggtgcttcaagcgaagcgttcgcagatcaatacgagcagctcaaaccttcatttatcaaaatgtcagatttgcttcaagatgtgaatcagcagcttgatcaaacagcaaatacacttgagtctactgaccaagacatcgcaaatcaaatccgcggataacagtatgaaagggaaggagcgcctgattcaaaagaagacggcgctctttctatgtaagggtgatcctaaatgtatattgatattacaatagatttgaaacattataacggcagtgtctttgatctcagattgtcagattaccacccggtgaaaaaagtaattgatattgcttggcaggcccaaagcgtatctatgcctccgcgcgaagggcactggatcagagtggtgaacaaggataaggtgttttccggagaatgcaagctgtctgattgcggcattacaaacggagaccggcttgaaatattatgaaaggatctggttgaatgtcaggtgaacaaaaatcatatttagaaaaccaattagaagctgttgccgagaaaacagatgccggctatacatttacctttcaacgggaaaaaataaagcttctcgacggtcttgaagctaacgtgatcaaagatataaatccattttttcataaagaaatcgatgtgacggatgatgaagtaatcatcacaatccaacctccctcctcctataaagcattccgcttcatgaaagctaaggataaaaaaagtaaatggcagtttgcctatcagcttgttcaagccgtacagcagcacaatctgtcgaggctgaatttgattgtcgctcctgaaaacattgtattcgataaagggcttacgccttattttctccattatggagtaaaagaaagcattcctccttacgagcgtgatgaggaaagagtatggcaggagctgaaagcggcagcggctttggcagttgacggcgcttttgcgtttgaagactacctgaaattcaatgaaacgctgacgttctccgcagaggcaaaggcgatattagatgctgaatcctatgatgatttgctcgagctgattcaaacccatattgatgagctcgaagccaaagcaaaaacatacatacatatcccgagaaagaagtggaacatccagcgatatatcggcctggggctcattgttttgcttgtaccggcacttatttattcgatgtacgccttatttttcgcgcagccaaagcaccaggcgatagtggacagcaaccgtgcgttcttaaacaagcagtacagtgaagtcatcagcacactgtccaagtacgatgcggaaagcctgcctgaatcggtgcagtatcagctggcgacgtcctatgttgaggtcgaaaacctggggagtgcaaaaaccaaaaatatagaaaataatttagtcacccttcaatcagaccctcagcatttcttatattggattgattatggtcgaggagaatacaaagaagcgatcagtatcggccgtaagctggaatacaatgattatatttactttgccctagctaaatataaacagcagcttttatctgaggatacaaatgatgaagacatacaaaaagaacttgattcagtaaatagtgagcttgaaaaagcccaaaaagaacgtcaagaaaataaacagtctaattctgaaacatcgttagtcgatacaagcgaagaacagacacaaacagacgaagaaaaacaagcagaagagaaagcggcagaagaaaaagccgcagccgaggaaaaagcgaaaaaagaagaacagaaggaaaaagaagacgagaaaaaagaaacagaaaagaaagatgagaaaaaagatgacaaataacgtgagacatgaagcgcaggtcatcgcatgctgccattcggccgtaagggggttcgccatttgagtctattatgggttttttaccaaaataacgttcaaaaattaaatctgtctaacctcccgtcgtctcatccggtgaccatagggcctgatgtgaaggattctgttacgatcagcaccattccatttaatagcggagtgatttctcttaaaagaaaggaatccggcggccaatacgaagttttcctgggaaatgattgtctcggcacgattgagacggatatatcatttactctccaaacggatcagcaggatatacgcttgatattgacgggcagtgaacctgagaaatccgtttattttacgggaaatcgggatgaaattgtatgttcctcagaaaaaacgaatgcagatatttatctgaatccgcaagattttgcatttgcagaacaaagcacgttttctttgctccgtgcaggcggcagctggtcggtccgccctgaaagcggaacgatcttcttgaacggagagaaaatcaacgccaatacgccgctcaagccgggggatgaaatattctggaacttcacgcaaatgagggtgacggaacaagaccttttagaaattgttcattatgcccagtttgaaacagcgttaacagaaacggtcaaaccgagtacagagatgcagaaaaaatatccgcagtacagaagaacgccgcggatggtatacgatctgccggatgaccgcgtttctttcagttttccctctcaggagagcgatcaaaccaacagagggctgtggctcgtcatcctgcctccgcttgtgatgctgatcgtgatgggcgtagttgccatcatccagccgcgcggcatatttatactcgtttctttggcgatgtttatgatgactctcattacctcgacagtgcaatatttccgtgataaaaaccagcggaaaaaacgcgaggaaaaacgggagcgtgtatataagctttacttagacaataagcggaaagagcttcaggcacttgctgaaaagcaaaagcaggttcttgaatttcactttccttcatttgaacaaatgaaatacttaacaagtgaaatcagtgaccggatctgggaaaaatcacttgaaagcaaggattatctccagctgcggcttgggacgggaacagttccgtcaagctatgaaatcaatatgagtggcggagacttggcgaatcgtgatatcgatgacctcatggagaaatcgcagcacatgcaacgcgtctataaagatatccgtaatgcgccggtgacggtcgatttggcagaaggtccgatggggcttgtcggtaaatcacaaattgtgaaaaatgagattcaccagctaatcggacagctgtcgttctttaacagctatcacgatttgcgtttcgtatttatttttcatgaagaagagtataaagactgggagtggatgaagtggcttccgcaatttcaaatgccccatatttatgcaaaaggatttatttataatgagcaaacccgagatcagctcctgtcttcactttacgaattgatcagagagcgtgatctcgaagatgacaaagaaaaactgcagttcaaaccgcattttgtatttgtcatcacgaatcagcagctgatctctgagcatgtcattctcgaatatttagaagggcagcatgagcatctgggcatctcgacaattgtcgctgcagaaacaaaggaaagcttgtcggaaaacattacaactcttgtccgctacattaatgagcatgaaggcgacattttaatacaaaagaaaaaagcggtaagaattccgttccgtctcgatcatcatcagcgtgaggataacgaacggttttcacgcacactgcggacgctgaaccaccaggtcggcattacgaattccattccggaaacggtatcgttcctggagctttttcatgcgaaggaagtaaaagaaatcggcattcagcaaagatggctgacaagtgaatcgtcgaagtcgctgtcagtgccgatcggctataaagggaaagatgacattgtgtatctgaaccttcacgaaaaagcacacggtccgcacggcttgcttgcggggacaacgggatcagggaaaagtgaatttctccagacctacatcttgtcacttgcagtgcattttcatccgcatgaagcggctttcttactaattgactataaaggcggaggaatggcgcagccgttccgtaacattccccacctcctcggcacgatcacaaatattgaaggaagcaaaaacttcagtatgcgtgcgcttgcttccattaaaagcgagctaaaaaaaaggcagcgcctgtttgaccagtatcaagtcaatcacatcaatgactatacaaagctatacaagcaagggaaagcagaagtggcgatgcctcacttgttcttaatttctgatgagtttgccgagctgaaaagcgaggagcctgattttatcagggagcttgtcagtgccgcgcgtatcggacgaagcctcggcgttcatttgattttggcgacacagaagccaggcggcatcatcgacgaccagatctggagtaactcgcgctttaaagtagcgctcaaggtccaggatgccaccgacagtaaagaaattttgaaaaacagcgatgccgcaaacattaccgtaacaggccgcggctatttgcaggtcggaaacaatgaagtgtatgagctgttccaatctgcatggagcggggcgccttacttagaggaagtctacggtaccgaggatgaaatcgcgatcgtcacagatacgggtctgatcccgctttctgaggttgataccgaagataacgcgaaaaaagacgttcaaaccgaaatcgaagctgtagttgacgaaattgaacgcatccaagatgaaatgggaatcgagaagctgccaagcccttggctgccgccgcttgcggaacgtattccgcgcactcttttcccttcaaacgaaaaagaccatttccactttgcgtatgtcgatgaacctgatctgcaaagacaggcgccaattgcttataagatgatggaagatggaaatatcggcatcttcggctcttcgggctacggaaaatcgattgcagccgcaacgttcctgatgagttttgcggacgtatacacacctgaagagcttcatgtctatatctttgatttcggaaacggaacgctgctgccattagcgaagctcccgcataccgcggattacttcctgatggaccagtcaaggaaaattgaaaagttcatgattcgcatcaaagaagaaattgaccgccgtaaacgtttgttccgggaaaaagaaatcagccacatcaaaatgtacaatgcgctgagcgaagaagagcttccattcatttttatcaccattgacaactttgacattgtcaaggatgagatgcatgagcttgaatcggaatttgtccagctttccagagacggacaaagcttgggtatctactttatgctgacagcaacgcgggtgaatgctgtccgccagtcattgttaaataacttgaaaacaaagattgtccattatctcatggatcaatcagaaggatattccatttacggccgtccgaaattcaatcttgagccgattccgggacgcgtcatcattcaaaaggaagagctttatttcgcgcaaatgttcctgcctgttgacgccgatgatgatatcggcatgttcaacgagctgaaatcagacgtacagaaacttcaagggcgatttgcttcaatggagcagccggcaccgattccgatgctgcctgagagcttgtcgacgagagaattgtctatccgcttcaagctggaacgcaagcctttatctgtaccgatcgggcttcatgaagaaacagtcagcccagtctattttgatttgggcaagcataagcactgcctgattttaggccaaactcagcgcgggaaaacaaacgtcctaaaagtcatgcttgaacatctgattgatgatgaaaccgaaatgatcggcctgtttgactcgattgaccgcggcttatctcattatgcgaaggaatcagatgtttcatatttggaaacgaaagaagatattgagcagtggattgaaacagcagaagacattttcaaaacaagagaagccatgtatgtagaagccgtccgccaaggagacgcacaaaatctgcgattctcacaagtcgtgctgatgattgacgggataacgagattccagcagacgattgatacgagaatacaagatcgtctcgctaacttcatgaaatcatacgctcatcttgggttcagctttatcccgggcggaaaccacagcgaattctcaaaaggctatgactccttgacgactgagatgaagcaaatccgccacgcgattctgctgatgaaaaagtctgagcaaaatgtcattcctctcccgtaccaaagacaggagcctgagattcagccgggcttcggatatgttgtggaaaacgggaaggagcaaaaagttcaaattcctttatgttctgctgaaagggagagtgctagatgacagaacaacgaaaaagcttgatcaagttaatatccgccgtcatcatcattttgctgctgccggtgttgtttttccgatttatcggagacgacccaacgaaaaaagcagtcaattctacccggcaaatcgcggtggtgaatgaagacacaggcgtattgagtgatgaggtaaagtctgatgaagaggacaaatccgcccagttcggcaaggaagtagcggccgttctgggtgaacgtcctgattattcgtggacggtcgtaaaccgaagcgcggccgagaccggtctcgcttcaaagaaatacgatgcgattgtctacattccctcagacttctcaaaaaacattttgagctatgacaaagaccatcctcaaaaggcaacgctcgaattcagcattcaagataacctgaatgcggttaacaaagaaaaagttcagcgtgagcttgaggatgcccaaaagacaatgaacaaaaaaatgtcggccttatactggaattttgtttcgcaaaaagtggacaacatcagaggagaatttgacaagatcgtcaataaagaatctgaattccagaatgtcatgtacaacttttacaaaccaagctctaatgatttagcaggtgaaatcaaacagcaaaaagacttaatcgatgagctgaagaaatcaatgaatgaagcgcaaggcacgacaaagaaaaagcttctacggcggaggaagccaaaaacacgctgaaagaattcattgatacagttgaaaggtacaaagaatatcaagagaatcagaaaaagctgcttttggcagcccaggattcaacacagcagcaaatccggacaggtctggatgccatccaggcacagcaaaaggcgaatcagttcagcgaacgcatgagcggattggcaaccgggatcggccaagcgaagacacaaataggactgacaaaccttgcgttgaacaatgctgaaaagttaaggcaaaatcaagtgccattgcaagaaatgggtatgaaaaaaattgagaatgacatgtttaatgcatttctatctcgatataaaagtcaatatgaagctattaaatatcaaaatttaaatcaattgcaagagaatatcgggaagaaccgccttagtttacttaaacctaaggaaagcgacgaaaaggaagatggagaagacacatctgataataaagatgacacagataaggaagatattgaagatataaaattggatttagagaagcagcgggatgagctcaaaaatgttgcaactgaaattaaagatatctctgaagggttaaaagaacctgaacaagaaaaaccaacaacacccgatgctgaagaaccatcaaccgatgattctcctaatactgaagaaccgtcgaatgatattccaacatccgatgatcagccaacaaatgaagatactggctcatcagaagagggtactcaagataatggatcacaaaatgatgttcaaactaacattgaaacgggacaaaaacatcaagaatcttcaaaaaacgttcctgaacaagatacaaacacggagaatacaggaacctctaaaacagatttctctttgattgaactcgcagatgaaaacgatggctcaaatcaaagtgatgggctacagggtgacggagctgacggtgaaactgatatttcaggtgcaaaaaaacgtctgaacgaagcagcgataaaattagaggaaatagaaaatgcacttcaagaaaaacaagaggaacataacaacaaactagagaaacatattgatgagttaaatcaagaaattaaagagttaaataaaacagtttcaaaattaaatgatcaaattggtgacttaacaaaaaagttggttgattttgataataatgtcaatgatgcttataggttaatatacaatttggaagacgaaataatacaaactttgcagagtagaggctatatagatcagaaagaaaaactaagttcaattttttcaagtagaattgaaactgataatatttctaacttgatgaagtattacaactctttaaatttatataagtctacgctaaatgataatctggatctaggctctttgactattattaaaggtgaagtcatccaagagcaagatggcaacgtccaatcagtcctggctctcacacctgaagaatcagccagctgggaagctctcaaaaacaacacgatgcaaacagatgaggatattaacagcttcatcgacggcatgaccaaatttgcggacgactacagcggctatatccgtgactctcaagcaggtgttctcgacgaactgacgaaaatctctgaaagtgccgcaaaagcgtcagaacagcttgtaacgggcgcaacacaggaatctgcgacgttcagcaacgatgggctgtctggtaccatggcactgagtgtccaagatacggtcggccaggaagtgctgcaaatgtcagacatgatgggttcattgtctgatcgccagtccggcatcattgattacacaaccaacatgcagcaaagcgttaatgatgttcaagcgaaagccgacaccttaaacaacaactgggggaaaaatgtcgcctccacgaaactcgtgcgaaatgacgtatacggcatactcggaaatacattagtagacgggcaaaacaatggctatgtatatgattacttagcgaatccgcttaaaatcagcggagaggttccggaagaaaaaattcagacggtacctccggttgtcatccttgtcattgtgttgatcagcagtctgttaatcggctatttcagctcgtattaccaaaacgcaccgcttctcgtcaaaggagcgttattcggaattctgaatatccttgtcggacttatgatcagcttgttcggcttgaatatttattcactgccggacgatcagacgattaagtggtcggtgtttacgattctattgctggtcgcaagctctgccttcatccggacggcattcagattcggatcaatccctggctgggttgcttcagcagcaatgatcctattctatgtcgcaccgcttattgatttgatcatgccgaactttacatttgaagatccggtttcgaaagtatatatcgacatccagtacggtactgggcacttgtttacaatgggaataacagttctgctgatcattacggtgattgccgtggctctgccgctgattatccggttgatggctgaacacacagcagaaagcgatgaaacgtatgaagcgtgatcgcagcatggaaaaggggatcatgatttgtatgctctccttttcccttttcataccctctgcagcggctgcccaaactgaagaaaatacagatgtcgcgccaaaccagtatgagaaaaaagacatcgaaatcgatacgaattatttgcatgaagatacctactatgaagaaaaaacagaactgcctgaggaacaaaaggatatcacttttgataaaccgaaggacaaggacgccgagctgataaaagatttgtttacatcaacaaatgccgaggattccaacacgattgcggcccagtcgaaacagcttggaattacttttgctgaaaaaccaatgacaaagacatcatcaacggaaacagaagatgaacaagaaacatcatcattgctgctgccgatgatctatgtcgtactgatcctgctcggaattgcaggcatcgtgttcctcatcccaaaagtcacagcgcaggaaaacaagaaggcgtaggccgcgtgcttgtgttgtgtaaaagaggtgccgtacaataataacggaaaaggaggtttccaatggaactttatatcatcaccggagcgtcaaaagggctgggtcaagccattgcattacaggctttagaaaaggggcatgaagtccatgccttatccagaacgaaaacagatgtctctcacaaaaaactaacgcagcatcaaatagacctcatcaatctcgaagaagctgaacagcaatttgaaacattgctctcatccatcgattcagatcgttattctggtattacccttattaataacgccggaatggtaacgccgatcaaacgtgccggcgaagcgtctcttgacgagcttcagcgccattatcagctgaacctgactgcgcccgtgcttttgagtcagctgtttacaaaacggtttgcttcatacagcggcaaaaagacggttgtcaacattacttcaggagccgccaaaaatccatataagggatggagcgcgtattgcagttcaaaagccgggctcgacatgtttacgaggacattcggatttgaacaggaggatgaagagctgccggtgaacatgatttcgttctcacctggagtgatggacactgagatgcaggccgtcatccgttcttcatcgaaaaaggatttccaccacattgaacgattccggaaattaaatgaaacaggaagccttcgcagtccggactttattgccggcacgctgctttctttactagaaaaagggacggaaaacggccgcatttatgatattaaagagtttttgtagagcagatattttctgctcttttttttatacaaaaggctgcagccagcgcattttattgaacagccgcatatactgactgaaacgttgcttttagggtataacaatgatgataagaagatcaaaatgatgtgacataagaattgagtttctctgcaaattatgttaggattctaaaaatatctaaaggaggggtttccatgagaaaggttacattaatggatgttttcacccatccaattgcacaaaaatatcttcagcgttccggcgtggcacatgcgattgcctgcgcttatcatgcatacaggctgtctgtgaaggctgacattaatcctgatttagcagcaaaagcggcactgcttcatgacattggccattatgaatggtatacagacggaaagtgggattatgagaaatacaaaagaaatgacattcatgccattaaaggggcggaacgggcgcataaacttctgattcggcttggcgaggaaccgaaagcagcaaaagagattgcactagccattttgcttcatacagattcctatttgcctgaaggcgaattagataaaaacacactgcagcagattgtcaaaaaagcggacgaactggatgaagagccgggcggccaccatcattaccgccaaattgatccttcaaccgcacgaaaaaaatagaaaagctggaccaattaatcgaccaagcccaggcatccgtgataaagcctgtataagtacggaacagcgccagctttcttcgctgtctccgcttcatcgatacttcctttacacccgcctccaaacgtattctcctaaaatctccgcacccctttgttttatcaggtaagcctgtgtcattatccataagcgcggcataagctgagataaaacacacaaaggggataaaagtatggtcaaccaaggtagtccgcaactggtctctttagtcgatccttatgtctatcagaccattaaaaagctcatcggctcaaggttcgttatacagacagtacgagatacggtcagaggcagactgatcgatgtaaaacctgaccatatcacaattgaaggagcccgaaattctgtttgtttgatcagaatccagcacatgatttccgtcaccccagattacagtgagcgggtctaacagtgcttgcgcatgaaaaataggcgtacaacaggacgtcctatttttcagttaagcgctgtaaaaacgcactatgatacattgttccatcaaggtcaaagccggcaaattcctgatagtcaccatctgaaaaacagaaagtgacacggtacaccgtatagcaggaacggactgaagcatgctggcagacccgaaaatgataaccgtctgaatcttttacatacagccgggatttcccggcaaatggggcacagaggtgtgctgcctcaccaaaacattcgaatccggcgattttgccatcttggctgatatccagcaggagacaatcattgactctgagctcctcagtccgtacattcctgttctttttcggaggaagaacatagatataagccagttctgaatctgtatcgtatgtcacggccttcatcaccaacactcctttcattatattaagagttctgatatgagttcatttttgttacaatgatggggtataagttcttttatctgacagacaaagaaaaactaggaggaacaaagcttgttgaaatcaaaagtccatttttggacattgcagattttatttgttttgctgattatttttgtagcaacaaaagtttcatttgtatttcagccgtttattgtttttatctcgacattgtttttcccgatgctaattgcgggaattttgtatttcatatttaatccggtcgtccgcctgcttgagaaaaaaattccgcggacattatccattctattgatctatttactgtttatcggtttgcttgcctttatttcagcgtcagtcggacctatcatcaccgcacaggtgacagggctgtttaacaaccttcctgattatataaaacagattcaggcgctgacaaaggatttgtcccattctcaatggtttacctggatgatgaaccaggattatgtatcgatatcaaaaattgaacagtcattgacaagttttctccaaaacctgccgcaaaatatcacgtccagtttatctgcggtgtttggtgtcgtgacaaacatcacgcttgttattattactgttccatttatccttttttacatgctgaaagacggacaccgctttccgcatttggcagtaaaaattctaccggcttcttatcggacagaaggcttaaagatttttaaagatttatccgatacgcttgcggcatatttccaggggcagctgttaatctgtctttttgtcggaacagcgtgttttatcggctatttaattgccggactgccgtatgccctgattcttgggattgtcatggcgattaccaatatcattccctatgtcgggccttttctcggtgccgcgccggctgtcattgtcggttttatggactcgccggccaaagcgctgtttgcgattattgtggtcgtcatcgttcagcagctggacggaaacctgctgtctcctcttgtgatcggaaagcggctgaatacccatccgcttacgattattttgctattaatcggagcgggaagcttcggcggaattctcggcatgattttagcggtgccggtttatgcggtagtgaaggcgttcttcctgaatattgtccgcttgatcaagctgcgccagcggtcacgactcgaggaaaacgcaaagccagctgaataggcgggcaccattatcggctccttgcatatgatgctgtaaatcaatgcggaggtggggaaatgcctgcaattgtggggccgatttatatcatgtcagttacggataatgccgcggcaagctttggagacgtatttgcgatttcgcccaaaagcgtcgctcattcaggggcggggtcaggcacatttcagcttggtgattttgtgaagattaacaaccaaacgagtaaaactctcttcaaagatgccgatatcactgatgaaacagtttcgtttaacgggtaacagccttttcacaagaggctgttgcttttttattgtataatatgggtagtctttgaatagagaggtcatgttatgaaaatcagaaaagcaaatatcaatacgcaaaccggaatgatcacggacgtgtatctgcatgaaaacagaaaagaactgcgcacgcttgtagcggtaccgcagctggagtggagcacgatcatttcctatgaagaagataaagcaactctgcctgaacggctggaagcgtcgttgcgccggcatacagaggaaacccctgctggtgagctggccaaaaaaatcattcattgggtaacagaaatgtaaacggcgcttgaaagtttagctcctgcctgatcaggtgataatgaagacaaacaagacgggaggacaggcttttgagtgaagataaaatggatctctatttgcagcaaggaatgtatgggcctttggagacaaagcctgacgagcgccatttgtttttaggctctttaagagaaagagtcgttttggcactgacgaaaggacaggtgcttagaagcaaaccgtataaagaggcagagcacgagctgaaaaacagccataacgtcacccttttgattaatggagagcttcagtatcagtcttactcttcttatatccaaatggcgagccggtacggagtgcctttcaagattgtatctgatctccagtttcatacgcccttaggcatcgtcattgcggctgatatcgctgtgaatcgtgaattgatatatattcaggacgacatttataatcggtcagtactgaaatcgtaagagacaaacggaccgtttgtctttttgttcatggcaattcacttacaactggagataagatataatgttctcatactgatggcggggaggccggctatgaaaaaagcacttatttgtattgattatacgaatgattttgtggcgagtgacggaaaattgacctgcggggagcccggcagaatgattgaagaggcgatcgtcaatttaactaaagaattcatcacaaacggtgattacgtcgtattagcagtagattctcatgatgaaggggatcaatatcaccctgaaacccgtctttttcctccgcataatataaaaggcacggaaggaaaagatctgtacggaaagcttttgcctctatatcagaaacatgaacatgaacctaatgtttactacatggaaaaaacgagatattctgcttttgcgggaactgatttagagctcaaactcagagagcggcagattggcgaactgcatcttgccggtgtctgcacagatatttgtgtgttgcatacagctgttgacgcatacaacaaaggttttcggattgttgtgcataaacaagctgttgccagctttaatcaggaggggcacgcatgggctctttcccattttgcaaacagcatcggagcgcaagtggcagagtaaggaaggggaaaaacagtgttagagtacggatttaaagatgacagcctgtcattacatacagacctttatcagatcaatatggcggaaacgtactggagagacggcattcatgaaaagaaagcgatttttgagctgtttttcagaaggcttccgtttgaaaatggctatgccgtatttgcgggcttggaaaaagccattgaatacttggaaaatttcaagtttacggatagcgatttgagttatttacaggatgaactcgggtatcatgaagattttattgaatatttgcgcggcttatcttttacaggttcactttactccatgaaagaaggagaactcgtttttaacaatgagccgattatgagggtggaggcacccctggtagaagcgcagctgattgaaacagctttgctcaacattgtgaactatcaaacattaatcgcaacaaaggctgcccggattaaaggcgtcatcggtgatgaagttgcgcttgaattcggaacaagacgggcgcacgaaatggatgcggccatgtggggagcgagagcagccttaatcggcggctttagcgcgacaagcaatgtaagagccggaaagcgctttaatatcccggtttccggcacacatgcgcatgcgcttgtgcaggcttaccgcgatgaatatacagctttcaaaaaatacgcggaaacacataaggattgcgtcttcttagttgacacgtatgacacgcttcgttcaggcatgccgaacgcgattagggttgccaaggaattcggcgaccgcattaatttcattggcatccgtctggacagcggcgatttggcgtacctgtcaaaaaaagcccggaaaatgcttgatgaagcaggatttacagatgcgaaggtgattgcttcaagcgatttggatgagcacaccattatgaatttaaaggctcagggagcgcgcattgatgtctggggtgtcggtacgaagctgatcactgcctatgaccagccggctctcggcgcagtttataaactcgttgccattgaagaagacgggaaaatggtcgacacgatcaaaatttcgtccaatcctgaaaaagtgacgacaccgggcagaaagaaagtctaccgcattattaatcagtccaaccatcattctgaaggcgactatattgcgctttatgatgagcaggtgaatgatcagaagcggctcagaatgttccacccggttcatacattcatcagcaaatttgtcacgaatttttatgcgaaggatcttcatgaactgatttttgagaagggtattctttgctaccaaaaccctgagatttcagacatacagcagtatgtgcaggataacctcagcctgctttgggaggaatataagagaatcagcaagccggaggaatacccggttgatttaagcgaggactgctggagcaataaaatgcagcggatccacgaagtgaaaagcagaattgaagaagagcttgaggaagaataaagaaaaactggcctttcattcgcgaagggccagttttctttatgtatatattatttttcatgtttagacaattttcgtcaaattatttgatatacttaggggtgaaagccgcgcgtattgtaagggggataaatcaatgagggtgtttgttgcaagacagcctatttttaatagaaaagaacaggttgttgcttatgaactgctgtatagagaaagcgaagagaacgtgtatagcgctaaagacggcgatcaggcaacaacagatttggtgatcaacagctttttaaacatcggaattgagaagctgacggaagggaaacgctgttttgttaattttacggaaagcctgatgttttcgaatcttcccacctccttcaatccgaaacagcttgtcattgaaatccttgaagatataccgatcacgccggccctcatttctagatgcaaagaattgaaaaaaatggggtatatgctggcgcttgatgatttttatgcaataaatccgcaagatgaggacttactggaaaaactcatgagctatattgatatattgaaaattgattttctcaaaacaacacgaatggaacgcagaacaattttgcaaacctacggctgccgcggcctgatttttttagcggaaaaagtagagacccgaaaagaatataaacaggcggtccaagacggctttcaattattccaaggctactttttcagcgagccgcgcatcatcagcgggcatgacctatcgactcatttctattcttactatgaactgcttaacgaactgagtaaagagcagcctaacataaagcgtgtgacagagtacatagagcgggatttatcactgtcctatcaaattttaaaatttttaaactcatcccacagccgtttgagccagaaaattgaaagcattcaacaggccattatgctgctgggatttaatgaaatcaaacggtggatatatattctttcctttaaggatttaagcaggaaagggcattccagcaagcacgaaatcattaagatttctctgataagagcaaagctttgcgaactgctggcgagaaagacatcccggccgcagcctgcttcttatatgctgatcggaatgttttctctcatagacaccctcctgcatagagaaatagaggaaattgttcaagaattgcctttaaaagatgaagtcgggcaagcattattaggccatcaaaacgactactaccaaatgcttgagcttgtgaaattaattgaaagcaacaactgggacacttgctcagaattaggcaatcaactggacaaagaagaagcgtatgaatgttatttagaggctctggaatggtgtcataatcttatggacgcaaaatgattgcggtcctctgaccaccgcaaagcaagaatcattcggctttgcgttccgataaggctgatatagatgccgtcgggattaaagaccgtatccacttcatgccggacgcccatttgtttgatcaggcgccttatagtttgtttatcagactgttcggctgcggtcagaatgcggcgcgaaagctcccgcgagcccgcaatgcggctgagaacgagctgggcatccgcaaatatccctgcggcctgcttcgctgaacggataaaggtatcaatattgttggcaggagcgggcggacggcgtacctcatacggatacacgtaaaaccagggataacgatatctcatgggagcacctcgcaaaaaaggatgtttctatatgtatagatccctaattgccgaatatgacaaagcgaaaaggccacaactttagcgttgcggtctttttcggtgtttgtcggtcaggaaacgccaagaatcgcatattcaattttgaaaatacggtatgaaggactatagtcttgcttagtgaaaatgcgaaacccgttaaaatcaaggagattaagaatctttctcaatttcagcacatataaacgctctttcgcatagaaagatagtcccgttcttgttgtgattcctttgagtataaggacctattgagatttgcggtgtcacgcaggacttttttgcatacttttcggtgaaaaatgagccgaaagcagatacactattagtaacagatcaaatacctaggactcgttcaccatacacaattcattgatctttcaaaaaaaggagtgtggaaacgatggaaaagaaacttgaagaagtaaaacaattgttattccgactcgaacttgatattaaagaaacgacagattcattacgaaacattaacaaaagcattgatcaactcgataaatacaattatgcaatgaaaatttcgtgaaaaagacttggaaacaagtcttttttttcgttctaccgatacaataaatggataaagtattatatgattgttaaaaaacgaaaaacctgctgtcctttaaatgtcccatttagtaaaatggaatgggaggggggaagtcgttattgagcagatatgtttagattctgtccggatcaaggagaaaatgaaggagattgtggagcaaaacatatttaacgaggatttgtcacaacttctttactcatttattgattctaaagaaacattctcctttgctgaatccacaatcttacattatgttgtttttggaggggagaatttagatgttgcaacaaggcttggcgcgggaatagaaattcttattctttcatcagatattatggatgatcttgaagatgaagataatcaccatgcattatggatgaaaattaatcgctcggagtcgttaaatgcagcactttccttgtatacagtaggattaacgagtatttattcattaaataacaatcctctaatttttaaatatgttttaaaatacgtaaacgaggccatgcaaggtcaacatgacgatatcactaataaatctaaaacagaagatgaaagtttagaagtaattagattaaaatgtggaagtctgattgcactagcaaatgtagcaggtgttttattggctacaggagaatataatgaaacagttgaaagatattcctactataaagggattatagctcaaatttctggagattattatgttcttttatccggaaatcgcagtgatattgaaaaaaacaaacatacactgatttacttatatcttaagcgcctttttaatgatgcttcggaagatttattatacttaatttcacataaagacttatattataaatcgttacttgataaagagaaattccaagaaaaattaattaaagcgggagttactcaatacatttcggtattattggaaatatataaacagaaatgtatttctgctatagaacaattaaatttagataaagaaaaaaagagctaataaaggaatgcttattaagttatacaaagggggatacaagatgcaagacctaattaactactttttaaattatcctgaggctttaaaaaaattgaaaaataaagaagcctgccttataggttttgatgtgcaagaaactgaaacaataattaaagcttataatgattattatctggctgatccaataacccgtcaatggggtgattaataggtggattaatattgaagaacttaataaaaaaattcacaatagctgtaattgttttgagtatcctttatataagctatacaatttatatcagtatgaatggaattattattgggactaagattcataaaaatgataaaagtcaatttatgatagaagaaatatcggaatcttcatatggacaatttgttggtctgagacagggagacatcatattaaaaattaataaagaaaaaccttcagacaaacatttgaaatggggatatttgagtcatattaacagtctggatattttgagaagtggaaaaaagattcatctcaaagattttgatttagttactctaaatagaccttatagtttttttctgttcgtacttcctttggtttttatttttaagcataatatgtattttttatatacttaaagtaaataaaaaaggagatcatttgctgcctatattcttattctattgttattagacatttcgatagcatatataagtgcaggcggaccatttagaggacatataatcaatcggtatattaacttgtttacttttatatcttctcctattctttatcttcaatttatacaaagataccttggagaaataggtaaaacttttttgaatagaatttcttttctttatatcataccaatatttaatcttggtattgagttttttcaagactatttacaagtagatattgattttttagcaactctcaatttggtttcttttgcaactttgactctattttctttttcagcgatatacttacatcttaataaatataaatatgctgagcattcgtttattcttaaattactaattttaacaaacactctttcatttgcgccttttttgatattttttgttcttccaataatatttacaggtaattatattttcccggcattagcttcggcgtcattactagtactaattccgttcgggttagtataccaatttgtagccaataagatgtttgatatagagtttatcttaggaagaatgagatactatgctctacttgccatgataccaactcttctaatagttggtgcattagttctgtttgatgtaatggacatccagatgaaccctgtgcgtcaaactgtatttttttcgttgtcatgttcgctgtcttttattttaaagaggtcatggattttaaatttcggttaaaacgtttctccgaaaaattcaactatcaggacagtatttttaaatatactcagctaatgaggggtgtaacttctcttcaacaagtttttaaagaactgaaaaatactatactggatgttttgcttgtaagcaaagcttatacctttgaggttactcctgatcacaaagtgatatttttagataagcatgaagttggaccggactggaatttttatcaagaggaatttgaaaacgtaacttcagaaattgggaaaattatagaagtcaatcaaggctttcttatgaaagttggtgaacgaggcggtagttcttatgttctgctttgtttatctaatattaacactccccggctaacacgtgatgaaatatcgtggctgaaaacactgtctttttatacaagtgtgtccatggaaaatgtcctgcatattgaggagctcatggaacatttgaaggacttaaaacaagagggaaccaaccccatctggctgaaaaagctaatgtttgcaatcgaagaaaaacagcgttcaggactcgcccgcgatctccacgattcggttcttcaggatttgatttccttaaaacgccagtgtgagctgtttttgggtgatttcaagaaggatgataatccgtgccgtgaagaggtgcaggacaagcttgtacagatgaatgagcagatgtctgatgtgatttcgatgacgagggagacgtgtcatgagctgcggccgcagcttctgtatgatcttggattggtgaaggcgctgtcgaagctggtggcgcagcagcaggagcgggttccgtttcatatccgtttaaataccgggagatttacggcttcccttgatctggattcgcagctgaatttgtaccggatcattcaagagtttctgtctaatgcggtcaagcactctcaggcgacggatgtgctgattatgctcatcagtattcaaaacaaaatcgttcttcattatgaggacgatggcgttgggtttgatcaagaaaaaaatactgagcattccatgagcatggggctttctggcattaaggagagagtcagggctttagatgggcgccttcggattgaaacaagtgaaggaaagggctttaaggctgatattgaaatcgaattgtaatggatttataacggaaacgacttggcacaggccaagtcttttttataaaatggaaaagagtgagtaaaagggaggaaaacatgaaaaagatactagtgattgatgaccatccggctgtcatggaaggcaccaagacaattttggaaacggattcgaatttgtctgttgattgtctcagtcctgaaccgagcgaacagtttatcaagcagcatgatttctcgtcatatgatctcattttaatggatctgaatctaggcggcgaggtcaatgggatggagctttctaaacagattttacaagagaatcctcattgtaaaattatcgtgtataccggttatgaggtcgaggattatttcgaggaagcgattcgtgcgggtctgcacggtgccatcagcaaaacggaatctaaagaaaagatcacccaatacatataccacgtactcaacggagaaattttagtcgattttgcttactttaaacagctgatgactcagcaaaaaacaaagccggctccttcctctcaaaaagaacaagatgtgctcacacctagagaatgcctgattcttcaagaagttgaaaagggatttacaaaccaagaaatcgcagatgcccttcatttaagcaagcggtccattgaatacagcttgacatcgattttcaataagctgaatgtcggttcacggacggaagcggttttgattgcgaaatcagacggtgtactttaaatgttggggggtgtagagatggatatgaagcacacattgcttgaagcgcttggtattgagattgttgaaaacacagcggaacgatgcgttgcggtcatgccggtggatcatcggacggtacagccgttcggatatttgcatggaggcgcttcagtggccctggcggaaaccgcggcgagcgcaggtgcacagaacctgattgatcatacaacgcaagcttgtgttggtttggagattaacgccaaccatttaaaatctgtaaaggaaggaacggtaaaggcgatagccgagcccgttcatataggcagaacgacgattgtctatcatattcacatatatgacgagcaagagaggctgatctgtatatccagatgcacgctggctgtcatcaagaaataaaaaaacagccggaactctgcctgtccggctgcttatttttataaataagaatcctcttttcgtttaatcacaaagtttctgattccgttatagtcatcttgcacacttctctcatcaagcttgacgccggagttatacgcagcacggcagatcaagtgcccgccgataggcgacgtaataaagataaagagaatcccaagcaggattttagcggagagctcccccgtcacaaaccacaaatagaagaagacaccgagcagaatcatattgacacctaatgttgagcctttagaagcagcatgagcgcgtgtaaacacatcgggaaggcgaagtacgccaaatgaagcaatgaggcatataagagcacccagcaaaatgaatacagccacaacgaccttagcggtttcgatcattttcgataatctctcctttctccaggaacttggaaaatgcgatcgttccgataaacgataaaatccccagcaacaaaataatatccaaaaacgcacttgttttcagcaaaatggagacaagcgccgtgattgcgatcagattgatgccgattgcatccagagccacgacccggtcaggcacagtcggacctttaatgacacgaatgacatacaaaaaggtagacactgccataatgccgagcgcgatttgcaggatcagcgtaaacatcaccggctcacctcctgtatggctttttcaaatgactcccgaatgtcaaaaatcgctttttccgcatcctcgatatccattgcatgaatataaagtattgttctgtcatctgaaatatccatcaccaaggttcccggcgttaatgtaatgagcagagaaagcatggtgatttcccagtccttcgtcagttcagttttaaaagcaaaaatacccggtctgatattcagttttggagataagactgatttcatcacactgacattggcaaggtacagttcctttataaaaatgaaacagagcttgataatagaaatcaatttccatagataaaactggcgagtgaaaaagcgccggaagaaaaagagagagagcattcccagaatatagcctgtaatgaatcctgcggcgcttggactgttgcttaagaacatccagcaaaaagcgagaaacacatttaataaaatttgaaatgccatgcgatctactccttcagaacagcttcgatatatttttccggattcagcagcgtctcggccgcttgatcaacgtaaggcgacacccattctgtacccaatccgaagagaagggacagcaagagaaaaatagctgccggataaagaagtcctttagctgttcgatgatttggttttggcgtttctttttcttcgccccaaaacgcatgtataaagatcctcagcacagagtacagtacaagcagactcgaaagcagaatcagcatggatatcgtaaattcaccttctgcgaagccgccctctgcaattttaaatttgccgacaaatccgctcagtggcggaatgcctgcaagagaaatagcggaaatgaaaaacatccatccaagaacaggatagcgtttgatcagcccgcccattttatgcaggctcgcggttccagtcaatgcgatcagcgtacctgccagcatgaacaaagcgcccttaatcagcatatcgtgaatcagatagtagatcgcgccctgaatggatgcgggggtgtgtactgccacaccgaacaaaatcacgccgacagcggtaataatgttatagatcacaattttcatgacattcgaataagcgagtgaaccgatcacaccaaaaatcacagtcagcgccgccagccaaatcatcaactgatgggtaaaggctgtatcgtgaataaaaatcaatgtgaaaaccctcgtaatcgcatataacccgacttttgtcagcaaagcgccgaacaacgcggagattgccgccggtggcgcgtaataagagcctggaagccaaaagtagagggggaagattccgcccttcatgccaaataccaaaagcagcaggacaccaatcacagtgatcagcccggtttgtcctgattcgctgattttcacgctaagatccgccatgtttaacgtaccggttacagcgtataaaaagccgacccctatgacaaacagggcagacgatacaatattaaacacaatatatttaagggattcccgcagctgaatttttgtgccgcctaatacaatcagcatataggaagcaataagcagaagctcaaaaaatacgtacatattaaataaatcgcctgttaaaaacgctccgctgacgccggcaagcaagaactgaacgccggagtagtaaaaggagcgctcccgtttttcaccgacagaacggaaggaataaagcccaaccaataaaccgatgatcgctgttgtgagaacgagaaggctggcgaattggtctgcggcaagcacaatgccgtacggcgctttccatccgcctaggctgagtgtctggatgccttttgtgaagacagtctgtacaagtatgccgctaatcacaatcccgatggccgatgccgccgtgctgaagattctcatgagcataagattcttcgtcatgaaaatcagaagaatagccgacaaaagcgggatcaggattggcaaaataacaaaattattcatgttgatcatttcccctcatttgatccatatcgtccgatttcaattcctgataagcgcgaaaggccatgacgaggatgaatgacgtaacgccaaaagaaatgacaattgcggtcaaaatcagggcttgcggaagcggatcgacaaatgatttggcatgctcgctcaaaatcggagcggcgcctttctttaatcctcccatagtcaaaagcattaaatgaacgccatggcttaacagtgctgttccgataatgacgcgaagcaggcttttagacagcagcaaatacgtagcagccataaaaataataccggctaatacagccattaagatttccattattcttcctctccaatcgtttgaataatggtcatcgttatgcctacgacaacaagataaacgcctaaatcaaatatcgtcgctgtggcgagctccgttttcccaaggatcggcagctgaaagtatccgaatgtgtgggttaaaaaaggagccccgaagacaaaggagccaacgcctgttaatacagcgagcagaaggccggctcccgcgacataaatgaaattgacaggcaaaagggaacgcacggtttttaaatcatatgccaagagcaagagaacgatggaagaggacgtgatcagtccgccgacaaagcctcctccgggcgcgttatgccctgataaaaataaatagaaagagaaaagcaaaatgataaaggatacaagctttgtcgcggtttgaagaatcaagtcatttgttttttgttcattcaccgcttttcccctcctcttttacttttgttttaatcatgctgtaaatgccgagagcggctatcgttaataccgtaatttcaaacattgtatcaaatcccctgaaatcaacgagaatgacattgacgacattatcccctccgccgagatcgtggctgtgtttgacaaagaaggacgcaatgctgtcttttgtccgctggcttgaggatgcgatgccgagcagtgtaacgataacaccgacgcctaaagaaatgataaaattcgtcatccggaacgttctcgtttttgttttcagcctcagtttcggcaaatggtagaagcaaagcagaaacagtgccacagaaatcgtttcaatgacgagctgagtcaatgccaagtccggcgctctgaaaatgacaaaaaacaatgcaagcgtataaccgacaacaccgagtgcaatgatcgccgtcagtcttgacctagcaaaaacagtcgccactgtggcgctgatcatgacaagcgtcaaaatgatttcgtatacaccgattttagccatgccttccgttttaaatgaaaatccgcctttaatggcaaaagctccgcctatcagaatgatgaaaccagcgaagatatacagcaaataatctcttaaaaacccggtcatatattgttttgtgacccggtaagagcctttctccatcatagtcaaaagcttatcgtataaccggttgagtgtgagtttcgaaggaaacagtttatagattcctttccacttattcagcgacaaataaccaattgttccgatcacaacaatacccgcagtcatgagcaattccgttgtaaccccatgccactgtgaaatgtgaacgtggaatttctcatggccgtcaagcagtgtcggatagattgagttcatcgcaggctctatcaggctgtacgacaatatattcgggaaaaagaagagactgacagccaaagcgacaagaatgaccggtggaacgagcataccgacaggcgcttcgtgagcctgtttttcaagctgttcaggctggtaatttcctctgaatgttttaaacagcaatttcatgctgtagataaacgtaaatacacttccgatccaggcgaaaagagggaacagaacgccccatgtctgcacgttgaacaggtcaaaatgtgtcacgcgaagcatgcttgtgaaaaacatttctttactcaaaaatccgttaaacggcggtaggccggccattgaaaatgtcccgattaaggaaatggtaaaagtaatcggcataatcgccatcaggccgcctagcttccggatatcccgtgtgcctgtttcgtgatcgataatcccgactgccataaacaagcttcctttaaaggttgcgtggttgatcaaatggaaaatggcagccatagcggcaactgtataatattctgtatgtccgtaatgaagggccgcagcactgactccgagcatggagatgatcatgccgagctggctgacggttgaaaacgccaaaatcgattttaaatcagtttgtttcacggcatggaatgaaccccaaaccatcgtaaagaggccgacgagggacacgatccaaaaccactgagctgaaaaggcgaaaataggactgaatctcgcaatcacataaatgccggcttttaccatagtagctgaatggagataagcgctgacaggcgtcggagcttccatcgcgtcagggagccagatgtaaaaaggaaattgcgccgatttcgtaaaagcccctaataaaatgagaatcatagccgggataaacaattcgtggccggcaattaattgaacctggtgaaccatctctcgaatactgaaggaatccgttatcaaataaaggagaataaatccgccgagcatgcacagcccgccgctgaccgtaatcaaaagtgatttggctgcgccatagcgcgacttttcccgcttataccaatagccgatcagcaaaaaggatgaaaggcttgtaagctcccagaacatgtagagaaccatgacattgtctactagaacgacgccgagcatggcgcccatgaacatcaataagtagacataaaagggcccaagctgttctttttctttcgataaataaaaaatgctgtaaagagtgaccaaagagccaatgcctgtgatcagtaaagcgaataataacccgaggccgtctatataaacggtaaagttaatgccgagtgacggaatccactctaataccgatcgaagtgtttctccagattgcgtcatcctgatcattgggagaaagtatataaacagcaagacgggcaggatcaacacaaaccagcccgtatgcactctttttgcgtattttgccaagaagggaatgataaaagcaaataaaaaaggcgataaaatagcaagatgtaagagctgcaaagataagacctccttttctcgttctcaattgaaaaatgcgctatgtataaaatatacggtcaaacgacctagtccaaattatatcgcacttttctgcaagctgccacgcttcgaactgctgtaatggatttttatgagttcttttgacctcaaaataagtctaacaaaaaagaggttatttgtatatttaaaatcaatcctgatcaagctgaaggaaaggagctggtcatgtgaaaacaaaagtcgtgatgtgctcaggtttattctgctcagtatttgcaggggcattcatgttgaatcaatatgacgggcgcagcggtgtggcggcttgtgatgagtgggagctgtatttactggagcaccacctgtcagccagaatgagtgagacggaatcaaaggatctgccgtttggtccccgagagtatattcggattgtgaataaataaaaaaagagttccgcataaaacggaactctttctgtttatgaagtgaaaaaacgaagcagcactgtcgcgcaaataactgtgcctgcaccgccgagacgggttgaaatttgggcaaacggcataaggcccattcttcctgatgccgataaaatggcaacatcacccgttccgccgagaccgctgtggcagcaggtaacgattgcggattcaaccggatacatgttcatcagcttgcctacgaaatatccagaaccaatcatcgcgataacaactgaaatacagatgatgacaaacggtatagaaatcacagacgctacgtcatccaacggaataaagaggatgccgagaccgaccatcagcggccatgtaaagcttgaagaaataaacttataaagctggtaagcgccttcttccatttttttcggaagaatatttgcatacttgacagccgcagctgaaataatcattaagatcgcgcccgggatgaagatgaatttctccaataacccgccaaaaataaagaatgtacacgcgagcagaactcctgctcccattagtttaaaatcaatttttgcttcggcttctttttgattgaaaatctcatttgcttttttagattttacgagacgtccgttcccatttagatctggacgcttgtcgccaagctttttcattaaggctgcacatatgatagcaaaaacgtttcctataattgcggctggcaccagctgagacacaaatacatcggcggatgagcccagtatttgtgaataggcgattgaaagcggcaaaatcccttcacctattcccccggcaataatcgggacaacaacaaagaaaaaggaatcataggcactatagccaaaaataaatccgacaaggatgccggctgcaacggccgcgatcgttcctgcaaccagtggaacgaacattctgataaacccctgtattaaaacaattctgttcataccgaggatacttcccacaacaaggcaagcgatatagaaataaaggaagttagacgttttcatcaagttggttacagcgtctaaagatgttgaattcagtacattgtaaaagactaaaaatgaaggaacaaacaaagataaaatagcagggccgccaatatccttcaatatcggtatgcgttggcctatgtctccgagaaacacaccaagaatcataatgatggcaaacccgccaagcatatttgccggcagctcattgtaatatgctgcaagaataataataacagctaatactgtgtataatggcaaaggaatcacaccgatttcccaagaccaaattttttgaaacaggtttttctcctgtgagtctttttgctcaggtgaaattgtccccgtttttggaattgctcccatgtcatacacccccatgtattgtttgttacagtctacaagaaagcgttaacacttcatattttttaagttaaaaaactaataaacaattaaattaagggggtcttttggattagaaaaaaatccctgagaatcgtcttcccaggggagaatgtttatctttttcctttaatataaggcacgccattggcttttggcgcatctgcccgcccgataaagccggttaaagcgagaatcgttaagatataaggagccatcagcatatacacatttggtatgtctttaaaaagagggagcagcgatccaatgatgcttaagctttgggcgaatccgaaaaacagggcggcccccagtgctccgatcggatgccattttccgaatacaagcgctgccagggcgataaaaccttgcccggagatggtagagtgcgtgaaatcaagcgcaattgtggaggcatatacgccgccgccgagaccgccgaacaatccgctgatcatcacgccgatgtagcgcattttatatacgttgattcccatcgtatcggccgccatcggatgctcgccgacagaacggatacgaaggccgaacggcgttttgaacaagataaaccaggaaataaaggcaagtgctattgcaagaatagacgtataatagacatccgaaaagaagatctttcccaagacgggaatatcgcccaaaccggggattttcgtcttataaaaaggctctggaattttgtctgtctgcgctttgccgtagatcagtttgacgataaataaagttgccccaagcgccagcatgttaatggcgacaccgctgactgtctggtcggcgcgaaacgaaatcgccgctgccgcgtgaatcagtgaaaacagggcgcctgctgccatggcggcaaggagcgaaagccaaggtgcggcggcacctaattcctgaccaaaaaataaattaaataacacgctggtgaacgccccgataatcatgaggccttctaggccgatattcaccacacctgatctctcggaaaacacgccgccgagagcagttaaaataagcggggccgcatagacgagtgtggcagggacaatgatagataaaatctgcacaatgtccacttagttcgccccctttttcttcaatttgcccatgacgaaacgaatcgcatagcttgaagccacaaatagaataataatggcaatcacaatatcaacgacctctgatggaacgcctgattcaatcggcatatttaatgcgccgattttcagcccgccaagcaggcatgctgccagtacaacgcctacggctgtgtttcccccgagaagagcgacagcgataccgtcaaagcctacgccggtaaatgcgcctttcactgctgcgtattcgaatgtccctaggccctccatggctccggcaagacctgcaaaagcgccggagataagcatggaggtcatgatattcttccgcacgctcatgccggcatactgggaagcgtgctggttaaacccgaccgcccggagctcaaatccttttgtagatttgttgatgataaaccacatgataactgctgcgagaagggcaacgatgattcccaaatgcagccgtgagtaatcggtgatctgttcaagaaaaggagagcggagggaggcggattcgtgaattttccccgtcttgtcctgatgatctgtcaagacgtttgaaatgatgtaattggtcatgtgcagcgcgatataattcatcataatggtgacaatgacttcatgaacgtaaaatcgcgctttcaaaatgccgggaataaacccccataatcctcctgcagctgccgctgtaatcaatgcgagcggcaagtgaatatatgccggtccgtcaaacgccgtaccgacccaaaccgctgctgtccagccgacgagcagctgtccctcgacgccgatattaaagagtccggttcggaatgcaaaggcgacagccaatccggataaaatataaggcgtaatttgccggattgtttctccgacataatagatttctccgaatatcccattccacaaagccgaatatccgctagccacactgtagccgctcacaagcataatcaacgcgccggccgcaagaccaagtatgattgcgatgagcggcacgagtaaatgagagagtcgtttaaccatttgctttccccgcttccttttgcgtgcttcctgccatcaagagaccaagctcctgttcagtggtttcctgcggattaacgctggcgataatgcgtccttcaaaaataacggcgattctgtcactgagattcataatttcttcaagctcaaacgagaggagaagaacggctttcccggcatcacgctgctcaatgagctttttatggacaaattcaatcgctccgacatcaaggccgcgagtcggctgggcggcaattaataaatcaggatttcggtctatttcccgcccgataatcgctttttgctggtttccgcctgacaatgcccgagcgtgtgtatattcatccggcgttctgacatcgtactcagtgatcaggctgcgtgcttttttgtacatttcgcctttatgtaaaacgcccaatgctgaatacggctttttgtaatagctttgcagcaggatattctctccgattggaaaatcaaggacgagaccgtgtttatggcgatcctgaggaatatgcccgatcccggattcagtgatttttcttggcgtcaggttttggatctgttttccgtttaaggtgattgttcctgaatctgttttgcggagtcctgtcaccgcttcgatcagctcagattgcccgtttccgtcgacgcctgctatgccgactatttctcccgctttgacagaaagagacaaatctctgactgtctctattccgcgggtatcctttacagttatgccgtcaatcgcaagcacttccgctcccggctgagcagctctcttttcagttttgaacgatacctcacggccgaccattagactggcgagttcgtcttggtttgtatcacggacatcaagggttttgatgccttttcctttacggataaccgtaacgcggtcacaaatctccataatctctttcagcttatgggtgattaagatgatggacttcccttctttgaccaggttcttcataatttgcatcagttccttaatttcatgaggcgtcaaaacagccgtcggttcatcaaaaatcagaatgtcggcaccgcggtagagggtttttaatatttctgcgcgctgctgcataccgactgatatgtcagctgcttttgcttcaggatggatctgcaggccgtatcgatcggaaatgtcctgcacctcttggccagcacgcttccggtcaattctgccaaacttctttggctccttcccgagaataatattttcagcaactgtaaaggtgtcaacaagcataaagtgctggtgcaccattccaattccaaggtcattcgctttgttcgggctgttgatgtgcaccttctcgccgcgcacccgaatttcaccccgctccggctgatacagcccgaaaaggacattcatcaatgttgatttccccgctccgttttcaccgagcaacgcgtgtatttcgccttttttgacttgaagattgatattgtcattggcgacgatacctggaaacgccttgcggatattgagcatttcaatgacatattccattgattgaccgctcctttatttcaaaataaaagaaaaacaagggataagggctcgacctccttatccctgcgattcttattcagctttgaaggttttcagctctttctcagttgccgggatttccaatccgtcgatgatttttttcttccatttatcgaccgctttgatcacatcatccgatagattttgtttagatggagaaatgccgactccgtcttgatcaagcccgtaggtaagtgtttcgccgcccgggaactttccgtcactcgcttttttcgttacatcttcaacgactgtatctacttttttcaccatggaagtgagggtgacgttatcatctgttccttctacctggccttctgcgtattggtctttatcgacaccgatgacccagacatcgcgttttggatcttcttttttcaggtttttcgcttcagtaaagacgcctgtgccagtggcgcccgcagagtgataaataacatctacgcctgatttatacatgctttcggcggttgctttaccgacatcggctttatcgaaaccccctgcgtatttcacttctacaacggctttagggttaactgcttgcacgccggcacggaagccgacctcgaattttttgatcaactctgattccatgccgcctacaaagccgatttttcctgatttgcttgatagggctgcggccactccgacgagaaatgagccttcctgctctttaaacgtaatacttgcgacgttgtctttatcgacaacagcatctataatcgcaaagtttgtatttttacgctggtcagcaatttcgctgattgaatcctccattaagtagccgacgccgtaaattaagtcaaaattctcacgcgccaatttatttaagttcgttgtatagtctgcatcagatttggattgaagatagtcgtaaccgtttttgccttttttcagcccattctctttcccaaaggcttggatgccttcccaggctgattggttgaaggatttgtcatccactccgcctacgtcagtaaccatcgccacactgaatttgtttttgccttcgcctgagccgctgcttttttcgctgtttccgcatgctcctaatatggtgcctgctgcgatcacaagtgacatcgccaatccgatttttcgtttattcaagatataaccccccagaaaaatttggttcaaagctgatccggccagtcatgtgatgggctgtcctgaacaatttcttagaatcgataaaattttctgataataacaaatggaatgcgctgagacagttctattcttccctgaataagcgtggtgtgagtatttccttcgaaaggcggggaagagaaggatgcggaaggcgttccgggcggaaaaccgtgacatcgttttctgaagtaagacttatgacttagtttttcgggatcaactaaccaatcataatttatcatttaactaataagaaataaatagaatttcgcataattttttaaaaattatctatttttagaattatttgcttaaaaatgtgaaagccctttgttattcttgtataacttatcaacaatagaatcaagcatcttggcaagagatatgacagaaaaacgcactgctcaaagcaagcagtgcgttttcttatagatattgctttattccgttaatgttactgttgttgacgttgtactgaaacacaggtcttccgatcgttccgtacgccatttctacattcagaacctgtatatcttcaagaaactttaagtattttcgtatggatacttgagagatttctgtgtgctttgccaagtcttctgtcgtaaaagattcattttcaaatgactggatactggaccagatcagcttcagcgtgctttttgtcaggcctttaggaagctgcactttttctgttgcttctttcttttgaaaaagctcggcgtccagttctttttggctcatgttgcgatgggttgaatacaccttttgttttcgtctgtaatcagacagagccgtttggaatcgttcaaattcaaacggtttgattaaataatcaacagctccgtaccgaagtgttttcttgatcacgtcaagctcgctggccgctgagatgacaatcacgtcaaccgcttcattttgggctctcaattccgtcagcagttccagcccgttttttcccggcatataaatatcaagcaaaatgaggtcaatatggtgctcccctaaaatatgcagagcgctttgaaaggaagaagcgatgcctttcagctgaaagccatctatttggcttaagtatcgtttatttaattcacccaccatggggtcatcttcaactattagtacattaatcatgattttcctccttcggttcgtacgggatgcgaatactgaatgtcgttccttcattcttttcgcttgtgaggatcatttggccttttaaattttcgatgctttgctgtgtgaaataaaggccgaatccccggtttttgccctttgttgaatagccttgttcaaatactttggcttggtcttcttcagacatgcctgctccagtatcggtaatttcaatatcaagtatgctgttatggaagcgcatggacatggtgatttgttttttcggcatatcggcaacggcatctaagccattgttgatgagatttccgatgattgtaataagttcatggatgacagaagggtctgccgcgttcgggatgacaccgttgcattcaatatcaagatttgcgccctgctcacgtataaagctttgctttccaagcagaaaaccggccagtacggagcttttgacatcatttataatttcacttgtttctgatttttgctgtatggctatatctttaatataatctccaagatcatcatactctttcagctggacgagacctaatatcacatgcagtttgttcataaattcatgagactgcgctctcagtgcgtttgcatacattttaacaccggaaagctgttcagctaaatgttttacctcggtcttgtcgcggaatgttgcaatcgctccgacagtttgtcctttcagctggataggaacttcattaaacacaagctccagcccgttaatgcggacgtctctgtcttgaagaggtttttttgtctcaatgacctttttcaagcggcttttcggcaagatgtcatctacatcctgatcaatgggatttgtgttgatgcccattttgacgaataggcgttttgcttccgcgttggcaagtttaattttgccatgttcatcgacagcgagtattccttccttcgtcgattccagcatcgcgctccgttcttcaagcagagtcgcaatttcataaggttcaagtccgtacatgatatttttcactgtacgggcgacgataacggctccgatcacaccgacgaagatgctgacgcaaataataaagtaaagcggccgtaagctatggctgatcacttcatcaatttcatttacggtgatgccgaccgcgactgcaccgacctgttttccattctccgcgtagacagggacgaacgctctctgcgatttcccgagcgtgccagaggctgtgctgatatggacatgcccttttaatacctcggactcatcaccgcctctgaatttttttccgattttgctcgggtcaggatgagttttgcggataccgttcatatccatgacgacaacaaattccgtgccggtaattttctgaacccgctttgtgtagctctgcagttccttttgtttttttccgctttctaaagcagcggctgtcatcggcgcttcagctaccatttcagcagtctgcagcgcagtggccttttcctgatctctaattcgtttggtggtttgggcaccgactgtaaaaaacgtaatgagcaatgcgattaatacaacgatacaaacaaatatggtgagtctggtttgcagttttaatgtttttttcatataaaacttccttacgttttatgattcctgcgtactactttactctcaaaatgctgctttgtgaagatttgggcccgtaattcgtaaaaaggagaaaaaatggaataatttatcttgtcaatgtgttttaagtcctccataataaatgaggtagattatagaaagggacttttttatatgaaaaatacttatttgacaggatattttccgctgattgcgatcctgctttttagttcgtccttatccatctcaacttcactttatgcgttgaagatgctgtcttcatttggaatgtatgatggaatgctcgattatttttcagagaaaggaatcaggcttgcgttatttgctgcctttgcacttttatattttatggttctgtccgctctgaaattaattgcaaataccgtgaccgagctgtcattgctgttttttgctaatgatccggaagggaacaacctgaaaaaactcagaatgggttccatgatttatttgggcggcgggattttatcctttgtgctcttgcaaaatgtcatttggattgtgatctggtttgcggtcgtcacgctcgcttactttgtgtttaccgtataccggatttattcgacgctttctctcatgtcattagttggattcattctattggaactgctgttttggtttacctttgttatcggtattctgttcatatttatcaagctttataatagcataatggctagcttacctgtgtaagctagccatttcagcgtttggtggtcagatttgcgcttcgtgctctgtacgcaatgaaacggcggctagattctcaggtttccgccgtttcacaacttcaaaagttttcaatcacgctgaatagatgacaaaatcctaaaacgaagccgttttaggattttgtcaacaatctgtgatggctagcttcctagccattttttatttacggtaaaaatctttttttaatggaaggggaggggagcatacattcattttttttgccaaaccacttatagcggtttttggcaatgaaagaatagaccatatctctgacaggcttcggcactgcgaaaaaaaggacgaagagccgccatgggcctcgcagatgcctgaaaaccttaatggctgcagttgactttgtgtacacttggccgtcttcaataaagacaaagctgtcaaaccgatcagtcggaagcccgctttttttcagcaggctctgtcctgtttccgactgcagcgatgtgaaagaaatcaatccgtccggatcacgtttaatgataaactgcacggcgccattgcataaattgcagacaccgtcaaacagcaaaacgcgatttggaatttgttctgaagtcactccatatcccctccgatcctttaataagccgcttgcagcgttcctttccagatggaaagctgagggctgatgctgtgaagatattcaacgctggtcggtgtatcctttccgacccagacacccattgtatacgtatcagtcaggccgacaaaccacatatcgtgataatcatttgatgttccggttttaccgccgatgtaaggcgcattgaaatatgcttttttccctgttccgcttttcacaacggaagacatcagttttttcagctgcatgttcgtgcggacgctgaatatttgagtcgctttatcattccatttataaagtgtttttcctttaaggtctgtcacctttgtaatcgcatggctcggcgtatagcttccgctgtttccgaatgtcgtataagcctttgtcatctcaagaggcgtcatgccgtttgtaaatccgccaagcgccgccggaagaagatagtcactgtcgacaagtttggcaaaatgatacggctcaatataactgaatgccttttggatgccgacgcggtcgagcattctaatagccggggtattatatgaatttttaaacgccgtatcaagcgtcactgtgccgtaagtgcggttattgtagttttgcggacagtagtctttgctgcaaaacttgctggcatcaatggtgctgcttgttgtcgcgccggtctgttcaatataagggccgtaatcaagaagcggcttaatggatgaacccggctgcctgtacgcctggtaggcgcggttaaagtcatatttttgatagtttttcccgccggatagagcaatgatttgatgcgtctggtgattaatcacagccgctccgccctgtacgtccgcatacgggagcttggaattcatttgtgccacaacttgattttgcatgtacggatcaagtgcagtataaattttcactccgtctttcatcagcgtgctgactcttgcggacagctcgttctcgatcttttctttttgttttcctgatgctttttgaaggcgtttatcaaagccttctgattcagacaccagctgagtgaattcatcattgacgtaggaaacgtagtcaggatatttgtcttctcttttttcaacatccagtttgattttttgttttacggcttttttcagctctttgtccgtaatgaccccggcatcttttagccctttaagtaaacgttcttgacggcttttcgtgtagtcaaaatgcttgagaggatcatataatgtagggttattaggtatagcacagataaaagccatttctcccactgtgagagatttcagcggtttgctgaaatagaattgagctgctgaaccgacgccgtaaacaccgttgttgaaataaatggtatttaagtaagcttcaagaatttcatttttcgtatattttttctccagctgataggaatacgcgagctctgtcagcttgcggctgaaggagcgttcgtggctcaaatacaagtttcttgaaagctgctgtgtgatggtgctggcaccctggtcaattttcttgtcttttacgttagaagcagtagcccgcaccattcccataaagtcaaagcctttatgctcgtaaaaatggcggtcctcagatgttaagaaaatctgtttgacttcctcgggaatcttgttaaatggaacgagcacacggttttcgtggtcgctgacgatttccgagacaagggagccgtccctgtcatacatgtagctgttctgaacaaggctgatatctttcagatcaatatttttatcaagcacctgatccagggacttcatttgttttacttcttttccggaagcgataactgtaaatgcaaacaatgggattatgcaaaggagcaaaatccatccgattatttttcgtaacatggtcactctcttttctcctaaattctagccatatcgtaccattcttttgagattacgagaaggttaaatttagaagattccttagttttttctcggaatcagcttgctttggcataagaatctttccgaagtttctgcatgatccaaagcatgcaggcgccggcgaaaaagagaaacgccgtgacgtaaaaggtggccgaaatggtaaaatggctcgatatgattccgccgagcagaggcccgagcacgtttcctaaaaagcgaaagctgacattgtagccgagaacttcaccttgaatgctgccgggagcctgaacgcggatcgctgccgtaatgcatggcagcaaaccgcccatcgccattccgaataaaaatctgaaaacaaggagcacgctgagtgaggacgcgagcgcctgcggaataaaaaagaaagaggcggcgagcaaaagtccgattaaaatgcggcggtggccgtagcggtcgcccagatcaccccattttctagccagcagcaaacttccgagccccgttgctgaaaatgccatgccggagaaaaaggcaagattgacaggtccgtgcagctcatttacatataaagcgagcaggggctggatactgaaattgcctgtttgaatcagcatggttaacagcatcatgacccacagcgccggatggtgaaaaatataggagagcacttcttttctcgagtaagacgtacgtttggctgttttctctgcaagatgcttttctttgacaccaaataacacgagaagaacagacgagaaaatcacaaaggatgtgataaaaaaggtatacgtaaagccgaaacgatcagcaagcatgcctcccaaaagcgggccgaacaagcttccggacacttgccccatttgcagcgtgccgagtgttttgccagctgagctcttcggagtctgtgccgaaatcatcgcaagagatgtcgggatgaatccggttacaagacccattgccatacgcagaaaaaacaattggtacaccgatgtaacaaagcccatgaagaaaatgctgagggcaatgcctgttccggttgccataaggattttcttgtatccgcgtttgtctccgaaccgtccccaaaacggggataccaaaaacgccatgagaaatgtaatgccgaacacatagccgctccacctttgcacaaagccgtttgaaaaagagctgagcgtctcaatgtataaggagagaaaaggaacgatcatcgttgtgctagcggagacaaaaaagttcgccagccacacaatgacaaagtttttcttacggatagaaataacatcaccttcttattatttcgggttccttactaattataaagaaacgattcacaatttaaaagaaacgaagcggctgggaaaattcattatttttagaaaatgaagaaatgtcgagaaggggaattgatatactataaagatagcattttctgatcggaggaaaggcaggtgtaaaaggtgacgacaaacagcttactcattattgatttcgaatttacaatgcctgatggaaagtacagtcctcaaaacttcttcccggaaatcattgaagccggaattgtaaagtcgattgatgatgaagtggttgagacgttttctagctatgttagaccgaaaaagttcccgaagcttacgaaacgctgcaaatcatttttaaaaataacccaaaaacaggtagacgaaggaatgagattcgaggatttcatccgtaaactaaacgagctggatcctgagaaaaacagcacaattattacgtggggaaacatggatatgaaagtgctgaagcaaaactgtatgtttaaccatatccctttcccgtttaagggagaaatgagagatttatcgcttgaatacaaaaacttttttggagaccggacattgacgggtttatggaaagctgccgaagagtatggagattccggaaccggcacccatcataaagcgcttgatgatgctctcacagcatataaactttttaagcttgttgagcaggataagcagtatctcgaaaagccaaaaccgcccacaatcggcgagagaatcgatttaaccgaactgttgaagcgcgcgacgtaaaaaacccaatcttttgtcagactgggttatggccggttaaaatattctttttctaaaatgtccagattatgaagggagcgctttgcccactccgaaccatcctcattcaatttggctctcatctgtgctgtcgcctcccgcagagattcggtataatccggcacttcaccgtcataaggcttcaccatatggtgggggatattggtctgttcaccatatgcgagcgcttttctctcatgaaaaaatggcacatccgcctgttttggatgatgaaggtctccctgagcgggatgggtaagaaccgctttcactttcactaaataatgctgcggcctgcaagccgtgatttctcctatgtatacacctgttttgtaaaatcctttaacgatagagcctgtctcaaacgtgctcatctgtcatcacctcgcatttattctattaaagttccaatcgatttgctagtgaggaagatcagcgggaagcttaatggtcaccgtagtgcctttttggaagctgctgttaaatgaaatggtcccgtgatgatgttcaataatggaaaaggttacggtgaggccgagtcccgttccgttcgtttttaaggaataataaggttcgccgagtttttgcatttgatggtctgtcatcccgaccccattgtctgtgatgttaatcatgatcgtatggccgtttcttttggctgatatgtggatcatccccttcccgtgaggaaccgcttcaatactgtttttcatcaggttgatgacagcctgcttcagctttgttgcgtctccgtatatcaaaaggtccggttctgtttcagcctcgacggttactgacttgtaattggcgtacgacaccataagggagcttgtctctttgataagggcagataggtcaaaaacctctttttcgtataattgctgtttggccatatcgagatagtttgtgataatgccttgcgcccggtcaagctctgacagtacaagctttttgtaatccgcactcgacttgttttgtagggtttcgtcattaaaaagcagctggacaaacccgcggacaactgtcagcggattcctgacctcatgggcgacgctcgctgccagttcactcacaatcgtcattttttcagaatggataagctgtgaacgcagggcgatattttcggcgatgctttcgataatatagatgcttaatagaagaacactggagcggaaaagccctgagactgccgcctcgtaaacgaaaattcctgatttttgaaaatttaaaatattcaaggcggaaagaatccagcttgaggcgaaaaataggaaaatctccacgcagctgatcaataaagacagcagcagttttttcgctttggacatgaatggccattttttctgaaataagattgggataatgataagaaaaggcagcaaagtgaaaacaaacattgcggaaggttcgtaaaaaagcagttcaaaacataggacagatgcggcgactgtaagtccggaagcggtactaatgtaaaataaacaaatgataacgggaatcatctgaaggccgtattgtatgtagtccatttcatgaatcgggaaaataatgcataaaacggaggcgccgcaggcgaagagcgtgaccaaaccgctgtttatttttggcacaagaatcgcaggttttccaagccaaaacacttggtaaagaagaataggaaacaaaataaagcagatgtgcagaagatagtcttttagaatttccattcgtgtgaaatcctttcgtataaaatatgaatctattataacactaaatattagaagtaaaatataaaattcctttattaagaacgcctttacaaatgaagacgtaaaggcgtttacagctatatttacgataatgcggctttgatgcggcgcaggccgtcctgcagggttgcaagagagcatccggcgttcaggcgcataaatccttctccgccaggcccgtatttcgtcccgggctctaaaataacttttccttttttagcattctttgctgaagctctgcatcggacaagccgtaagcgctgaagtcgagccaaatcaagtatgatgcatccggcttcatcattttgacctttggcagctcggtgctcaaaaaggcttccgcttcgttcatgtttttctcaatgtaagtgatcaattcatcaagccacggtccgccttttgaatacgcggcttcgattgcagtgacggcaaacgcgttcagtccgcctaaaccatttcgctgaaggcttgcggaaaacttggcgcgcttcaggcgatccggaataatgatcgctgaagcctgcaatccggcgatattaaatgttttgcttggagcagcacatgtcacggaaatatcagcgaaatcgtcagagagcgaagcgaacggcgtgtgtttatgtccgtacagcattaaatcggaatggatttcatccgatacaactgtgacgccatgctcaaggcacaattcgcctagcttcagtaaatcttcccggctccatgaacgcccagaagggttatgaggattgcataaaataaacaatgtaacgcttgggtcactaagctttgtctccaaatcttcaaaatcgattgcatatgcgccgtctttttctagcagcggattatgtaaaatgtgccggccgtttttctccaccatatggtaaaaaggcgtataaactggaggctgaacaactacttgatcgcccggctccgtaaaagcttgtaccgccatgctcaaagctgttacaacgccggggctgaatgtgatgctttccggatttaccttccagccgtgcctgttttgcatccatccgcacacagcatccttcgttttttgatctggagttgtataaccaaaaataccgtggtcaagacgctcttttaacgcttcagttatcgcttccggggcgcgaaaatccatatctgccacccacatcgggagggcgtctgtcacgccaaataattcgcctgttttatcccatttgaccgattgggtgccaaggcgttcttctcgtttatcaaagttcattctgttaccccctcatgtatgtttattcttctaagcttcactatgataagatagaactgcaaattttattataagcggtgatgaatatggaagaaagtcatgcggtcagggaaatgattaagatcattgccaaatgggacccgtttaaatatggagaagagttttacgaaacggaggctgttgatgtcgtgcaggcagtctatgatgaaaacgatcccgacttgctggcgaaaagcattcagcaaatatttgaaacttcttttgaacaaacgctgccgatcgccagctgccgggaagtggctggccagcttttattcattaaaaacagcagctcctgcacgccttaaaaaaaccggttcagcaccggtttttttgtatttgataaaatcagcaatgtgttcagaaataagttcaggccgttcttcaggcaccagatgtccggtctggccaagtgagtacagcacggaattaggcaaatctgcgtgcagccgtttaccgatctccattgggacaattcgatcctcctcgccccaaatcaatagagcaggcttgttcattttcttcaattgctcgggttctaaatctccttctctgtggcggataaaccttgtcatggctttgaaaatctgctcgtcctgaaacggtctgccatagccgtcaatcatctcctcatcaatcagcgatttgtcatgcaccacatttaataaatttttcatcacgccttctttcgagagccagcgtttgatgtaaagatgaaaatacgggatatgggtcccgaaaataatcgtcgggtgtgaacgttttaaataccctgaactgcaaagcagcacaacctttgaaaaaagctcaggtttttggagagcagcagacagcgatatctgcccgcccatagaatgcccgacaagcacagcctgtttcacttgcaagtgctccaaaatcccaatgacaagcttagcaaggttttgataggtatagataaacgttcttgatttttcagattggccgaaaggaggcaaatcaagcgcgatgatgtcgtacttgtcccgaaggagaggaattacttttctgaagctgaatgcagatgataaaaaaccgtgtacgcagaccagcgtttgcctgccgggattttgataatgttcgtagtatacattgactccatcgaccgtaaaccgccttattggtgaaaccgcctccattctgtgtcactccctttttttgatggttgtattatgccctgaaattgtcaattctagcggaagtttctcctcgttttttcttagcattcgtcaaaaaacgtgatataatgtcatgagatttcttgacattgcaaaggtgtgaatcaaatgaaattgacagaaaaagaaacagaaatattagaaattttagacgaaaacagccgcgccgatttagaaacaatcgcaaagatggcgggcatccctgtaaatgaagtgaaaacaattattgacaaactggagaaagaaaaggttattatcgattattccgctatgattgactggcgaaaagtcgacggacatgagggcgttacggccatgattgacgtcaaagtaacgccgaagcggggcgtcggttttgatgaagtggcggaacggatttaccgattccaagaggttgaatcagtttacctgatgtcaggcgtatacgatttgtctgtcgtgattcgcggcaattcgatgtctgacgtagcgcgttttgtttcggataaactctcaacgcttgattcagttgtatctacgacaacccattttatcctgaaaaaatacaagcatgacggcaaagtgtttgaaacaggagacgacgacaaaagaatcgtggtgtcaccgtaaatgacttcgtatttatcagactatgtacaacaaataaaaccatccggcatccgcaaattctttgatttggcggcaacgatggaaggcgtcatttctttaggcgtcggcgagcctgattttgttaccgcatggaatgtccgcgaagcaagcattctctctcttgaacaaggatatacgtcatacacggccaatgcgggtttatactcattgcgggaggaaatcagccgttatttgagcaacaggtttgaccttagctactcgccagataatgagctgattgtgacagtgggggcaagtcaggctttggatattgcgatccgcgccattgtgaatccaggtgaggaagtcatcattcctgagccgtgttttgttgcgtacgatgcgcttgtttctttggcaggcggtatcccggttcacgttcatacaacggcagacaaaggatttaaagcaacggctgctgattttgaagcggcagtcactgaaaaaacaaaggccattctcatctgctcaccatcgaatccgacaggttcggtttattcgaaggaagagctgaatgagattgctgagtttgccaaaaaacatgatgtcatcgtcttagccgacgagatctacgcggagctgacatatgatgaggaatttacaagtatagcggcattaccgggaatgaaggaacggacggtagtcatctcaggcttttcaaaagcatttgcaatgacgggctggaggctcggttttgccgcggcaccatccttgcttcgggatgccatgcttaaaattcatcagtatgcgatgatgtgcgcgcccgcaatggcgcagtttgccgcccttgaaggcctgaagaacggcatggaagacgtagaaaaaatgaaaaaaagctatcgaagaagacggaatctgtttgtagaatcgctcaatgaaatcggtctcagctgtcatcatccgggcggcgctttctatgcttttccatctatcaaaagcatgggaatgagttcagaacagtttgccgaggagctactgacgcaggaaaaagtggcagttgttcctggaagtgtgtttggtccgagcggtgagggatatatccgttgttcatacgcaacctcgattgaacagcttcaagaagcgttagtcagaatgaaacgcttcctgcacaaaacaacataaaaaaagatacgaaccttttgttcgcatccaataaaaggggggaatactagaaagcctttggtattttcagtttaccccctttttgctgtgcataaacctgattttttataaaaaagttttctttgcggaaataagacatgtgtgatataattttaaattgcgtataaacagatatttaatttaacttaggagttgttatgaatggcagcaaaatttgaagtgggcagtgtttacactggtaaagttacaggattacaagcgtatggtgcgtttgttgcattagatgaagaaactcaaggtttagtacacatttctgaagtgactcacggtttcgtaaaagatatcaacgagcacctttcagttggcgacgaagtacaagtaaaagtacttgctgttgatgaagaaaaaggcaaaatcagcctttcaattcgtgcgacacaagctgcgcctgagaaaaaagaaagcaaaccaagaaaacctaaagctgctcaagtaagcgaagaagcttctacaccacaaggtttcaacacattaaaagataagcttgaagagtggatcgaaatgtccaaccgcaaagaccttatcaaaaaataagcatgaaaaaagcaccggacaggaatgttcggtgcttttgatttcatgcaaaatcctatttcagcgtgattgatatcctatcgcatttcaggatttgctgcttcttcacgtgatctttcctcgtttggcttaaatagcagaccgaggttgattaagccggcgattccgacaagtccgtaaatgattcgggaaagagctgacccttggccgccgaagatagccgctactaagtcaaattggaaaaatccgatcagtccccagttaatggcgccaatgatggttaatacaagacaaattctttgaatggtactcatgttttgcaacctcctccatgaattattaaaacagttatagattgtgacatattggagaatctatacatgcattctccatatgagggaagctggcctgccctcgcttatatcagcttctttcccagcaccttgcaaaataaaaccatctggtatgctgatcggtgagagctgattgctttacatgtggtgaggacattctgcataataaaaaatctaaggaggagatgtcatgcaaaactttacatactggaatccgaccaaattaattttcgggcgcggcgaagtggaaagacttccggaggaactcaaaccttacggaaaaaacgtattgcttgtgtacggaggcggcagcattaaacgcagcggcctgtatgatcaagtgattgaacagctgaataaagccggagcgaccgtgcatgaattagcaggtgtggaaccgaatcctcgtgtgtcgactgttaataaaggtgttgccatctgtaaagaacaaaacattgatttcttgctggctgtcggaggcggaagcgtaatcgactgtacaaaagcgattgccgcaggagcgaagtatgatggtgatgcgtgggatatcgttacgaaaaagcatcagccaaaagatgctttgccattcggaacggtattgactctcgctgcaactggttcagaaatgaactcaggatctgttattacaaactgggaaacaaaagaaaaatacggctggggcagcccgctcgtattccctaaattctcgattcttgatccggtgaatacattcaccgtacctaaaaaccacacgatctacgggatggttgacatgatgagccacgtattcgaacaatacttccatcatgtatcaaacacgccgtatcaggaccgcatgtgtgaatcacttttgcgtacagtcattgaaacagcgcctaagctgatcaatgatctcgaaaattacgaattgcgtgagacgatcctgtacacaggaacaatcgcattaaacggcatgctttctatgggggcaagaggggattgggctactcataatattgaacatgcagtatcagccgtttatgatattccgcatgccggcggactggcgattctgttcccgaattggatgagacacacattgtctgaaaaccctgcccgcatgaaacagcttgcagttcgcgtgtttgatgttgaagaagcaggtaaaacggatgaagaaattgcccttgaaggtatcgataagctgtccgcattctggacaagtcttggcgctccgaaccgtcttgctgattatgatattaatgatgagcagcttgacacaatcgctgacaaggcaatggctaacggtacattcggccaatttaaatcactcaacaaagaagatgtgctgtcaattttgaaagcatcactataaaaaaaggggaaatagccgtttggctgcttccctttttcttttttgtcaacttatgttacaatggaaaatctgttttttaccagcatcatttggaggttttactatggaaaatttcacttattataatccgacaaagctgatttttggaaaaggtcagcttgaacaattaagaaaagaattcaaacgatacggcaagaatgtactgcttgtttacgggggcggcagcattaaacgcaacggcctttatgatcaagtcacaggcattttaaaagaagagggcgctgttgttcatgagctgtcaggtgtagagccaaacccgcgtcttgcgacagtggaaaaaggcataggactttgcagagagcatgacattgattttctgcttgctgtcggcggaggcagtgtgattgactgtacaaaggcaatcgcagctggcgtcaaatatgacggtgacgcttgggatattttcagcaaaaaagtaacagcggaggatgcgctgccgtttggcactgttttaactcttgctgcaacagggtctgaaatgaaccctgattccgtgattacaaactgggaaacaaacgagaaatttgtatggggcagcaatgtcactcatccgcgtttctctattttagaccctgaaaatacgttcaccgttccagaaaatcaaacagtatacggcatggttgacatgatgagccacgtattcgaacaatacttccataatgttgaaaacacgccgcttcaggatagaatgtgctttgctgttttgcagacggtcatcgaaacagctcctaagcttcttgaagatctggaaaactacgaacttcgtgaaacgattttgtatgctggtactattgctttaaacggcacgctccaaatgggatacttcggtgactgggcttctcatacaatggaacacgctgtttcagctgtatatgatattccgcacgcgggcggtttggcaatactgttcccaaattggatgagatacacgcttgatacaaatgtaggccgttttaaaaaccttatgctcaacatgtttgacattgatactgaaggcaaaacagataaagaaattgcgcttgaaggaatcgataaactgtctgcgttctggacaagcctcggtgcaccttctcgtcttgctgattacaatattggagaagaaaagcttgagctgattgctgatatcgcagccaaggaaatggaacacggcggcttcggcaacttccaaaaactgaacaaagatgacgtgcttgccatccttcgcgcgtctctataaacccaaagggcggaatccagtcattccgccctttcttcttgacttgatttcacagataagttcatataaagtgaaagatgaaaacattataccgttatggagggacaagcaatgacgcatgtacgctttgactactcaaaagcgttgactttcttcaacgaacatgaacttacatacctgcgggactttgtaaaaacagcacaccataatatccatgagaaaacaggcgcgggcagcgattttctaggctgggtggacctccctgaacattatgataaagaagaattcgcgcgcatcaaaaaaagcgcggaaaaaatcaaatctgactctgatgtcttgcttgttgtcggcatcggcggttcttatcttggagcgcgggcagcgattgaagcgctgaatcacgcgttttataacactttgccaaaagcaaaacgcggcaatccgcaagtcatttttatcgggaacaacatcagttcatcttatatgagagacgtcatggatcttcttgaagatgttgacttctctattaatgtgatttctaaatcaggtacgacaactgaacctgcaatcgctttccgtattttccgcaagcttcttgaagagaaatacggtaaagaagaagcgaaagcgcggatttatgcaacaactgataaagagcgcggcgcattaaaaacgctttctaacgaagaaggctttgaatcattcgtaattcctgacgatgtcggcggccgttattcagttttaacagctgtaggtctcttgccgattgctgtcagcggcgtcaacattgacgacatgatgaaaggcgccctggatgcgagcaaagattttgcaacatctgaactggaagataacccagcataccaatatgcggttgttcgcaatgtcctttataataagggcaaaacaattgaaatgctcatcaactacgaaccggcgcttcaatactttgcggaatggtggaagcagctgttcggagaaagcgaagggaaagatgagaagggcatttatccttcttcagcgaactattcaacagaccttcattctttaggccagtatgtacaagaaggccgcagagatttattcgaaacggtcctgaacgtagagaagcctaaacatgaactgacaattgaggaagcggataacgatcttgacggcttgaactatttagccggtaaaactgttgatttcgttaacaaaaaagcattccaaggtacaatgcttgcccatacagacggaaatgttccgaacttaatcgttaacattcctgagctgaatgcatatacttttggataccttgtatatttcttcgaaaaagcctgcgcgatgagcggttacctccttggcgtcaatccgtttgaccagcctggtgtagaagcgtataaagtcaatatgtttgcgttactcggcaaacctggctttgaagagaaaaaagcagagcttgaaaaacgtctggaagattaatgtgagaaagctgactggcatttgccggtcggctttttataaaatcagaaaggtgctgatgttcatgaaacaattggttaaacatctcatcattgccggtttttctgcagctattttaagtttccttatctcctttgatgccgtgtatacagggttttcttcaagctttggcggcacgctgtcacattttttcatccactcctttcttctcattggtttgccgcttgccctttttaccgatgcggtacatcggattttgcatttaaaacgaacccatactcttttcactaaattaggactctatgcaacggttgtttatgtgtcttgggattcagctgtatggcttgcagcggcaatggctgtttacttcttaattgaatgcgctttctttcctgttggccgcgcgaaagaaacaacgatttccatgtaggcgcctctgaatgaagtcttgttcggcgggacaggataagtgaaaaaaggggcattctgatgataccaataccttccgcgatagatgggcagtcttttctgcttcaagaactggaacaagtgatgaagccgctcggttatgtgataaacggcggctgggaatacgatcatggctactttgattataaaattgatgatagagacggctatttatttttaagaattcccgtcaatgcggtacagggcagtctcgatgaacgaggggcggccgtccggatcggaacgccatttatgctgagacaggtgtttcaggcggatgttgacgatcacgccgagggagggcctttccaatcactgtttaatcaattttccgaaccggaaaggcgggacgcggaaattgatccggcatttttggatatcggcgcctctctcgtgaaagaattggaggatgttctgttacactagatggcaaggaattgatctgtttcgagcaccttgtatgtaagaggaggggaaagcatcggcccctcctttttttgtatgcctataattgttgtgttgtgatcaaggaaatagagaacacaggttttgtaagccgctccctttagttcgtcaggaacagcaagaagctccacatgctgatcaagtgtcagcttgattccgttctgctgtttagacggccgtaacttgacttggtaatgctgcagcatcgcccggctgataaattctgaagttccgatgatttggtttgcgcctgcccgttccgcattggtgacaaaacggtcagttaaaatctcgacgatgcagtaagcaaggggattaagacctttaacagataaaagagtcagcactgacagcatatcagcatcagtttcacttttatactgatcggcagtaatcatcactgattccgcttcagtaatattggcccgtttcagtgtcccatcatcggcagcgtgcccgcgtatgaaatgaacgttttcaataagcgggccttctgttaaggattcatcgattagtacgactgttttggaaggggcggcaagctgaaggtccttcaaaagccggtttgttttttcattccacccgatcagaatgatgtggtcccggcctttgtaagcaacttttccttcaatgtagcgatgctgtctgctgaatgcggccgctgataacgtagcgaaatacgctgtgacaaagcttgctccgctcaaaatcagcagtattccggctgcctgtcccagcggagtgtgcggcacatagtctccataaccgactgtagaaaccgtaacgacagcccaccaaataccttcgaataccgaagtgaactgcttaggctcaagtatataaatgatttggccgaacaaaagaatcagacataaaataataaccccgattcggataaataacggccacctgagccatgaaataaatatccgatttgatttcattctttttctccttcttcagatactgagatggataaaatctgtttaataattgtatttaatttctcatttagcttttcctggccgtacatatctcgggcctgcttcattaactcggctgtatcatcatcaagctgaataagcggttcatcaatttccgattcattatacagctggataaacgcgtccagtccttcattcattcggtcgattgctgtgctcagctgttccttttcctcactcgtcactttcatagcttccatcacacccgtgcttttttctaacagtatgtcccacttccggtgatgtttttcaaaaaatgtacaaaacatataaaaccggatttctccataaactaaaacaaaaaggatgaaaaagatgacgatctttcaaagaacgatcgtggttttaatcggtacgcagctggcggcatccgcggtgattttgtttattttcgatttgaattcatataatcacttttccggaagcttctcctggcttcattttctgaaagaactggccggcagtttcgccttttatttgttttcagcaggcctgttctttttgctgattggattgtgtgctccaagccggaagaaaaagcgcatttctgtacacgagaaagaaaactcattaaaataatcgtaatagagaaatgatcatgaacaaaggatgatgaaaaaatgctgtttatatttttaacaatagccgcattgggattgtcgttttgggcacaatttaaagtaaagagcaactttgaaaaatattcaaaagtggaagcctcaagcggacgtacaggggcagaaacggcaagacggattttagatataaacggtctttacgacgtgccggtcgaaccggtaagaggcactttaacagaccattacgacccgacaagacgggtggtgcgtttatctgagccggtctattacggccgctcaatttccgccatatccgtagcttcccatgaagtcggacatgccttgcagcatcaggagtcatatggtgcgcttgtgctgagacataaaatcttcccagtcgtgaattttgcatccggtgtagctcctttgcttttcttaggaggcatgcttctcggcagcctgaatttgatcgggcttggcatcatactgttttcagcggctgtctttttccagctgattacattgcctgtcgaattcaatgcaagttcacgtgcgaagcagattattgtgtcagaaggattcatccgaaacaatgaagaaaatggggtaaataaagtgctgagtgctgctgccttaacgtatgtggccgccgccctggtttccctgtttgaactacttcgttttgtgatgattttcttaaacggtcgtgatgagaattaacgttaaggaggtggccccttaccatttatggtaagggctttttttgcttattttacaattgatcgccatttttgttttgattggcattacggctgttttcgttgcagcggaatttgcgatcgtcaaaatcagaggttcaaaaatcaatcagctcatcgaaagcggtgacagccgagcactagccgcacataaaatcatctccaatcttgacgagtatttatcagcctgccagctcgggattacgattacagccctcggccttgggtggcttggtgaacctacatttgaacgttttcttcatcccttatttacaatgacaggcataccggaaccgtttaaccacattgtcacatttgtagttgcatttatcatcgtcacttttttgcatgtggtgatgggggagcttgccccgaaaacggtttctattcaaaaagctgaagctgtaagcttatggattgcaaagccgctgatctggttttataaaatcacgtacccgtttattaaagcattaaacggctctgcaagttttcttgtgaaattgtttggctttcattcggtaaaggagcatcaggttgtcatcagcgaagaggaactaaggctgatcctttctgaaagctatgaaaagggagaaatcaatcagtctgaattccgctatgtaaataagatttttgaatttgacaaccgggtagcgagagagattatgattccgcggacagaaattgcggttatctctctggagcagtcgcttgaagaggcaattcatcacatcattaatgaacggtatacacgctaccctgtcatcaaagatgacaaggatcatattttagggatcatcaacagcaaagatatgtttaaagcttattttctcggccagccgataaagctgaatcaaatcatgaggcccgttatcagagtcattgaaagcattcctgttcagcagcttttaatccgcatgcagaaggagcggattcacatggcgattcttgtcgatgaatacgggggaacggcggggcttgtcactgtagaggatattatcgaggaaatcgtcggggaaatccgcgatgagtatgatcaggatgaaacaccgcacatcctgaaaaagggcgagcaccattatgtgatggatggaaaagcgctaatagacgaagtgaatgaccttctcgacattgcgattgaaaatgaagaaattgatacgattgcaggctggcttctaacgcaaaaaatggagctgaaagcaggggatgtgatacacgcggagggctgtgaatttaaaatcctcgacgccgaagatcaccacatccgttttgtagaaataaaaaaactgatttttgataaaaaacagccggggaacaaacggctgttttttgtgtcatcaagtcatttcttaaaaagcaatgctgtaaagacctttttctacataggatatataagaacggtacactgggaaggagtggctgtatgaaaaaggcttggtggaaggaagccgtagtttaccaaatttacccccgcagttttaaagattcaaatggcgacggaatcggggatattcaaggaatcagaaccaagctttcttacataaaagagctgggcgctgacgtcatatggatttgcccgctgtatgattcaccgaatgccgataatggctatgatatcagggattatcaaaacatattaagcgagtttggcacgatggaagattttgatgagctgcttggtgacattcatgatctggatatgaagctgattatggatctcgttgtgaaccacacaagcgacgaacatccatggttcatagaatcccgttcatccatacactcggaaaagcgcgactggtatatttggaaagacggcaaaaacggaaaaacgcccaacaattgggaaagcattttcggcgggccggcttgggagtatgatcaaaagacaagccagtattatctgcacctttttgataaaaaacagcctgatttgaattgggaaaatgaaaaggtgaggaatgccgtttatgacatgatcaattggtggcttgataaaggaattgacggatttcgggtggatgccattacgcatattaagaaaaaagaagggtttcctgacatgccgaatccaaagggactggactatgtcccttcctttccttatcatatgaatgctgacggcattatggatttgttaacagagctgaaggaaaacacattttcccgctatccgattatgacagttggtgaagcaaacggcgtcgctgcaaaagaagcagctgattgggctggagaaaaaaacggcatattcagcatgatttttcaatttgagcatctcggcctgtgggatgtagagatcaatgaaagtattgatatcgttgcatttaaacgaattttaactgactggcaggacagtctggaagggatcggctggaatgctttgtttatggagaatcacgaccagccccgttcagtttctgtgtggggagacgacggagtgtacctgaaagaaagtgcaaaagcgctttccgctgtttattttctcatgaaaggcacaccgtttatttatcagggacaggaactcgggatgacgaacgtggcttttccatctattgaggactatgatgatgtcgcattgaaacgcctgtatgaaacaaaaacagcgaaaggcacatcacacgaggatgtgatgaagattgtctggaaaaagggaagagacaattcgcgaacgccgatgcaatggaatgctggtccatacgccggattttctgaggccaaaccgtggatcggaatcaatgagaattacaaatggctgaatgccgaggcgcaaaaaaacgataaaacatccgtttaccatttttacaaaagcttgatcaagctgcgccaaacatatgatgtttttattaacgggacatacgagctcattttaccggaagatcagcaaatctttgcatatcttcggaaaaacgagagccatactgcactgattgcggccaatctgacaggaacaccggcgttgttcaggcactctggattgccattgtcatcagatgcactcgtcttgtcaaatattgaaacagagccgcacaagcatatgacatcagtactcttaaagccgtatgaagcaagaatatatctatggtgctaaactccagccttagactggagtttttttgttttatcgggtttatgagagcggtttaacaggaaaaaaagaacacagaacgaattaagcgatgagagcggacaaacgaaaggagaaacaaatgctgaaaacactgcaaatcaaaacaaccaaacgagatgaaatgatagatatcacccgggaggtggaagcgtttcttcaagaaacaggtataacgagcggcgcagcgctgatttactgtccgcatacgactgcgggcattacaattaatgaaaatgccgatccggacgtcaaaaaagatatgctcagaaggtttgatgaggtatatccgtgggaacatgagctggaccgccatatggagggcaatacagctgcacacatgaagtcgagtacggtcggagcttcacagcatgtcattgtggaaaacggccggcttattcttggaacgtggcagggcatttatttctgcgaatttgacgggcctcgcacccggacatgctatatcaaaatgatgggataataggctgttttttatgacaaaagcatgatcgctgaacaagcgccgatagccggagggcttgtcacacccgcccacgctgcggctttatcgaatgaaggcgtgcttggcattcgtccatatgcgaaataaaaagcgagggaaagagacacgcgcctcaccctttgttttccggaaagcctgcatgagggatagttaatcaatggatgtaaacgtaccgagctttgccgaacgtaacttgataaactgaggtgacagatatgaacattcttcaatattcttataaaaaaagagggaaaattgagtttgtatttgaaggctggcctcactcaaaagttacaatggttcctatcaaaggctactattttgtccgctttatcaaatggagcagccaggatccaatcgtgacaagaaatgaccttgaaaaaatggagtgggctgcgaaccaatattttggcacagcccccttctatcgaaaacgaaaggcatttgaaaccccatcgtccggaaaataggcgatggggctttttagcggacgatgcggaaaagagacggaacatccagtctggtcgcctgagacagaaggtaggctgactgtaaggctccttttttcctaaaagaattcagcttatcaataatttgctttccgtttaagattccaagaccatgggcaaaatatttatcttcccccagtagtatcacattttcgcctctccattgcgccttttgcggatcaaattcaggattcttaaaatacaaacaatctccaaggaaaaagtggtgtcctgtttccgtatatatcggcaatttctcataatgccagtcatataaaataattctgtcaaagctggcattgaatttatcttctccgattgtatcgattaaggccaagtaataaatgataacgattgcggttgcgcattcaaacgcataaaacgggccgttctctgcaatgtcccgaatcgcttttgaaggcggcattctgtatttcagctccaaggcgccctccggtgaaaccctccaatacgttgtattcccgtatgtttttaaaaaagtggcaaacttcgccccgcttttgtgcagcgtctttgccgctgctacaatattcatccgcagtttaagctcaaacatcagttcagcaattgaatgataatcaaactgaacaggcgtctcaatcatctcttttaagagcggattcagatcttgatcaatctgccaattttcaatatcctggggacggagcaattgtcctgatacaataatcatgtttagccccccttgttttttataagatatgcaaagagcttgggcaatgaaagttaaaaaggcagaagacagccaaaaagaacttcttccattttttattttaaaacttttttaagcagccgatatatactgtatcaaacctgaaggagcaagtgacatgaagacttttatcaattggctgaagaaaccgtctatttcaaagaaattaatcgtctcatttattgcgattctcattatccctattcttatattagaatttagctcttaccgaagcgccagcggaaagctggatcaggaaattatgggaaatgcgaaaaacagtgtcgatacatttaatacaactgttacaaatgatctgggagaaaaagcgaaagcagtcacctttttcagtgaatctcttaaaagatccgcattcaaagggaaatcaaatcaagaagagatcaaagctaaattttcacaatatgtatctattaatcaaggagtagccagaatttatgggggcgcagataacggcacttatgtacaagcgccaaaagaaaaattgccggaaggatacgacccgagacaacggccttggtaccaggatgcgatgaaggccggcggtgaaattgtcgtgacagatccttacgtggctgcgagtgacggaagcatggtcattaccattgcacaggagctgaaggacggatctggcgttgtcgccatggatattaccattgataaattgttagaacaaatgaaacaaatcaaggtcggaaaagaaggttatgctttcattgcaacaaaaaacaaaacctatgtcgcccacaagaaccataaggctggagaaaagctttcaggcgactgggtagccaaaatgtatgcgaatgacagcggtgaactccagtatactcttaataacgaagataaaaagatgacctatactacaaacgaactgactggttggaaaatagccggcacaatgtatatggatgaaattaaggatgcctcaaagtctgtgctgacaacaggaatgattgtgctgattgcttccattgtggcaggcggaattttaattctgtttatcgttcgttcgattacaaaaccgttaaaacgtcttgttcaatcatcgaaaacgatcagcaggggggatctgaccgaaacgatcgaaatccattcaaaggatgagcttggagagcttggggaaagcttcaatgaaatgggacaatctctccgctctctgatcagcgctattcaggactcggtgaacaatgtggccgcatcttccgaacagcttaccgcatctgccgggcagacgagtaaagccaccgagcatattacgatggcgattgagcagttctcaaacggaaacgaggagcaaagcgaaaaggttgaatccagctctcatcagctgaacttaatgaatgaaggactccagcaagtctcacaaacatcgtcagatattacaaaggcatctatccaatcaacggaaatcgccggaacgggtgagaagtttgtgcagcagacagtcggacaaatgaactcgattaatcaatctgttcagcaggctgaagctgttgtcaaaggcttagaaggaaaatcaaaagacatcacaagcattttgagagtcatcaacggaatcgctgaccaaacaaatctgcttgcactaaatgcagccattgaagcggcgcgtgccggagagtcaggacgcggcttctctgtcgtagcggaggaggtgcgcaagctggctgtccaatcagccgattcagcgaaagaaatcgaaaagctgatccaagaaatcgtcgcagaaatcgacacctctcttcacatgtttaaagaggtcaatcaggaagtacagtccggacttgttgtcacagacaatacaaaagaaagcttccagagcattttcagcatgacaaacgaaatcgcgggcaagctgcagacgatgaattccaccgtcgagcagctgtcagaccgttcacagcatgtttcagcagcagtcagcggcattgcagacgtgtcgaaagaaagctcggcaagcatccaggacattgccgcatcagctgaagaacagcttgcttccatggaagaaatcagttcctcagcgacgactcttgcgcagatggcagaagagcttcgcgatctgacgaaacaatttaaaatcgagtaaaaaccgaaaaacagcgctatcaaagcgctgtttttttatatggtaaacaataataaagtcctagtttaacaggtgaatttagaactatttttcattttttcctccattttcaatgtaatttaaaggaagatccgccgatataatttgtaaattattgaaagaaggttcaaaaggaaatgaaaaaaacactcaccactattcgcagatcatcaattgcaaggagacttattatttctttcctgctgatcttaattgttccgataaccgccctttcggttagcgcttatcaatcagcagttgcctcacttgatgtacagatgacgcaaagcgcaaaggaaaatgttcagatattagatcacatcattgatgataaaatcagcactactgaaaaaagcctcgcatatttcagcgattgggctacagcagaaaaatttcaggataaaaagaaaacagagctgaaacaggaatttaaacaatttatccaaatgaatgataatgtcgctgcggtattttcaagcggcaaagacggggacttcacacgttatccgtacgctgacatgccaagcgactttaatgctttggaacgagattggtacaaagaagcaatggccaataaaggcaaaacaattgtcactgagccttatgaatcgatttcatcaggaaaaatggtcgtcaccatcgcccgtcaaacggtggatgggtcaggcgttgtcgccattgatatgaaaattgatgacttagtcactaccgcgaaaggaatcaatatcggaaaagaaggctatgcttttattttgagccaaaacaagaaagtcatcgcctactccggagaaaaagcgggaacagagctaaaaggggactgggttgataagctctacaaggataaaagcggggactttgaatatacgtacaaaggcaaaaagaaaaaaatggcatttgcaacaagccaaacaacaggctggaaaatcagcggcacgatgtatgcaaacgagattcacgatgctgcaagcagggttctgatcatggcttcaatcgttctggcgattgccatcggagctggaatgacggcgatttattttgtgattcgatccatcacaaagccattgagacgcattgtcgcatccgctgaaaaaattagtgaaggcgatctaaccgaaacgattgaaatcaattcaaaagatgaactcggcgttctgagtgagagcttcaatcatatggcacactcgcttcgctcgctcattcacgggatcaaagactcagtagaacacgttgcctcctcgtctgaagagctgactgcatcggcagaccagacaagcagagccactgagcacattacgatggctatcgagcaattttcaaacggcagtgaaagccaaagcgagaaaatagaaacgacaaccgaacaaattaatgaaatgaatgacggattggcagagctggcgcgggctgcagcagtgattacagaaacatccgcagattcaaccgaagtgtcaagcaaaggggagacactcgtccagaaaacagccggccaaatgaacacaattgaccattccgtaaaagcagcggaacaagtggtgaaagggctggagatcaaatcaaaggatatcacgaatattttgcgtgtcatcaacggcattgcggatcaaaccaatcttttggctttaaatgccgccattgaagctgccagagcgggtgaatacggccggggcttctcagtcgtcgctgaggaagtgagaaagctcgcggtacagtcggctgactcagcaaaagaaattgaatcgctgatcagtgaaatagtaaaagaaattcacacatcactgaacgtgcttcagtccgtaaacaaagaagttgaaacagggcttgtcatgacggatgaaactaaacagagcttcaaacatatatcgcaaatgaccaatcaaattgcttccgagctgcaaaacatgaatgcgacggttgaggagctgtcagcgggagctcaagaaatttccgcagcttcaaatgatatcactgccatttctaaggaaagctcggatggcatccaagatatcgccgcttcagctgaggaacagctggcatccatggaggagattagttcatctgcactgacgcttgaaagaatgtctgaagaactccgtgatctgacaaaacaatttaaagtagacaaataataggtctaaaatactatttatttatgggaaattagttacttttgttaaatttcttcttttttgctgtatatatttacccatttccagccgatatgaagggtagcataaaaaaggagaaatgaatgatgaaaaaaatactccaactcataaaacaaagatcaattacacggaagcttctcgtttcctttctgtcgatcctcatcataccggttgtcatattggcgatctttgcgtatcaatcggctagcagctcactcgacagacagatgatggggagcgcattggaaaatgtacagcaattaaacgaaatcattaacaccagcatcggcgaaaaagaaaacagtgctgattatttcagcgaatggctgacaaaagagaaatacaatgcaaaaagcaatgcaagcattgcagagaaattctcacaatatatcagcattaacaaggatgtagaatccatttatacaagtgacacaaaagggcactttacccgctatccggatcttccgatgccaagcggctataatccggttgaacgcgactggtacaaaaaagcggttgcaaataaagggaaagtcgtgatcacagacccttataaaaccgcgtcgacaaatacgatggttgtgacaatcgcccagcagacaaaagatggttcaggcgttatcgcaatcaacatgacgattgaaaatctgctgaaaacaaccaaaaaagtcaacatcggcacacaaggctacgcatttatcatgacgaaggacaaaaaagttgtcgcacaccctaatgaacaatcaggaactgaattaaaaggcgactggctcgataagatgttgagtgctgataaaggcgattttcaatacaccatggatggcgataagaaaaaaatggcctttgacacaaacaagttgacgggatggaagatcggcggcaccatgtatttggatgaaatccatgaggcagcccagcctgtccttcaccttgctttaattgtcttggccgcagctattatcatagggattatcgtcatgacattgatcattcggtcgattacaacaccgctgaaacagcttgtcggttcctctaagcggatcagcgagggagatttgacggaaaccattgatatccgttcaaaagatgaattgggcgagctcggcaaaagctttaacaatatggcgtcgtcacttcgttctctcatacacgccatccaggattcggtagacaatgttgccgcttcctctgaggagctgactgcatcagctgcgcaaacgagcaaggcaacagagcacattacattggcgattgaacaattttctaacggcaatgaaaaacaaaacgaaaacattgaaacggcagcagagcacatttatcaaatgaatgacgggttgacgaatatggctcaagcttctgaagtgatcactgattcatctgttcaatcgacagaaattgcaagtgaaggcggcaagcttgttcatcaaaccgtcggccaaatgaatgtcattgacaagtccgttaaagaagcggagcaagtcgtacgcggattggaaacgaaatcgaaagatattacaaacattttgcgtgtgatcaacggcatcgcagaccagacgaacctgcttgccttaaacgcagcaattgaagcagcgcgcgcaggcgagtacggccgcggcttctccgttgtagcggaagaagtaagaaaactggcagtacagtcagcagattcagcaaaagagattgaaggattaatcatcgaaattgtgaaggaaatcaatacatcactcggcatgttccaatctgtcaatcaagaggtgcagacaggacttgacatcacagataaaacagaaatgagcttcaaacgcatttctgaaatgacgaaccaaatcgccggcgaactgcaaaatatgagtgcgacggttcagcagctttctgccagctccgaagaagtttcgggagcgtctgagcacattgcatcgatttcaaaagaaagctcagcgcatatacaagatatcgcggcgtcagctgaagagcagctagcttccatggaagaaatcagctcgtctgcagagaccctttcctctatggcggaagagcttcgggatatgaccaaacgatttaaaattgaataataagccttaacacccaagcttgttgcgcttgggtgtttttttagttttttattaaaccttttatcctagtttgacgatattagatttatcttaaaggaggagtcaacgagaatgggaaaattcatacaatggatcaaacagccatcgatcagcaaaccgctaatcgctgcgtttctggcagtgcttattttgccggttggggttttagcatatttcagttatcaatcagcttggaacgcgttagacagagagctcataagcagtgcgaagggaaatgttgaagaactaaacagtacgctgcaaaataaattagaagataaagtaaaagcaatagattattatagtgagacagtcgataaagacatattgttaggcaaaaacaaaacattactgaaagagaaatttaagcagtacacgacacttaacgacgatgtaggcgcaatctatgctgcctcagaagataagaagctttataaatatccggatagcggtgttccgaaaggtttcgatccgacaggacgtgactggtacaaacaggcggttgcggaaaaaggacaagctgttttctcagaaccgtataccgatgaagcgacaggagatatcgttgtcacaatttcaaaacaattaaaagacggttcaggggttatagcgctagatttaaacctggatgaagtgcttactgcatcaaaaagaatcaaaatcggaaaagaaggctttgcatttattacgacaggcaacaaaaaatatatcgcccatccgaccattaagccggggacaaccggttccggcgattggacaaaccaagtatattccaaaaaagaaggctcatttgaatatacattcgaaggcaaagaaaagaaaatggcctttacgacaaataaactgactggctggaaaatcgcgggcacatattttgtcagtgaattgcaagatgcttcaagcccggtgctgaacactgcggttatcattctatgcgtgtcaatagtaatcggcggcatactcatactctatattatccgtgccatcaccaagccgttaagaaaacttgtctcaacgtctgcaaaaatcagcagcggagatctcacagaagtcattgacattcactcgaaaaacgagtttggccagcttggcgaaagctttaatgaaatgtctgcatcattgcgttctgtaataggcgttattcaaacgtctgtagaaaacgtcgcttcatcttctgaggagctgacagcaagcgcagcccaaacaagcaaggcaactgaacatattacacttgccatcgaacagttctcagatggcaacgaggcacaaagcgagaaactggaaacaagctcaaatcatctttctcaaatgaacgaggggatttcaaaagtggctcaagcctcttcaaccattacgaaatcatcgattcagtcctctgaggcagcgggcagcggagaaaagctggtggagcatacagtcggccagatgaaaacaattgaccaatccgttcaaaaagcggaagcggttgtgaagggccttgaaacaaaatcgcaagacatcacaagcatcttgaatgtgattaacggcattgctgatcaaaccaacctgcttgcattaaatgctgcgattgaggcggcaagagcgggagaatacggaagaggtttctcagtagttgcggaagaggttagaaaacttgctgtacaatcagcagactccgccaaggaaattgaaggattaattcaagagattgtcagggaaatcagcacctcactttcaatgttccaatccgtgaatcatgaagtgaaagaaggcttgcagattacggatcaaacagcggaaagctttaaacaaatctatgagatgacaacccaaatttccggcgaattgcaaaacttgaacgcgacggttgaacaactgtcagccggatcacaggaagtgtcaagtgctgttgaagatatttctgcagtggcgaaagaaagctcagcaggcattcaggatatcgcagcttcggcggaagaacagcttgcgtccatggaagaaatcagctcttcagcggaaacgttggcaaacatggcggaagaacttcaggacattacgaagaaatttaaaatagaatcataatgaaacgagaaagcggcatatctgctgctttctttttttgttaaaaagcaaaaataaacaaaaacgattcaaaaacaaacagaaatcatatataatgaaaacggatacaaataaaagggtatggaggaatatcaaatatggtgaaacatatatgggattcagagcgagctgcacagctacctaaaggtgtagaggaattggtgtacaggtccaatctgatcgggtcagaccgcactgtctgcaactggggcggggggaatacatctatgaaaacaacggaaaaggattttagaggccgtgaaatagaagtcatgtgggtaaaaggaagcggatcggatttggcaacaatgaaagcgcataacttttccggtttgaaattagatgatatccgcccgctgattaaaagggaccaaatgcccgatgaagaaatggtagactacctgtctcattgtatgatagacagcaaacatccccgcccttcaattgaaacgctattacacgcttttctgccatacaaacatgttgaccatacccatccagatgcgattatcagcatatgctgtgcggataatggaaaacaaatcgctgaagacatttacggaaatcggtttgtatgggtgccatacgtccgtcctggatttactttgtctaaaatgatcgctgaaggcgtagcaaacaacccccacgccgagcttgtattaatggagaaacacggcttagtcacttggggagagacgtctgaaacatgttatcaaaaaacgatatccatcattcaagaagccgagcagtatattaacgatcgtatcaatcagcatgaggtattcggaggcaaaaggtatcagccgctgccggaggataaaagaaaacaaatcttggcaggcatcatgcctgtgatcagaggagcagtaagtgaagaaaagaaaatgatcctttcctatgatgatcatgacgatgtcttggaatttgtaaacagtgtccaagcgccagcactttcgcaaatcggtgcggcatgcccggatcaccttgttcacacaaaacgggttccgctgtacattgattggaatccggaaactcaagatgtgcacaagcttgcagatctgatcaagtcaggagtcgagacctttacatcagagtatcaggcttactttacacgcaatcagcaggatggggatcaaatctttgaatccgccccgcgggtgatattgattcctggaatcggaatggtgaatacaggaaaaagttatgcgatgtctaaagtaagcggggctttatatcggagggccatcgccgtaatgaaaggagcaaccgctctggggcaatttgtttctttacatgaaaatgagtcctaccatgtcgaatattggccgctcgaactatataaactcacgctggccccgccggaagcagaattttcccgaaaagtagcgctgataactggaggagccggcggaatcggcagtgcggcatgccgccgatttgcagctgagggagggcacgtgatcgtagctgatctgaatatagaaggcgcacagaaaattgccggggaaataaacgatgcatacggaaaaggacgggcaatggctgtcaaaatggatgtgacaaaggaggaagacgtacagtcagcttttgaacgagcggcgcttgcttacggcggcattgatatcgtcgtcaataatgccgggctggccacatcaagcccatttgacgaaacaagtctaaaagaatggaatcttaatatgaatgttttaggaacaggctatttccttgtagcccgtgaagcgtttaaacagatgaaacatcaaaatagaggcggaagcatggtatttgtcggatcgaaaaattcagtttatgcgggaaaaaacgcctctgcctacagctctgttaaggcgcttgaaacccatttagcaagatgcatcgcagcagaaggcggagaattcggcattagggtcaactccgttttgcctgatgcagttcttcaaggatcggcaatctggggttcaagctggcgtgaggaacgagccgcggcgtacgggattgaaccggatcagctggaggaacattaccggaaacggacagcattgctcgtcaatatttacccggaggatattgccgaagccattgcattcttcgcttcttccaaagccgaaaaaacaacgggctgcatgatcacggtagacggcggcgtccctgctgcttttacgcgttagatatatgctatgataaaaatataagacggactacgatatgaggaagggcgttaccgatgctagtagcagaacggcagcaaaaaatagtggaaatagtaaatatgcgttcaagcatccgcgtttccgaattaagtgacattttttcagtcacagaggaaaccattcggcgtgatcttgaaaagcttgaaaaagaacataaactgagccggagccacggaggagcggtcagtattcagcagaaggaatcagaaattcatttttctgaacgggaaatcacgaatgtcatcgaaaaaaaagccatcgctcacgaagcggccaaatatgtaaaaagcggagaccgaatcattctcgatgcaagcacaaccgcttggtacatggcaaaaatactccctgacattgagctcaccgtgattacaaactcaatgaaagcagctattgaactcagcaataaagaaaacatatcagtcatttcaacaggcggcattttgctggaaaaatcattatcatttgccggcccgttagcagagcgttcacttgagacctatcatgtcaataaaacctttctgtcatgtaagggatttgacgtacacaacgggatgagtgattcaaatgagtggcaggcgctgctcaaaaaacggatgatcgaaaggtcggaccagaccattttgatggccgattcaagcaaatgggggaaccgcgagttttcacatatcgcctcgctgcaagatgtcagccgccttattacggattctggacttgatccggcatcggtaaaagctcttgaggacaaaaaggtgaaggtgacagctgttcctctttcgaagagagggtgaaaggatgatttatactgccattgatgtaggcgcatcaagcgggagaatcatggtaggtgaactgaatgaagggaagcttgacatacaagagattcacaggttcgctaacggtttcagtcaaagagacgggcattgcttatgggatattgatcatttgctaaaacaaatcctgcaaggactgcaaaaagtaaagacgcttgggtatgaacactgcaccgtaggcattgatacatgggcagtcgattatgtcttactggacgaaaaaggcgatcggttgcgggaagcaatctcctaccgtgatagaagaacagatcacacaatagacaaactggaacataccctctcaaaagccgcaatttatcaaaaaacaggaatacaatttcagcctttcaacacgatctatcaattgtttgaagaagaccgtgagctgctgaaaaagacagacaaaattatgatgattcctgattatttaggctattgtttaaccggaaaagctgtaacggaaatcacaaacgtgtccacaacacagcttttaaacgtctcaacgggaaatcttgatcctgaattgcttgaagccgtgtctgttctggaacagcaatttgcgccgctcactgaaccggggtgtgaactcgggaagctaagaaatgagtggttcccggattatgatctcccggcgtgcaaggtgatgacagtcgcaacacatgatacggcctcggccgtcattgcggcgccaggcgtaaatgatggctgggcgtatatcagcagcggaacatggtcgttaatcggggttgaaaacaaaacaccgataataactgatcttgctttagaaaacaactatacaaatgaacgcggcgcaaacaacaccattcgctttctcaaaaacattatcggcatgtgggtgatacaagaagtcaaacagcagctacaagcagattattcttttcagcagcttgcagaagaagccaaaaaaacagaaccattccagcaatttataaacttaaatgataaacgtttcctgaatccagaaaacatgataaaggaaatacaacattattgcagacaaacccgccaaaagattccccgtactgcaggcgaacttgcctgctgcatctacagcaatttagccatcatctatgcgatagccatcaaagagctcgaaacaatcacagaaaaaccgatcgagcaatttcatatcatcggcggcggagcccggaatgatttcttaaatcaattaacggcagacatgagtggaaaagcggtatatgcagggccgatagaggcaactgccaccggaaatcttttgatgcaaatgattgctgccaaagaagtcaaagacataaaagaagcccggcaagtcgtcagaaattcctttccgatcaaagtgtttacacctaaagacattgatagaagcacgatcattcagtcatttcagcaaactgttttgaaagcgctatctaaatgatgaagaggtgaaaaggtttgaaaagaaaagccagtatcatgtttgtccatcaagacaagtacgaagaatacaaacagcggcatgatgacatttggcctgagatggcagaagcactcaaagctcatggagcacaccattattccatttttctagacgaggaaacaggcaggctttttgcatatttagaaatagaggatgaagagaaatggagaaagatggcggacacggaagtttgccaaagatggtggaaatcgatggcgccattaatgaaaacaaattcggatttcagtcctgttgcgatagatctaaaggaagttttttatttggattgaaaaactgataaagggagagagccgtatgaccataaaagccaattatgacagtgcaaaacaggcatatgaaaaatggggaattgatgttgaagaggcgcttcggcaattagagcaagtgcccatttcgatccactgctggcagggtgacgacattgaaggctttgaagtaaataagggcgagctttcaggcggaattgacgtgaccggcaattatcccggaaaagcgcaaactcctgaagaattaagaagagatttggagaaggctctttctctcattcctggaaagcaccgcgtaaacctgcatgcgatatacgcagaaacaaacagggaagcggtagaacgtgacgaattgaagccgcagcattttgaaaactgggtgaaatgggcaaaaaaccttggtctcggtttagattttaatccaaccttgttttcgcatgagaaagcggctgacggactcaccctttcacaccctgatccggacatcagagaattttggatcaggcattgcatcgcttgccgccgtatcggggaatacttcgggaaagaattaggaacaccttgcttgacgaatatttggattcccgacggctataaggatatcccgagtgataggctgacaccgcgtaaaagactaaaagaatcactggatcggatcttctcagaggagatcagtgaacaacataatcttgattcaatcgagagcaagctgttcgggcttggctccgaatcatatgttgtcggatctcatgaattttatttagcttatgctttgacgaatcataagctttgtttacttgatacaggccatttccatccgactgagacggtatcaaacaagatctcgtccatgctgctttacacagacaagcttgccttgcacgtatcgcggcctgttcgttgggatagcgaccatgtagtggttttggatgatgaattgagagaaatcgctcttgaaattgtacgaaatcatgctcttgagaaggtagccatcggtctggattttttcgatgccagcattaaccgtgtagccgcctggaccatcggaacgagaaatatgatcaaagctttattgtatgccctgcttctcccgaacggatatttaaaacaattgcaggaagagggccgctatacagaaaggctggccctgatggaggaattcaaaacatatcctttcggagccatctgggattcctactgtgagcaaatgggcgttccggtaaaagaggcatggctttatgacatcaaagaatatgagcaacaggtgcttttaaaaaggaaggcatcttctccgattgtctaataaaaaatccgccgcggcatttgcacgcgggcggatttttttaagcttgatcagcagggtatacaatccccatttgctttcttgcttcttccataatttttgcggtggtcaaagaccgttcaaatgtattttcttcagattccagcttattctcttttataagcgtgacaaattcttctgcttcatagaacatcgccggtttaggatcagggatcgcgatgttttcaaggcggccgtcccggtagcggatttcaacacgttcaggccggtgaatcgtatcgattacaatcgtcccgtcttcaccctggatttcagccggggcataggaagtagagattttggaatgcatcagaacagcttcgaacccgtcgtaagacagaatgacagttccttctccgtccactccggaggataaagcatatccgtttgcttttacatccttcggcgcgccaaacaacacaacagccggataaatacaatagacgccaatatccattaatgacccattggaaagctcaggctgaaacgcattcaaaacagttccgcttctgaacgcgtcatatcgtgaggaatactggcagtagcttgcggtaaatctgcggacagtgccgattttatgcaggtgttttttcagttctttgaaattcggcaggaaagtggtcttcattgcttccatgagaacaacgccgtttgccttagccgctgagatcatctcttctgtttcttttgtattcgaagcaaacggcttctcacaaagcacatgcttgccatggttcataaagagaacggcttgttccttgtgaagagcgttcgggctcgctatgtatacggcatcaaagcaatcgctcgccgccatttcctgaaggtctgagaaggcatgcgcagcgttgtgtttagcagcaaactcgccagcgcgttcagccgatcttgaataaacagcagtcagctgaaaatcttcgatatccgctgctgactcaagaaagcggtctgtaatccagttggttcctattattgcaaaacgtatcactcgtatcgctccttttgcatgatatagctaaattatagcttaaaaagaacaaaatcacatgatagatataaatagaatgttaaaaccgagaaagcttttccagcaattaacggtttttatttttcattatagggacgatagtgtacaatttaattaaactatgtatgacggaggaacgatagtggagacgttgcaaacatggagcggcagattcaagcgattcttcttggataataagtttgttttatttttgcttgtgctgctgctgattggtttaaatattctagtatttacaaaaacatcatttattttcaccccgattattgttctgctcaaaacgatatcacttccgattattttgacaggcattgttttttatctgttaaacccagtcgtcgattttctggagagaagaagaataagaagaatctattctatattgctgctatacctattggttatcgggctgatcacgatcacgatcgtgtcgatcattcccttcttaaaagaacaaattatgagtttgattgacaatatcccgagatatgtggacgtcgtagaaaatcagacgaaacagctgattggcagcaacttcgtcaatcaggcccagcaaacgatgaacattaatatatctgatcttgctacaaaggtttcggatcaggcagcgacgatcgtgaacagcacctttaccggtgttgggaattttatcggcgcactgactgagattatcatttcgatcgtcacggttccgtttattctattttatttgctaaaagacggaagaaaattaccggtctacatactgaagtttgtgccgactcgattgaaagaacagacatatacagtcttaagcgaaatgaatcatcggttaagctcttatatcagaggccagatcattgtcagcttctgtatcgggtttttgctgtttatcggttatttgattatcgggctggattatgcttcattgcttgcagtcattgcggcttgcacaagcatcgttccatatttagggccaacgattgccattacgcctgcgattatcattgccatagtgacatcgccgctcatgctgcttaagctggtgatcgtttggacgattgttcagctgattgaagggaagctgatctctccgcaaattatgggaaaaaaccttcacatccatccgattacgattatttttctgctgttaacagccggcaagctgtttggcgttgttggaatcattcttgcgattcccggctatgcggttgccaaagtcattacgacacatttatttgactggtttaaaatgcagtcacatttatacgatgaagaaaaaaatgaaaatacgccggggcataaagtgtgattttcgtttatagttatataagacgggctttccatttatgggaagctcccgttatgtaaaaaaataaatgtctaatggggagaatcaaaatcatgactctatgggaattgtttgtagccgccattttaggaatcgtagaaggattaacagagtacgcgccggtttcttcgacaggacatatgatcatagtagacgacatctggctaaaatcaagtaatctgatgtcagaagaagctgctaactcattcaaggtggttattcagctaggctccattttagcagtagctatcgtgtttaaagaccgaattttaaatttactgggcttgaaaaaaaatattacaagcgaccaggagcagggacataaattaagcattgcccaaattgccgtcggactcgtgcctgcagctgttctcggctttttgtttgaagattacattgatgaatatttattttccgttaaaactgtggccatcggtttaattgccggggcaatcctcatgctttttgctgactgggtcaataaacggaaaacagcgacagacacactcgaccgcatttcctataaacaggcgatagccgtcggcttattccaatgtctttccctttggcctggtttctcgcgttcgggttcaaccatttccggcggtgttattctcggattaaaccaccgagctgcagccgactttacgtttattatggcgatgccgatcatgatgggagccagctttctaagcctcgtgaagcattgggacagcttaagttcggatctgatgccgtttttcatcgtcggctttatctgtgcctttgtggtcgcactgtttgtcgtccgtttcttcttaaggctgattaacaaaatcaaacttgtcccatttgcaatctatcgaattattctcggtgtgattttacttttgatcatgatgtaagtcgaaaaataaggctcttttccgagccttattttttctgtcaattcaagaggaaacagcttgtttttcaaaataaaatcatctataataaacatgacgttacatacggggccatagctcagctgggagagcgctacgctggcagcgtagaggtcaggggttcgagcccccttggctccatacctttaaacccttattcgataagggttttttgttttgaggaaaaggtttcattctctgaatcctccagttgagtgaagtcaaagtgagcagtttatctgtcaatcatgaattttccaatacctccttttgttcctcaaagaccgtcatgtcttccaaaggaggggagtagacatgaagagacaccattcgttcagatgttggattggacattttgtgaattaaacctttggttgaaataaggcattctccttcgtggacaaagtatgaattggagagttctgcgtgttcgccggttgaacgataaatagaattaagaagctttccttctaacaccattgcacaaccaatggattgaccatgatcgtgtactgttgtctccttgtttggcggaatgttaatcacgataatttccaattcattatttcgatagatggcatttcggccgtaagcgtactggtctggttccttaatatacggttgactcaattttgctgcgtttggaatttgttttaaagacgttgctaaatctttaaccgatggatttttcaagccgccaaaaatgtcttggatacactcatacagttccattcgtttttgcctcccttacattggtatttcataggttaattcatggtatttacccatatacaatttagaggcggcaaacgcccagtgaacacaaaaaaatgtgggggtaaaatgttgtcttatcaccaacttatttgagtttattagttggaatagtggattgaaaggattaaaacggcctgctttaattcgcttgagggaacgagcagggattcataagtgcagttctagacacaatatcggggaaaagctttcaagctttctatgttgtgcttgaaatttactccattgacaaaacacaatcgatttgaaataatatttgattatatgctcattcattcacataattataataaaataatatcatttcccctgaaagggagaatattagaatgaaagctaatggtatgcaaaatctattagcttcttttgttttcaaaaaatgatgtgtttcgcatgtattcatataggaagggatgacaacatgaagacaaaacactattgggtgatttctttgctcgccgtcttagcggtcgggccgggattgatgtctaacacggcattgtcgtcagttcaaggccttgttcagaaaacggttggaacaagtgtctttacatcagtaaatccgatattgatcggcaatatggcctttgccttgttagttccggcaggaccgctgctgaggaaaaaattcggtgctcgtcccgtctatctggcttcattacctgtctttatactaggctcactgctcatcgcatgttcaggcgatattgcattgatggcggcagggcgctttttacaaggggcggcaacaggcgtcatgctgatgattatgattccaatgcttgtactgtcattcccgattgaacgcaggaactatgcactgcttgtgctgatcgggggattctatggttctgttatcatcggtacaatcctgggaaccattgcaacaagctgcgggcattggagatggctgtttttcatctttggcaccttgtccctgatcggtgtcgcggtgagctatttctttcttcatgatgagcatcacggagcggcggatcaagaacagccgcttgatcgtgcgggaattcttttatctgtcttccttgccgcagcctcagcggtttcattcatttttctgcaaaaatgggggctgtcatcgggttatgtatggattggtttcggggtgacgttatgtttgctcattggtctattgattgtggaatataaagtgaaaaaccccttcatatctattaaactgatgctgctgccaaaaccggtgctcggcttattgatcatagctgcagggacgataacggtagctgtcagcctttctgcttttcaaggcttgctccgtcaaatgtatgatatttctcaggagcatctcattcttttaagcttgactcttttaatcggagtggcgatcgcggccattttgagcgctctgttatacgataaagtcggaccagggatgctcggtattatcggcggactcattctcgtttttgtgaattttcaatggctgcatatacaggatcgatcatctctttatatgttcgcggcactgtttatcatgcttgcagcgggaacaggcctgacagtcgccgcagggctgatgggagctgccatgggaggcccgctgcctgatttggtcaagagaatgacagctgttcagtttttaagattgtttgtctatatgggagttcccattctcatcggctttttcacgaaaaaagatgctgccagacaaagcggttcggtacaggattctatgatgactgcttatcatgatctcttcttcatttcttttatccttagcgtgctgctcgtctgcctgtcattttgtatgaatgccactggaatggggcacaagctggcacataaaccacatgataaagcgaaaacagctccggaaaaaccggccgtctcagcacaaggtttgtcgaaggcaactgtcaaatcatataaagtaataaatgatacggaatatcggaatgcactcagaaatttacaaaaatagaaacatggtaaaaaccttttcattgagcgaaaaggtttttattttgcaatcttttcccaactttatccctaaagaattgaaaaatattagaagtgcaagtaaaattctaaaaggtagattcttttacattcgtaatcttttaattcgaaggaaggttttcatggcccgtaaaaaacttaaaaacgtaaactcttgatttcactatttttccttgtatcgattccgctagctctgtttgttttagcgacaactttatcaaaaccgattgaaatatccaaagaaactgaagaaatcgatgaacagcaagtatttatagacagtctgtccggacatgcccaaattttgtatgaaaaataccatgttctccccagcatcacaattgctcaggccattctcgaatcggactgggggaacagtgaactggctgctaaggccaacaacctttttggcgtaaaagggaattataaaggccatcatgtcacgatggaaacggacgaagttgaaaaagggaaaagaaaaaccattcgcgcgaagtttcgaaaatacagcacgttttttgaatctatggatgatcacgcccaattgttcgtccgtggcacatcgtggaataaaaagaagtataaaccggtgcttgaggcagggaattataaggaagcggcaaccgccctgcaaacatcaggatatgctacagaccctgactacgctgacaaaatcagcgctattgtggaaaaatacgatttagatgagtacgatgaggtaaatccatccctcaaatctgtggatttaaacgcctctattaaagacagtgccgttcaagacgtatggtccaagccttctactgatgatcggtccataaggcttacctctgcccaatcttacgtcggcaaagacataaaggttgtgtctaaaaaacagaaaggccagtctgtatggtaccaattccaaatcaatgataaacttatcggctggattgatgattcagctgttgaaataaaggaggcaacctaagccctttttactggtatttttaattctttgttccattccggggaatttgaggtataatattccacggaagttatcactttttaactatgctttcgggagggaacaaaggtgcagaaatatagacgcagaaacacggttgcctttacagtactagcttattttactttttttgcgggagtatttttgtttagtatcggactctataatgctgataatctggaactcaatgaaaaaggttattacatcgctgttatgatacttgtagcagttggtgcgattcttacgcaaaaagtgacccgtgataacgcggaggataacgaaatcatcgcggaacaggaaaaaagacaaaatcaatctcatatcgaatcataaaaaatccggcgactgcacgccggatttttttgatatcaccctgtaaacacttcgccatcaggataacggatatttgattgctctgtttttgcgaatgaaaacacgaacgttaaaggaccaattcttccgataaacatgatgacaatgatgatacacttgccagctgttgtcagttcaggagtaagccccatcgtaaggccgacagttccgaatgcggaaaaggtttcaaacacaatttgaagaaatggcgcttgttctgtgatcgtcagggcgaaaatccctaaaaacacgatgaacaaactggtgacgctcacagctaaagctttaatgataatcggatatttgatggaacggcggaaaataaccgtttcttttttacctctcaagtaagcaataacagatgttaaaatcacgatgaacgtagtcagcttaatgccgctcgccgttgatgcgcttcctgctccgataaacatcaataataaagtaaatacaattgttccttctctcatgcttccaaaatctagagaattgaaccctgcggttctcggcgtcactgcctgaaaataggaggcccacagtttatccactatatgcaggtggccgagcgtgccggggttgctgtattctaaaataaagaccgtaagcatagcgatcgcattcaacatcagcgttcctgtaagcatgagctttgtatgtaaagaaaagttttaaaacgccgatttttcatcacatcaaacagaaccgtaaatccgatccctcctgtaataaataagaaagtaatcacgaggttcactgtaggatcgccaacgtagctcatcaaattatcaggccacaacgaaaacccggcattgttaaaagcagatattgcgtgaaacaaacttgcaaacaagccggatgaccagccgtattgaggtacaagccggatggataaaatgagtgctgctatcaattcaatactgatcgaaaacagaaacaggactttgacaaggccaatgacaccgccgattgtcggctggtttaaggcttcctggacgagcattcgttcttttaagccgattttttttcctaatatcatgacgatcaagaccgcaaatgtcataaatccaagcccgccaatctgaatcagccccataattactgtttgcccgaataccgtaaattgagtgccggtatcgacaacagcaagccctgtaacagttgtagcggaagccgcagtaaaaagggcatctatccatgacaatggcttcgtagtggaaatcggaagcattaataggacagccccgatgataatggtaaggaaaaaaccaatggcaagcacttgaggcggtgtaaaccgaacccatttgatcactttatccttttgaagtgtcacctttgtctacatcccttcgttttcaaaacgtttaatatcctttttgtggcccatgatcaccaggcaatcttgctcgcgaatgatgtcttcaggcgcgggggaaagacagatatctccatgatgtttaatggccaggatcgtgcagccgtactttgctcttacattcaggtcaataatcgattttgaatcaagcttgcgcgtagccagcagctcgacaatactgtattcatcagatagatcaatgtaattcaaaacattttcgtctgaaaggctttgtgcgattttaacccccatatctttttcaggatgaataatgcggtcagcgcctattttttcaagcaccttgtgatgataatagttttgagccttcacccaaatatttggaatatcaagctcctttaataatagggtggtcagcgtactcgcttgaatatttgctccgatggcaacaatcacatattcaaaattgcgtattcctaatgaaagcaattcgttttcttcggtggcgttggcaattaccgcatgagtggcgtaagaagcatatgcattgaccttttcttcgttgatatcaaccgcaaggacctcatgccccattctatgaagttctttacaaatgctgccgccaaaccggcccagcccgatcacggcaaattgcttatttttaattcttcccaatgttcatatctcccttagtgaattaacgtttttgaaacaaaaaagaccattgcaaagaatggccgataatagacctcctctctgtatacgcctacgaggttagctgtcggattagggattcagagtaccccctcttacttagtaagattcaccccaaggctgttaataaaacagccaatcgttggttcccccgttcgtgtttgattaagcggtaaaagagactgtatgaaattgaacactcaagaatttactcctgtttctagtgtttgtcaatttaaattttaaaccagaaaaaagataacggggattagagaaaaaggggagggtaaaacgcaaaaaagaccggcgttaaccggtcttttacattagttgcaaccgcaaggctgagtcggaggagtgctgcgcttagccacgtcaatgctggcttctgcgtaaaatttatttccgatgcttaatgatttattctccgcacggaaagtatatgtaccagcggcaggaagtgttttgttattcagttttaatttgaattcgccagctcctaacaaatcaagtgccaaaggaactcttactgttttcccgttattgaggatctgtgttgtacgcaaggcatttccgttcaatgtgtctttcgtgtttgcagtaaatccgcttggcaatgtaaactccataacgccaaggctgagaagcgtgtttggacggtaagtcaattcgatatctgagaaagaccattccgttttgctggcgccagtgattgttgcgaacaatgaagctgtagactgtgttctcatagtggattcagtatgagctttagttgatgtagattcagccgcgaaagaagctgtaggtgcagaaacgagtaacccgagacttaatgcactaattgccaaagaagataataatttgcgtttcataacaaaattccccctaaaaaatgataaattaaacaggcctgcccgcttttcacctcctctgaaaggccaaatacaaattttacctacataaaattaccatcaaatattttggaagtaaatggggtgtttttcccgtatttttcaaatttgtagtagttacatcaaaaaaacgcctagtttcccaggcgttttctgctttactttgtttcgaccggtataaatttaaaaatttctccggtctgcaccgattcagcaagccgtttcagccagtcatagtaagctttagagctttccagctgatcatataactgcagtgcttcatttttgatatcctcatcgagatcttccttgcataaaaccttttgtaaatcagcttgagcttcctcgatcgctgttacattcacttgaacctcccgctcccatttaggtggaaagaaatttgtgaaaaatttaaagaaatccttctcagccacaaatgtatgcttgcggatgccccggtgaaatgtttttttcactacatttaagtcttgaagctttttgacgccagtgctcatgcttggtttgctcatttgcaactcctcacgcatttcgtcaagcgtcatctcatccctcatatacatcgtcccatataaaatcccgacactgcgggtaattccgtaaagatccatcgtttcagcaatggagtcaataacaagatcccgagcctgttctatagctgcaaattctggattttcatccatactgaccctcttttcctttagaaaattaaattcgttaagttatttctttatgttctttatcttaacgaaacatgaggaaaagtcaaaaagaaaaatcaaaatgggactttgacagtttaaaaaccatatgttagattaaggttgttaaaaacattaaatttttatttaacaaactttatttacgtcaaggaggcttatatgagtcaaacattattcattgacggagaatggatcagtgccgaaaaagaacagatccgcagtattatcaacccatttaatcaagaagaaattgcaactgtaagcgagggagggcgagaggacgccatcaaagcaatcgcagccgcacgtagagcatttgacaaaggagaatggtcatcgctatccgggcttgaacgcggaaaaattgttctgaaaattgcggaattaatcagacgcgatcttgaggagctggctgagcttgaatctcttgatacaggaaaaacactcgaagaaagcaaggccgatatggacgatatcgccaatgtttttcaatattacgccggcttggcagacaaagatggcggagagatcatttcatctccgattcctgattcagaaagcaaaattattagggagccaatcggggtttgcggccagatcactccatggaattatccgctccttcaagcgagctggaaaatcgcccctgcactggccgcaggaaacacaatcgtcatgaagccgagtgagattacgccgctgacgacaatcaaagtctttaagctgatggaagaagccggtgttccaaaaggtgtcgcaaatcttgttcttggaccgggagccacagtgggcgacgagcttgccgtaaacaaagacgtcgatttgatttcatttacgggcggaattgaaacaggcaaaaaaatcatgcgggcggcaagcggaaacgtcaaaaaaatcgcccttgaacttggcgggaaaaacccaaatattgttttcaaggacgcggatttagaagttgcggttgatcaggccttaaacgctgtatttttccacgccggccaagtatgctctgcaggttcccgcttgcttgttgaggatgccattcatgatcaatttttggcggagctggtcaaacgggcaaaacgcataaaactcggaaacggttttcatgctgagacagaaagcggtccgcttatttcggcggagcacagggcaaaggtagaaaaatatgtagagatcggaatagaggaaggcgcgaagctggagacaggaggcaaacgcccggaagatcctgagcttcaaaacggctttttctatgaacctactattttctcaaactgtaattctgacatgagaatcgttcaggaagaggttttcggtcctgtattgacagtcgaaaccttcagctctgaagaagaggtaatcgagcttgcgaatgataccatctatggcttggctggagcggtatggtcaaaagacattgaaaagtgcgaacgggtagcagcccgcttgagaatgggaaccgtttggatcaacgattttcatccgtactttgcacaagcgccatggggcggatataagcaatccgggttcggacgcgagcttggaaaaataggccttgaagaatacacagaagtcaaacatgtataccgcaatacaaaaccggcagcggttaactggtttaattcataagagggggagattgatgatgacattaaatatgaaggtagaaagcatgcagaaattccacacatttgaaattccgactgtgattaagcatggaatcggagccatcaagcatacgggtgaggaagtagctgcactgggcgtttcaaaagcgctccttgtcacagaccctgggatttataaagccggtgttgctgatcccgtaatcgaatcacttaaagaagcaggcattgaagtggtactctttaataaagttgagccaaacccgcctgtccgtctggtgaatgaaggatctgagctttacaaaaaagagaactgtaatggtttggtggcagtcggaggcggaagctccatggatacagcaaaagcaatcggagtagaagcgactcacgaaggaagcgtgcttgattatgaagcggcagatgggaaaaaaccgctggaaaaccgcattcctccgctgacgacaattcccactacagctggaaccggatcagaagtaacccaatgggcggttatcacagatgaagaaagagaattcaaattcaacacgggcggtccgctgattgcagcgcacttgacaatcattgatcctgagcttcatgtttcaatgcctccgcatgtaacagctatgacgggaattgatgcgctcgcccatgccattgagtgctatacaatgaaatttgcacagccaatcacggatgcggttgccttaatggcgattgagtatgccgctcattacatcaagagggcatttgctgatggagaggatctggaagcaaggtacggaatggcgcaggctgcgatgcttgccggtctttcttacggaagtgaatcagcgggcgctgctcatgcgatgagccaaacgcttggcggtattatcccagtcgctcacggccaatgtgtagcggcgatgatgggccctgtcatggaatacaactggaagggctatcctgagaagtttgcgcgtattgcgaaagcgttcggtattgatacaaggaagatgacaacagaagaagctgcgaaagcatctgtcaattggatgtatgatctggtcgaagatttagaagtgccgactttagaagagcagggagtatcacctgatatgatcgaacgcttgtctaaagaagcaatgaaagatccgcaaaccttcggaaaccctagagatttaaatgaaaaagcatacaactggatctacaaacgctgctttaaccttacgcctaaaacggtataatcaaaatcccgctcctttacagagcgggattttttgggataatgaagcataggtggaaattttagataagaaggaaggtgccagctgatgtggaagcgtatgactgcaaaagcggaaggcttatatatcgcagatacaaaaagcttcgtaacaaagcaaatggacaagcttgattttgattatggcggcatccccggcgacttgcattttggcctgaccaaaaaagcgggagccagagaaccaatgttttcaagagggactgaaattttcaaccgcagacaaatttcaattgtttcaatagaggaatgcaacgaaatcgctttaaaaatgggagtgccgagaattttgccggaatggctcggggcgaatgtggcagtcagcggtatgccagatcttacttcattaaaagaaggaagccggattatttttccgagcggagcggctctgctgtgtgagggcgaaaatgatccgtgtatccagccgggagaagtcattcagtcttattatccggaccaaccgaagctggcgtcggctttcgtccgccacgcactgggcattagagggattgtctgtattgtggagagacctggtgctgtttacacaggtgatgaaatagaagttcattcctatcagcgaaaagtcaaacgaaaagcagaaagggtctgattaaatcaggccctttctatcttttctttaatttctttcatttggctgaggtgccgtttttcatgatggccgataaaatcgatccactgtctgacagtcagctcttgaaacacaggatgcggaagcactctttcaaaatcttcttctttcagagaggcaatcgcagcagtcagctgctctcttaccacatcaagctcacgtttcatttggctgcctgaaataaaatcatgcgcaggctcaagatgactcggggctttccgtttattatttctgtcctgtgctacttcaagcggtttttcttcaatttctttaatcggagcgtcctttacacgttccttcaacattttttgtgcggtcatatcgatttttttcaaatggtcaagaacttcccgtatgctccattcttcagcagaaggcttttgattcagcttttcgtcagaaagtcctttcaattcgttccacgtttctaatctggcttcattaaagatactcatcatatctcctcctaaaatgacattaccatatatataagcaattatcatttataaagcacttcaaatgggttatttgtcttaaaattttgaaacttttcccgaggtgtctcgtataaatggtaacggcagccgttcatcaatgcattgatgaagaaaggatgaggaagttggagttatttggagtacctatacaaacaatgtatctttatacgcttattattgcgggcagccttacgctgttattcctgtttttcggagatgtattttcagggctgtcagaaggcattccgtttcttaatccgacattagtgctctcattttttacatgtttttcagcgggcggatatataggtgaacttgtattgcctctgtcaagcttgctgattgcgcttttatcttgcatcctttcgatcatgctggtggtattgcttcacatctttgtactggtgccattatcatctgcagaagaatcattggcatatagagaagatgatctcagaggaagactcggtaaagtgattacagctgtgccggttgacgggtttggtgaagtggtcatagaagggataggcgggaccatttcaaagtcagcggtcagttttgataatcagcagatcagttacgggacaacggtgttagtcgtagatattaacaacggagttctttcggttactccgcatgaacccatttaacataaaaggaggaatttgatatgacaatgccgattataatgatcatcggagttgtattctttttattaattgcactaatagctgtgtttattacgaagtatcgtacagcagggcctgatgaagcgttaattgtaacagggagctatctgggtaataaaaatgttcatgtcgatgaaggcggcaaccgtattaaaatcgtccgcggcggaggaacctttgtccttcccgtcttccagcaggcagagccgctaagcctattatcaagcaaactcgatgtttcgacacctgaagtctatacagaacaaggagtgccagtaatggccgatggaactgcgattattaaaatcggcggttctataggagaaatcgctacagcggccgaacaatttttagggaaatcaaaagacgaccgtgagcaggaagcgcgggaggttttagaaggccaccttcgttccattctcggctcaatgacagtagaagaaatctataaaaacagagaaaaattctctcaagaggtgcagcgtgtcgcttcacaggatctcgcgaaaatgggacttgtaatcgtctcgtttaccattaaagatgttcgtgataaaaacggttatcttgaatcattagggaaaccgagaattgcccaagtaaaacgcgatgctgatatcgcaacagcagaggctgataaagaaacccgaattaagcgggcagaagccgataaagacgcaaaaaaatcagaacttgaacgggcgacggaaatcgctgaagctgaaaaaatcaatcagctcaaaatggctgaattccgcagagaacaagatacggcaaaagcgaatgccgaccaagcatatgatttagagactgcccgagcgcgccagcaagtcacagagcaggaaatgcaggttaaaattatcgaacgccaaaaacaaatagaactagaagaaaaagaaattcttcgccgtgaacgtcaatacgactcagaggtaaagaaaaaagccgatgcagaccgttattctgttgagcagtccgcagcagctgagaaagccaaacagctcgcggaagccgatgccaagaagtacagtattgaagcaatggcaaaggctgaggcggaaaaagtaagaattgacgggctagcaaaagcagaagcggaaaaagcgaaaggagagacagaagcagaggttatccgcctgaaaggtcttgcagaagcggaagcaaaagagaaaattgcggccgcctttgaacagtacgggcaggcggcgattttcgatatgattgtcaaaatgcttccggaatacgcgaaacaagcagcggcacctctttcaaatattgataaaatcaccgttgtcgatacaggaggaagcggtgaatcaagcggagcaaacaaagtaaccagctatgcgacgaacttaatgtcaagtctgcaagaaagtttaaaagcatcctcaggaattgatgtaaaagaaatgcttgagaacttttcaggaaaaggaaacgtaaaacaaagcattaatgaattaacaaatgaaatcaaagaagccaaaacgatccaaaaatcagagtaaggaaagggcagaaccgtatggtaactgtacgtgaagcgaagttagaggatataaaggacattgcaaaagtgcatgtagacagctggaggacaacataccacgaaattatcccgattgattatttaaacagcctgaactataaggaatttgaagacaaatggaaaagtcgctcgttaaagggagtatttgttgctcaggacgaaaagggttcagtattcggctttgcttcatttggacctattcgctctgaacaagaaggctatgacggcgagttatacgctatttatcttctggaagagcgccagcggcaaggtgcaggcagggcgctcttagcaaaaggagcggagtttttgcttcaacatggtttttcaagtatgtttgtttgggttattgagcagaatccctcgattatattttatcaggcctattcacctgaaagagtagcggaggacaactttgaaattgccggagtaaggctgaaagaagtaggtcttggctggccggatctttcagctttaaaaacacttcttaacagataacgaaaaatcccccagcggaattcgctgggggattgttacttttacgctttgtcacttttaagcagacggggtgctgtcataaataataaacataggacaattgcacaaataatgaatgaaggaaccatgtaagtcgcattataagttaaagaataaatccataccggtgttccttttggagcaaagctgccgaaaaacacagctcctgaaatgacatgcgcggcatagcgcagcaaactgccgataaaaactgcgctgaccactgaaacaatcaatttcccttttgtttttgatacagcggctttacggacagaagaagcgaaacagccgcttatgccgattgctgcgaaagcgacaatgtaatctaacaatagctgtacaggatgttgagcaaacaagtttccgattgctatttgtactagacctgtcaacaaacctgtagtaagacctgctttgacaccccagcgaaacgaaattaaaaagatcggaatcatcatgatggagaccgagcctccttgaggcatgctaagaaacattcctgagacaatgtctaaaataacggctgccgctgtcataatggcaatttcaataaggcgaaccagttgcttagattgattcatatctatctccttccattgacagacaaccaaaaggacaacaaaaaagcagcacgcggaaggatgagaaaagttccacgcactgctttacgatctgcaattcatttgactttgccacatccctacgccagcgttaactaacaggttcaaagggtcagaacgaaaccgctcactctcagctttaatgctccccttgtggtcatcagtatttagttcgtttctactatacaagaaaacgaaaaaaacaacaagatcacatgactgatgtatatgttcttttaagaaacttatatgatacacacgctttagaaatcatggcgaggattatagtttatttgttttatagattttttttaaaaaactattgcaataaataaatacaggtgttatattattaaacgtcgctgatgcacagcggacacaaactagatgcttcaaaacaacttgaaaaaagttgttgacaaaaaagaagctgaatgttatattagtaaagctgcttcattgagaagtaacgaaatgatctttgaaaactaaacaagacaaaacgtacctgttaattcagtttttaaaaatcgcactgcgatgtgcgtagtcagtcaaactagggcctgcacgacgcaggtcacacaggtgtcgccgcaggatgcggtgaacttaacctgtgatccatttatcggagagtttgatcctggctcaggacgaacgctggcggcgtgcctaatacatgcaagtcgagcggacagg

SEQ ID NO: 47 - DNA, 2965 bp, Bacillus subtilis WAUSV36
aaacgtgttctttgaaaactagataacagtagacatcacattcaattagtaatacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaattcataggatatgagaaggcagacccggggaactgaaacatctaagtacccggaggaagagaaagcaaatgcgattccctgagtagcggcgagcgaaacgggattagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaacgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaattcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggc

SEQ ID NO: 48 - DNA, 206788 bp, Bacillus subtilis WAUSV36
gatctatatgaaatcgggaagtagctcagcttggtagagcacatggtttgggaccatggggtcgcaggttcgaatcctgtcttcccgaccattcttggggccttagctcagctgggagagcgcctgctttgcacgcaggaggtcagcggttcgatcccgctaggctccacttgatttcaaaaatatttggcggtgtagctcagctggctagagcgtacggttcatacccgtgaggtcgggggttcgatcccctccgccgctaccaatggacctttagctcagttggttagagcagacggctcataaccgtccggtcgtaggttcgagtcctacaaggtccaccactatacggaggaatacccaagtctggctgaagggatcggtcttgaaaaccgacaggggtgtcaaagcccgcgggggttcgaatccctcttcctccgccatacatattcctaatcatcgcggggtggagcagttcggtagctcgtcgggctcataacccgaaggtcgcaggttcaaatcctgcccccgcaaccaaattttaaaatggtccggtagttcagttggttagaatgcctgcctgtcacgcaggaggtcgcgggttcgagtcccgtccggaccgccatttaaatacttaggctcggtagctcagttggtagagcaacggactgaaaatccgtgtgtcggcggttcgattccgtcccgagccaccatttatcaatatgctttggcggttgtggcgaagtggttaacgcaccagattgtggctctggcattcgtgggttcgattcccatcaatcgccccaaataaaaattgcgggtgtagtttagtggtaaaacctcagccttccaagctgatgtcgtgggttcgattcccatcacccgctccatttctatatcgtcatgggcctgtagctcagctggttagagcgcacgcctgataagcgtgaggtcgatggttcgagtccattcaggcccaccatgacttttgttccacagtagctcagtggtagagctatcggctgttaaccgatcggtcgcaggttcgaatcctgcctgtggagccaaatggagaagtactcaagtggctgaagaggcgcccctgctaagggtgtaggtcgtgtaagcggcgcgagggttcaaatccctccttctccgccatatgattacagatatcataattatcggcccgttggtcaagcggttaagacaccgccctttcacggcggtaacacgggttcgaatcccgtacgggtcatccagaagccttgcatatcctgcaaggtttttttgtttttataaatcatgatatgtcttagattttgttctttattttaaaaacagactacaaaaatctccatatatttcgtttttcttcagaaaatgaagttaattgtctataagtataagcgctttcaggaaagggctttttttatttcttcgaataaatactataaatgaaaactatgatgtcagaaaggatgattacatggccgctgccagcccgacagcacatgatgtttatctttttcacgaaggcagtctgtttaaaagctatcagctgtttggctcgcattaccgcgagctgaatggcaaaagcggatatgaattctgtgtgtgggcgcctcatgcgtcggaagtacgagtggctggagattttaacagctggtctggagaagagcatgtgatgcacagagtgaatgataatggcatttggacgttatttattccaggtataggagaaaaggaacgatataaatacgaaattgtgacgaataacggtgagatcaggctgaaggcagatccatacgctatttattcagaagtcagaccaaacacagcgtcacttacttacgatttggaaggatacagctggcaagatcaaaaatggcaaaagaaacagaaggctaagacgctgtatgaaaaacctgttttcatttatgaactgcatcttgggtcttggaagaagcattctgatggcaggcattattcctataaagaattaagtcagacgcttatcccttatatcaagaagcatgggtttacccatattgaactgcttcccgtgtatgagcatccatatgatcgttcatgggggtaccaaggaacggggtattacagcccgacaagcaggtttggcccgccgcatgatctgatgaagtttgtggatgaatgtcatcaacaaaatatcggagtcattttggattgggtccccggacatttttgtaaagatgcacatggcctttatatgtttgatggagaaccgctttatgaatacaaagaagaacgtgatcgggagaactggttatggggcacggcaaactttgacctggggaaaccggaagttcatagttttttaatttcgaatgcgttgtactgggcggaattctatcatatagatggatttagggttgatgcagtggctaatatcttgtattggccaaatcaggatgaacgccacacgaatccatatgctgttgattttttaaaaaaactcaatcaaaccatgagagaggcatatccccatgtgatgatgattgcagaagattctacagaatggcctcaagtgacaggtgccgttgaggaaggggggcttggttttcattataaatggaatatgggatggatgaatgacgtactgaaatacatggagacgccgcccgaagaaaggcggcattgtcatcagcttatctctttttcattactatatgcgtttagtgaacattttgtattgccgttttctcatgatgaagtcgtatacggaaaaaaatcacttctcaataaaatgcctggcgactactggcagaaatttgcccagtatcggcttttgctgggctatatgacagtgcatcccggaaagaaattgatctttatgggatcagagtttgctcaatttgatgaatggaaagatacagaacagcttgattggtttttggactccttccccatgcatcagaaagccagcgtttttacgcaagatcttctccgcttttaccaaaaaagcaaaatcctttatgagcatgaccatcgtgcacaatcgtttgaatggattgatgtccataatgacgaacaatcaatcttttcttttattcgttatggccaaaagcacggtgaggcgcttgtcatcatttgtaattttacacccgtggtctatcatcaatatgatgttggagttcctttttttactcaatacattgaagtgcttaacagtgacagtgaaacatatggaggctcagggcaaatcaacaaaaagccgttatcggctaaaaagggagcacttcatcataaaccgtgttatatcacgatgaccatccccccttacggcatctcgattttacgggcggttaaaaaaagaggagagataaaaagatgaaaaaacaatgtgtagccatgctccttgccggcgggaagggcagccgtctcagcggattaacaaaaaatatggccaaaccggctgtatctttcgggggaaaatacaggattattgattttaccctaagcaactgttctaattcaggcatagacacagtcgggattttaacgcaatatcagccgctcgagctgaattcctatattgggatcggcagtgcatgggacctggatagatataatggcggcgtgacggttttacccccttatgccgagtcatcagaagtcaaatggtataaagggacggcaagctccatttatgaaaatctcaattatttgaatcagtatgatcctgagtatgtactgattttatcaggagatcacatatacaaaatggactacggcaaaatgcttgattatcacattgaaaagaaagcagatgtgaccatctctgtcatcgaagtgggctgggaggaagcaagccggttcggcatcatgaaggccaatccagatgggacgatcacacattttgatgaaaagcccaaattccctaagagcaatcttgcctcaatgggaatttatatattcaattggccgcttttgaaacagtatcttgagatggacgatcaaaacccttattctagccacgacttcggcaaagacattattccactgcttttggaagagaaaaagaagctttctgcttatccgttcaagggatattggaaggatgtcggaacggtgcagagcttgtgggaagccaatatggatttgttaaaagaggactcggagctgaagctgtttgaacgcaaatggaaaatttactccgtcaatccaaatcagcctccgcaatttatttcatctgatgcgcaggttcaagattcgcttgtgaacgaaggttgtgttgtatatggaaatgtgtctcactccgttctttttcaaggtgtgactgttggtaagcatacgactgttacatcatccgtcataatgccggatgtgacgattggggagcatgtagtcattgaaaatgccatcgttcctaatgggatggtgctgccggatggcgcagtgattcgctccgaaaaagacattgaagaggtgctgctcgtttcagaggaatttgtagaaaaagaattgatttaattactgaagagggggcagagtcagtgttcaataatcaaatgttaggtgttatagatgaaaccacatataagcattctcttcaggatttaacagcacagcggtcgctcggggcgatcccttttgccggcaggtaccgactgattgattttatgctttccaacatggtgaatgcggatattaggagtgttgcaatttttccgaagtatcgttaccgttcgctcatggatcaccttggggcgggtaaggaatgggatttgcaccggaaaaaggacggcctcttttttttcccgtctccccatcttcatcacgaatacgatgaattcggttcctttcgccagttttcggaccatctagattacttccacagaagcactcagcaatatgctgtaatctccaacagccataccgtatgcaacattcaatttcaatatgtgctgaaacgccatcaggaggttggctgcgacgtcaccgaggtatttcaggacggccagtcgctgcaaatctatatcatgtcaacaacgcttttaaaggatctgatctacggacatagcgaaaaaggctataaaaccattcaggaggctgttgaaaaggaatcttccgccctgaccatttgcccttatgaatattcaggttatgccgctgtcattgattcggtggaaaaatattatacccacagtatggagctcattcagcctcgtttttggcagcaggtgtttttgccgcagcagccgatctatacaaaagtgaaggatgagccgcctacgaaatacggaaagcacagcactgtcaaaaattctttggtggcaaacggctgtgtgcttgaaggagaggttgaaaactgcattttgttcagggcggtccatgtcggaaagggtacgaagctgaaaaactgcattattatgcaaaaaacgcagattggagaggattgtcttcttgagcaggtcatttcggataaggatgttaaaatcggcaaggcgacggaagctgcaggaacagctgagcagccgcttgtattaagaaaaggtttggtgcaaggagagctgatgaattcttgaagatattatttgctgtgtcagaatgcaccccatttgtgaaatcaggaggtcttgccgatgtagcaggtgctctgccaaaggcgcttgcgcgattaggcaatgaggtagctgtgatgctgccgaagtacagccaaatacctgaaccgtggaaaaagcgtatgaaaaaacaggctgagtgtaccgtagctgtcggctggcggcagcaatattgcggaattgaacatatggcagagaatgatgtgaattattacttcatcgacaatgagtactatttcaacagggattcgttgtacgggcattatgatgacggtgagcggtttgcctttttttcaagagctgtgctggaggctgccaaagttgtgaatgttcaagccgatattgttcatactcacgattggcatacagcgatggtcaattatttgctgaaagaggagtacagaaaacatcctttttatgaacggatgaaaagcgtgctcacgatccacaacctgcagtttcaaggcatattccctcctgatgtcacacatgacttgctgggtcttgagatggatcattttcattatgaaaggttagaatgcaacggatttgttaattttatgaaagcgggcatcattgcggctgatcatgtgacaactgtgagccccacttacagaaatgaaatcatgacgccgtattatggtgagcagttggaacaggttttgcaatatagggaagatgatgtaaccggcatattaaatggcattgatgatacgttctatcagccgaaaagcgacccttatatagaggcgcaatacgattcaggggatcttgcatgcaagctggaaaacaaaacgaagcttcagcagcggatggggcttccagagaaaaacgatattccgctgatcagtatggtgacaaggctcactaaacaaaaggggcttgatcttgtccgcagaattatgcacgaacttcttgaggagcaagacatacagctggttgtgctaggcacaggagaacgtgaatttgaagattatttccggtatgcagaatttgcttttcatgagaagtgccgggcttatatcgggtttgatgagccgctagcccatcaaatttatgcgggctctgatatgtttttgatgccgtcgaaatttgagccgtgcggtttggggcagctcattgctcttcaatatggcgccattccgattgtcagggaaacgggcggtctttacgacactgtccgtgcctatcaggaggaagagggaacgggcaatggctttacgttttccgcctttaatgcgcatgatctgaaatttacgatagaaagggcgctgtcgttttattgccaacaggatgtatggaagagcatcgtgaagaccgctatgaatgcagattacagctgggggaagtcggctaaagagtatcagcgtattttcgagcaggtgacaaggagtggacgggatgttctcgagtaaagaacgctttgcagacttatttttaaagcgtctggaaatgacgtgcggaaaaagctttaaagattctgccaagctggatcaatataaaacgttgggcaatatggtcagagagtatatcagcgctgattggatcgaaacgaatgaaaaaagcagatcaaattccgggaagcagacatattatttatcaatcgaatttctgctcggtcagctccttgagcaaaacttaatgaatcttggtgttcgtgatgttgtagaagctggtttaaaggaaatcggcatcaatttagaggagatccttcagatagagaacgatgcaggtctcggcaatggcggacttgggcgcttggccgcttgctttttagattcgcttgcttcgttgaacctgcctgggcacggcatgggcatacgttataagcatggtttgtttgagcaaaaaattgtagacggacatcaggtggagctgcctgagcaatggctgaaaaacgggaacgtatgggaagtaaggaatgcggatcaagcagtggacgtgccgttttggggcgaagtccatatgacagaaaaaagcgggcgcctgcattttcgccatgaacaagcgacaattgttaccgctgttccttatgatatcccgatcatcggctatgaaacgggcactgtcaacacgttaaggctttggaacgccgagccctatgcccattatcacggcggtaatattttgtcttataagcgagaaacagaagcggtttctgaattcttatatcccgatgacacccatgatgaggggaaaattttacggctgaagcagcagtattttttagtatgcgcaagcttaaaaagcattgtgaacaattaccgtaaaacacataaatctttatccggcctgcataaaaaagtgagcattcatattaatgacactcaccctgcgcttgcggtgcctgagctaatgcggattttgctcgatgaagagaacatgagctgggaagaagcttggcatatcactgtacatacgatttcttatacaaatcatacaacattgtcagaagcgctcgagaaatggccgattcatttgtttaagccgctgctcccgcgaatgtacatgattattgaagagatcaatgagaggttttgccgtgcagtttgggaaaagtatcctggagactggaaaaggatagagaacatggcgattacagcgcatggtgttgtcaaaatggctcatctggccatagtaggcagctacagtgtaaatggcgttgcaaaaatacattccgatatattaaaggaaagggagatgcgcgactttcacttgctgtttccgaatcgttttaacaataagacgaatggaattgcccacaggcgctggctgttaaaagcgaatccaggcttgtctgccatcattacagaggcgatcggcgatgaatgggtcaagcagccggaatcactgatccgtttagaaccgtacgccactgatcctgcatttattgaacagtttcaaaacaacaaaagcaagaaaaaacaagagcttgccgatttgattttttgcacggccggggtggttgtgaaccctgagagcatattcgacgtacaggtgaaacggcttcatgcatataaacggcagctgctgaatgttcttcacattatgtatttgtataaccgcctcaaggaggattcggggttttcaatctacccgcaaacctttattttcggggcaaaggcttcaccaagctattattatgccaagaaaatcattaagctgatccattctgtcgcagaaaaagtcaattatgatccggcggtcaaacagctgatcaaagttgtttttttagaaaattatagagtttctatggctgagcgaatttttccggcatcagacgtaagtgagcaaatttcaaccgcaagcaaggaagcgtctggtacagggaatatgaagtttatgatgaacggggctttgacgatcggcacgcatgacggcgcaaatatcgagatccttgagcgggtgggccctgactgtatttacacgttcggcttaaaggcggatgaggttctatcgtatcaggaaaacggcggctataggtcgagggaatattatcagcatgacaggagaatcaggcaggtagcggatcagttgatcaatggtttttttgaaggagaggcagatgaatttgaatcgatctttgactcgctgcttccgcataatgatgagtattttgtgctgaaggatttcagctcatatgcagatgcacaggagcgaattcaagctgattatcgagagcgaaggaaatggtctgagcattcgattgtaaacattgctcattctggatatttctccagcgaccgcacgatccgggaatatgcgaaggacatttggggcatcaagccgatgatgtgaaaaagccgctgtataagcggctttttttgttcacagattcattgaattgattgtaaaggataagaacgtcgcaaatgcactccataaaaaataaggcaaaagaagatagcttgcggctctgctgtattttttggcaatgatcagtaatacgattgctgtgatggcgacaagcaggcagtcaagcgatgcagccagcagatttttttgcgtaaactggaaatagctgaaggcttgattgagcacgtaatttatcaaaagtgtaaaccaaaagcttttcgcacctttaaatgaaaacgcagcatatacaatggctgctgaaagggagatcagggcaaacaggatggcccaaatgatgccgatcgcagttccgcttggcgtccagtccggttttttcaatgaattgtaccattcttggtccacaggaaacaggtagcctgcggctgaaaacagcgcatatgtaatcacaaaaacggctaaagcgccgacaatctttttcatatttgcaacctccgcatgtatttaattaccctttatcttataaatatcaaacccccgatatgcgggggaaatgatggtcttaaataagctgccgcaatgcgtttgctttaatgcgttcatattcaaaagctgattctaattcttccttcggtaaagcagacttgcggacgtatttttcgcgaatgacatcgtaaagctcgtaaggaaacagcatatcaataaacatgacttgtttttgttcttcagttaatggggctctggattcgtatgcgttcagcatgacattaaatgtttcgtcatcccaaacacccgtcgtatccaaaagcggaataatcattttgcgcaaatcgcgaataggcagatcaaatgatacggtatctaagtcgatgacccaaatctgttcattttctcctaagagtgtattcccggttccgtaatcctggtggcaaaggttagggctttttttcagctgttcagtccatggaacataggtcgattgcaaaagccggtctttgatgcgcagcccgtcttcaataaagccatctatctcctgaagataaagctgtgagaaaggatcttctttttccgcctccgccatcagcttccacgtttccatctgtttgcatcgtttcgtgtagtgattcggccagcgacctaatttggtaaatatgggaacgccatttggcggctgatatccgacggaagctgtatgaaaatcagcaaggcctttcatgataaactccaagtcctgctttacagtcagctcaaacggtcttccttcgatccagtcatatacgacaaatagaaatgagccgtgcttagaatataggctgccttttttgtttgggagtatgccaggaacattcatgcctttttttgctaaatagtcctgcgcgaaaatggaaaacaacgctttcttttctggcctgtgtattcgttttagacaaaccgcgccggagtctgtgtggaccttccagacaagcgccatctggtttccctgaatgacgtctattttttcagcctgcacatcccatccttgaagcacattttcagccagctccgttaatttttttgcatcttctgctgataaaggaagctctgatgaattcccctcctcaatgacttcatggttttctgccattaaaggacacatccttacctgttttactcctaccttatgaatcaaaaggaaaaaatgattgagttatttgactatatttaatagatgaatctggttgtttacccgttttgtttttagggcagtcccattccgcacaagttggttgttcagccgtatcatgattctaactagttaaaaatcatgcaggaatggaggctatgtatgaaaatagcactgatcgccacagagaagcttcctgtcccatcggttcgaggaggcgccattcaaatctacctcgaagcggttgcccctttaattgcaaaaaaacatgaggtgactgtgttttctattaaagatccgaatctcgctgatagagagaaggtagacggtgtccattatgtgcatttggatgaagaccgttatgaagaagccgttggagcagagctgaaaaagagccgttttgatcttgtgcatgtttgtaatcgcccaagctgggttccgaaattgaagaaacaggcgccggatgctgtttttattttaagcgttcacaatgaaatgttcgcttacgataaaatcagccaggcggaaggcgagatttgcatcgactccgtagcgcagattgttacggtcagcgattatatcggacagacgatcacaagccgttttccgtcagcacgatcaaaaacaaaaacggtgtattctggtgtggatttaaaaacgtaccaccctcgctggacgaatgaagggcagcgagctcgcgaagagatgcgaagcgagctggggcttcacggcaaaaaaatcgtcttgtttgtcggccggcttagcaaagtcaaaggcccgcacatattattgcaggctttgccggacatcattgaggagcaccccgatgtcatgatggtgtttatcgggtcaaaatggttcggagataatgaattaaataactatgtcaaacatcttcatacccttggtgcgatgcaaaaggatcatgtcacatttattcaatttgtgaagccaaaggacattccgcgcctttataccatgtcagatgtatttgtatgctcttcgcaatggcaggagcctttagcaagggtgcattatgaagcgatggctgcgggacttcctattattacaagcaatcggggaggcaatccagaggtcatagaggaagggaaaaacggctacatcattcatgactttgaaaatcctaaacaatatgccgaacgtatcaatgatttgctgagcagctcggaaaagcgggaacggcttgggaaatacagccgccgtgaggcagaaagcaattttggctggcagagggtggctgaaaatctgctcagcgtctatgaaaagaacagatagaaggggtgaacagagtgtaccaaaaagagcatgaagaacagattgtgtccgaaattctcagttattatccgtttcatatcgaccatgtggcgctgaaatcgaacaaaagcgggcgcaaaatctgggaagtcgaaactgatcatggcccaaagctgctaaaagaagcgcaaatgaaaccggagcggatgctttttatcactcaggcacacgcccatttacaagagaaagggctgccgatagcgccgattcatcaaacaaaaaatggcggtagctgcttgggcacggatcaggtttcttacagtttatatgacaaagtgacaggaaaagaaatgatttactatgatgcagagcaaatgaaaaaagtcatgtcatttgccggccattttcatcatgcctcaaaaggatatgtttgcacagatgaaagcaagaagagaagcaggctgggaaaatggcacaaattgtaccgttggaagctgcaggaacttgaagggaatatgcagatcgcagcatcctatcctgatgacgtattttcgcaaactttcttaaaacatgctgataaaatgctggcaagaggaaaagaagctctcagagcgcttgatgactcagaatacgaaacctggacaaaagagacactcgagcatggcggattctgttttcaggattttacattggcacgtttgactgagatcgaaggggagccttttttaaaggagcttcactcgattacctacgatttgccgtcaagagaccttcgtattctgctgaataaagtgatggttaagctttctgtatgggatactgatttcatggttgcactgcttgcggcctacgacgcagtgtatccgctcacagaaaaacagtacgaggtactttggattgatctcgcgtttccgcatttgttctgtgcaatcgggcacaaatattatttgaagcaaaagaaaacgtggtcagatgagaagtataactgggcgctgcaaaacatgatttctgttgaagaatctaaagattcgtttttggataaactgccggaactgtataaaaagataaaagcgtatcgggaggcgaattgacatgaggtcatcgagacaaaaagcctctatttctaaactggatctcgaccaattcgtatttacaccgcctggaccgatgggatggcaggctcatgactcaatctcagctgagaaggaagaagaggagaagcatttagatgtgggcagcattcgagagctccctcacatcaatgcaccgaaagaatatcaaaaagaaacgaaggaaaaggaaacagatcgcaaaatcgtcgatgatgaagaagaaacaaaattcgaaaccactctggagcctgaggaggagcgtgattcgaaacgctcagcgcccccatatgaagaagaggatgaagatgaagaaccagacttagcggaagaagctaaagtggaaatcatcattcttccaagtgaatctaaaccagctccatggttttctcaaactgtaaagcgcaaggcataaagtcacatttatgcctttttttaagttctctgtagcgaaaaaacagcccgttttgcaacacgagctgtaggttttatgtttttgctttcacaaaaagctgattgatagatgataaatcaaaattttgcgtcagaaaaggcggcggaaattgtttgtttttcggggtcagaacggattggtaaacagtattgagccttttggcagcatgggtaaaggtaaataaagcttctacatgctttcgggcgttttttgtcattttgttcattaattcttgatctgtaaaggctctgtcaattgcttttgcaaatgaagaaggtttgttgtagctatcgatgacaaggccggtgacttcgtgttttacgacttcaccgtttccgccccggtttgtggtaattaagggcgtgccggccgccattgcttcataattcacacgggcgaggggttcgttccactgagagctgcacacaaatacatctgccatcagaaaaaggtttgggatatcgtctgcgggaatgaattttgtaaagattatgtggtctctgtatggcagcgccagcgtgcgcagataggtgacatattggttttcgctgtcatcgctgaaccacttcccgcctgctatgaccagtacagcatcagggtgctgctgcaaaatccgtctcatgctgtgaatgagaaggtgaggcccttttgtcgggcttaagcggccggcgaataaaataacttttttatcttcaataccgtattttttccggtatgtttttctgacagccgagcctttcatcgtccagacgggcggataagagtttaaatcaacgccggaatacacaacttttgtgatgtcctcggcttcagggaaacgttcaatgacggtttgtttaataaattcgctcactgttgtgatcatggagacattgtcgagtacttcttttccttgcgcgaaggtcatctttttttcagaaaacatttcgttatgcaggctcagaacgatcttgctgtttggtgaggcttttttatataaagagacatttaaaggcctgttgaacacatgaatgaggtcaaaggaagaggctcgcagctcttcggctaccgcctcgcggtaatgttcttttggcagatggatataatgtacgccgtcttttgtttctctttttgggagcgatggatcttctattgaaaaaatggtcaggtcgtacctgctgctgaaatagggcgtgacaccgtcaatcatcatttgaatagcgccgccgcgtactgcgggcgccggcagcttttctgtacagataaaggcaagcttcatttttattccccctgatacagcgacgataaataggcgatttcgttggtcaagccatcctttaaggatgtggcgggatcataatgcaagagctgttttgcttttgaaatatccgcccacgtgttgctcggttcccctgctattttgtccgaaaagtgcagtgttgcttttctcccggaaatatcctcaatgagggagacaacttttaagactgaggcacgctctgcgccgccgatatttactgtttcaccaataaggtggggtttcccaagaacagcggtgatgcctttgacacagtcgctgatataagtgaaatctcttgactgctgcccatcaccgaagatggtaagcggcttttgctgaaggtgctgcttaatgagccggtgaaaagccatatccggccgctgtcttggcccgtatacggtaaaaaaacggagaatcacaattggaatgccaaagctctgtttatacacatggcaaagcttttctcccgtaagctttgttaccccgtacggagataaaggagaaagcgacgtgttttcgctgacttttccttgtttttcgccatagacggaagaggtggatgcaaagacgaacgtttgaatagaatgttcccggcacgcctcgaggagcctttggagcgcttggatattatgtgcggcatatgggtgaaaatgattgccccagcttgagcggacacccggtatggccgccaaatgaaagatgacgtccactccttccagtaaggaagcaagatcggctgtcagcagattttcctttatgaacgtaaatcgcttttccggcagcaggtttttaaggtttttaatttcaaggaaaatggagtaggaccgataaagtcatcgattccgataacgttatgtttcttatcttttagtaattcttcgcagaggtgggagccgataaagcccgctgctcctgtgacgagtattttcatggacggccaactcccgtacagatcaggccgcaagcctcgatcagttctttttttagtacgttgcgtccgtcaatcacaagacgccctttcatgatatctgcagcctttttccaatcaaacgctaaaaactcagaccattctgtcgccaaaaataaaaagtcactctcttcgatcgcatcaaaagcttgagaatgctgagttacatgttgccgcaaatgttctggaagtacagcttcaggatcatatgcatgaacatcacatcccagctccgccagcctttccatcagtctgacagcctgagaattccggatgtcatcagtattcggtttgaaggaaatgccgagtacagccgctttcttgccttgaagtgtttcgaagaatgactgtatttttttgatatacaggccaagctgggtgtcattaatgtgctgcacggcccggagcaggaaggtctccgtgtttttttcctgggcagcaaattgcagcgcctgcagatcctttggaaaacaagagcctccgtatccgatgcctgcctgcaaaaagtgcttcccgatccttgggtctagaccgatagcgcgggaaatatctgagatatctgattgataggcttcacatatgcgggccatttcgttaatgaacgaaattttggccgctaaaaagaaattgttggcatatttgatcagctctgctcccgctaagcttgtaacgataaaaggggtatcaatgtgtttgtaaatggatttgacgatggctgccgatacgtgatcttcttcctgaacaccgatgactgttttgtcaggatgcagcatgtcatataaggcattgccttcccgcagaaactccggattggatacgatattaaagaggtttttagacactccggaggcaatcagctgttttgctatgttttcatttgtcccgggcggaacagtgcttttcgtaataatggttttatacgatcggatcgcctcgcttaaatcaccgatgacggactgcagggctttcgtatcagctgatccgtccgaacgcggcggagttccgactgcgataaaaataacgggacattcctccatgctcgatttcacttcagaagaaaacgagagattgccgcaacgaagtattgcatctgaaagcccaggctcgtaaaagggaatgactccttttttcagctgcccgatttttttgacgtctttgtctgtgcatatcatgtcatgtccgatggatgccagtgccgctgatagggttaaaccgacatacccggcgccaaccacacaaattttcatcacctgagctcctttacaagattactggtcatatatcaatatcctattaaaaaagggctggttcgtgattccgctttctgcccagttgcttccgcctaatttcagatgtacaaacatcgggatgcgctcttggaatatcatgtaataaacatgagctgaggggaaaataccatgataaaaaaagcgatcattcctgcaggcggattcggcacgagaaatctgccggtgacgaaggtgattccgaaagaaatgtttccggtaggatctaagcctgtgattcattatcttgttgaagaattaaaggagtcaggcattgaggacattttgatggttgtatcgagccataaaaatctgattgtcgactattttgattcctctttggcacttgaggcttttttggcctctaagaataaactgcatttacttagagagcatcccattccggatatacggattcactatgtgcggcagccttatgcaaagggtcttggcgacgccatttctttcggaaagcaatttgcaggaggagagccttttgccgtcgttttgccagatgatctgattttttccgccaatcagccggctttggggcagctgattgaagcgtatacgaaatatcagtccagtgtgatcggcttaaaagaaacaaaaacggaggatttacatcattacggggtgataaaaggggagcctgttgaaaaagggctttatcgcatacaggatattgtggaaaagcctaaacaaaaccctccgtctcattttgccgcagcagggcgttatattttcacaccggatatttttaatgagctggaggcattagaagctgatagcggaggagaagtgcaggtaacggatgcgataaaagcttcgctcggggcatgtaccgtatacgggaaattgctagagggcgagcggtatgacatcggcctgcaaaaggattatctgaagctgatttacgatatgctgaaaacggaaaagaacccccaataattgggggttcaatcagcgtggagatcgccgaatgtggtcatgattccctcttcgtcaagttcttcttcatagcgctcatgggctctgctttgataaacggtaatttctttcccagtgatatctgtagcgatgaaattttcgtaagactccgtattgccgatattctcttcggcattcatcgtcatatcatcatagctgagcggagggttttccatatcctgcggcgtttgtgagttcccatatttttcgacatcctgataggaatcctcactgtcatatggcgctctgatttcttcatcatcatcaaattcaaattgcccgaatggtgtttcttcttcaatcggacggtctttggaaaccacgtcctgtgacgaatactccgcgagggttgtggcagtcggaagcgcttcaagtcgttcgaaagggatttcctttccgctgacttcacaaatgccatacgtaccgttttctatcgccttcaatgaatgctcaatgtcccgaaggtgctctctctcatgcaagtctagagcgatgtctttctcacgctcgtaaagttctgtcgcctgatcgccgggatggttgtcgtatgccgaaagctcaccccacgaatcataaggaaaggctgagttaagctgaaaatgatcattgtctttgaaacggtttaagatatcttttttcgtttgttccagttcattttttaaatgctgaagctgttctttcgtaagcaatgtgatcgcctcgtttctctgtgatgcatacctttagtatgaacagatcgcctgagaactttcataaatggcgggtggaggaatataggaggttttccttttatggtaagcggatacaacctttgctatcagtggagaaagaaatttaagctttgtttctttttcatttctgaaattaggtttataataggtaaggcaggccatttggactgcatgatctgtgtttgacacaaaggagacacaggtgtatggtattaaaagcattttaaggattatggaggaatgtctcatggtgacaacggtgcagcgtacgttccgaaaggaagttctacatgcattacataaagccaaagaagtcaaccatgctgtcttaataagctattcgagacaaatcgagtctcttgaccctctatcatttttcaattacggagcaaaaaaatatacaggcaatcgatttttttggtcagatcctgaaagtgaattgacaatagtcggtcttggcaaagaagcggttttccagacaaatcaaaaaaacagcgagcggtatcgtgaggtttttgaacaatgggagcgctttaaaaagacggcttttcatatttatgaagaagaaaagctgcagcattctgcagtgggacctgtgttattcggaggattttcttttgacccttgcgaagaaagaggttcacaatgggaccatttctcggaaggggatttctttgtgcctgcgcttatgctgacgatgactgctgaaggcccgttcttaacagttaacagatgggtaagcggaggagaagacgcagaagctgttttagaaggcttaaaagcttttgcggcggaatttatggttcccgatttcaagcaagaagatcaggctgtgattgcagcagccgaagagctggataaggatgattggctgaaagcaatcgaaacggccacaagccaaattaaagagaaacaatatgataaggttgttcttgcccgagagctgctgctcacgtttgacggtccaatccaaattgaaccggtgcttaaaacgcttctggacgatcagcagacaagctatgtttttgcaattgaacaagaaggcaaaacctttgtcggcgcgtctccggaaagactgatcaaaagagacggcggcactgtcatgtcttcctgtctggcaggctccattaaacgaggcgtgaatgaagaagacgaccgccggataggccttgaattattaaacgatgagaaaaacctgcttgagcatgatattgtggtaggtatgattcataatgcttttgtatcaagctgttcagaggttgaaaagcctgatggacctgttttgtacaaaacaaaaagcgttcagcacctgtttacgccgattgtcggacagctgcgcgagtctgcttcgatttttgacttaattgagaagctgcaccccactcccgcgcttgggggatcacctcaggaaaaagctgttgacgtgatcagggagattgaaccgatgtcccgcggctggtatgcggcccctatcggctggattgacagccaggataacggggaattcgcggtcgccattcgttcagggctcatcgaaggaagcacagcaaggctgtttgccgggtgcggtattgtggaagactcggaaccaatctcggaatatgaagaaacacagattaaattgaagccgatgatctctgcattaggaggtgagaggcgttgacagtcaacccgattactcattacatcggaagttttattgatgaattcgccctttccggaattacggacgccgtcgtttgtccgggctcaagatctacaccgctggctgttctttgtgctgcgcatcccgatatcagcgtccatgtccaaattgatgaaaggtctgccggattttttgcattaggtttggcaaaagcgaagcagcgtcccgtactattgatctgtacatctggaacagccgcggccaacttttatccggctgtggttgaagcccattattcaagggtgcctattattgtgttaactgctgatcggcctcatgagctgcgcgaagtaggcgcaccgcaggctattaatcagcacttcttattcggtaactttgttaagtttttcacagactctgctcttcctgaagagtctccgcaaatgctgagatacatccgaacgctggcaagccgcgctgccggagaagcacaaaagcgcccgatggggcctgtccatgtgaatgtgccgctgcgcgaaccgctgatgccggatctttcagatgagccgtttggaagaatgagaacaggccgtcatgtgtctgtgaaaacgggtacgcagtctgttgaccgagagtccctgtctgatgtggctgagatgctcgcagaggctgaaaaaggaatgatcgtctgcggagagctccatagtgatgcggacaaggaaaacattattgcgctgtcaaaagcgcttcagtatccaattttagcagatccgctgtctaatctgcggaatggtgttcatgataaaagcactgttattgatgcgtatgattcgtttttaaaagatgatgagctgaagcggaaactccgtcctgatgttgtcattcggtttggaccgatgcctgtttcaaaaccggttttcttatggcttaaggatgatccgacgattcagcaaatcgtgattgacgaggatggagggtggagagacccgacacaggcaagcgcgcatatgattcattgtaatgcgtctgtttttgctgaggagatcatggcaggccttactgctgccaccagatcctcagagtggctggaaaagtggcagtttgtcaatgggcggttccgcgagcatctgcaaacaatcagcagtgaagatgtttcgtttgaaggcaatctctatcgaatccttcagcatcttgtgcctgaaaacagctcgctgtttgtgggaaacagcatgccgatcagggatgttgatacgttttttgaaaagcaggaccgccctttccggatttattcaaaccggggagcaaacgggatagacggtgtcgtctcctctgccatgggggtatgtgaaggaacaaaagcgcctgttacccttgtgattggagatttatctttttatcatgatttaaacggcctgctggcggccaaaaagctgggtattcctcttactgtgattcttgtcaataatgacggaggagggattttctcctttttgccgcaggcttctgagaagacacactttgaagatttgttcggcacaccgacagggctcgatttcaagcatgcggctgcactttacggcggaacgtattcatgcccggcttcttgggatgaattcaaaacagcttacgcgccgcaggcagacaagcccggactccatttgattgaaatcaaaacggatcgccaatcaagagtccagcttcatcgcgatatgctgaatgaggctgtgcgggaagtgaaaaaacaatgggaactgtaaacataacggtatcagatggtgtccgatatgcagtggcagacgagggaccgaatgcttccgaagccgtcgtctgtctgcatgggtttaccggcagcaaacaatcatggacttttcttgatgaaatgctgcctgattcccgtttgatcaaaattgattgtttagggcatggggaaaccgatgccccgctgaatgggaaaagatacagcacaacccggcaagtttctgaccttgccgagatttttgatcaattaaaacttcacaaagtgaaattgattgggtattctatgggaggaaggcttgcttactcttttgcgatgacatatcccgagcgggtatcggcacttgtgcttgaaagcacgacgccggggctcaaaacacttggggaacggcgggaacgaatcatgcgggaccggaagcttgctgattttattttacgagacgggctcgaagcgtttgttgcgtattgggagaatatccctttgttttcatctcagcagaggctggctgaagatattcggtacaggatacgatcgggccgtctgcggaacaataagattgggcttgcgaacagtttaaccggcatgggcaccggttcacagccttccttgtggagccgtgtagaggaaatagatgttcctgtgcttctgatctgcggggagtgggacgaaaaattttgcgccatcaatcaagaggtgcataagatgcttccttctagtagaatagagattgttccaaaagcaggacatacggtccatgtggagcagccgcgattgtttggtaaaatagtgagtgagtttttgacaagcatctgactcattcacatagagaataaaaggaggtcatcatatggctgaatggaaaacaaaacggacatacgatgagatattgtatgaaacgtataatggcattgcaaaaataacaatcaaccgacctgaggtacataatgcgtttacccctaaaacggttgctgaaatgattgatgcgtttgctgacgcaagagacgaccaaaacgttggggttatcgtgcttgccggtgcaggggacaaagcattttgttctggcggagaccaaaaagtgcgcggccacggtggatatgtaggagacgaccagatccctcgtcttaacgtattggatcttcagcgtttaatccgcgtcatcccgaaaccggttgttgcgatggtgtccggatatgcgatcggcggaggccatgtgcttcacatcgtatgtgacttgacaattgctgcggacaacgcaatttttggacaaacaggccctaaagtgggaagcttcgatgcaggttacggttctggctacctggctcgaattgtaggacataaaaaagcacgtgaaatctggtacctatgccgtcagtacaacgcacaggaagcactggacatgggtcttgtcaacacagtcgttcctttggaacagcttgaagaagaaacgattaaatggtgtgaagaaatgcttgaaaaaagcccgaccgcactgcgctttcttaaagctgcgtttaacgcggacacagacggacttgctggaattcagcagtttgcaggggatgctacccttctttactacacaacagatgaagcaaaagaaggccgtgattcctttaaggaaaaacgcaaacctgatttcggacagttccctcgttttccgtgatcagcaatatctagtaaaccaacagcttgagactttgcggtccaagctgttttcttttcaatacagacattttacctcggagatgatgacatgctgacagaacagcccaactggctcatgcagcgggcacagctgacacctgagagaatcgctctcatctatgaagaccaaaccgtgacatttgcagaattgtttgccgcgtctaaacgaatggcggaacagcttgccgctcattcggttcggaaaggggatactgcagctattttgctccaaaaccgtgcagaaatggtatacgctgttcacgcttgttttttgcttggtgttaaggcggtgcttttgaatacgaagctgtcaacacatgaaaggctgtttcagctggaggattcgggatccggctttttattgacagattcaagctttgagaagaaagaatatgaacacatcgttcaaacgattgatgtggatgaactgatgaaagaagcagcagaggaaattgagatcgaggcttatatgcaaatggatgcaacggcaacgctgatgtatacgtcgggtacgacaggaaagcccaagggagttcagcaaacgttcggaaaccattatttcagtgcggtgtcgtccgctcttaatttgggtataacagaacaagaccgctggcttatcgcattgccgctctttcatatcagcggattgtccgcattatttaaatctgtgatctatggaatgactgtcgtgcttcaccagcgtttttccgtaagcgatgtgctgcattctatcaacaggcatgaagtgacaatgatatctgcggtgcagactatgctggccagtcttttggaagaaacaaaccgctgccctgaatccatcagatgcattcttctcggcggcggtcctgcaccgctgccattgcttgaggaatgccgtgagaaaggattccctgtctttcagtcatatggaatgacagaaacatgctcgcaaattgttaccctgtcgccggaattcagcatggaaaagctcggatctgcggggaaaccgctgttttcgtgtgaaatcaaaatagagcgggacggacaggtatgtgaaccgtatgaacacggtgaaatcatggtcaaaggcccgaatgtcatgaaaagctattttaaccgggagagcgcaaacgaagcctcctttcaaaatggctggctgaaaacaggtgatcttggttatttggacaatgaaggctttttatatgtattagacagacgttcagatctgatcatatccggcggagaaaacatttatccggccgaagtggagtcagtgctgctttcacaccccgctgtggccgaagccggggtttcaggggctgaggacaaaaaatgggggaaagtgcctcacgcctatcttgtccttcacaagcctgtgagcgcaggagaattgactgactactgcaaagaacgcttggcgaagtataaaattccggcaaaattctttgtgcttgaccgcctgccgcgcaatgcgtctaataagctcttgcgaaatcagctgaaggatgcgcgtaaaggagaactgctatgatcgaaatagaaaaaatcacgctttaccatttgagcatgaacttaaagaaaccgtttaaaaacagtatcgaaacgcttcaagagcgtaaatttctgatcgtggaagccattgatacatcaggtgtcacaggctggggagaagtttccgctttctcttcgccttggtacaccgaggaaaccattggaacatgtttgcatatgctaaaagatttttttatcccaaatgtcgtcggccgtgaattcaatcacccttcagaagtgccggacagcctggcgcggtataaaggaaaccggatggcaaaagcgggacttgaatcggctgtatgggatatttatgccaaaaagaagggcgtatcccttgctgaggcattgggcggaacaagagataaagtccctgccggggtggtagtcggcctggcgcctcttgacgatatgctgaaggaaattgagagctatcaaaaagaaggttatcaaagaataaaaattaaaattcagcctgggcaggatgtggaattggtcaaggccatccgcagccgattcccaaccatcccgcttatggccgatgccaattcctcttacgaactgaaggatatcagccgtttaaaggagcttgatgactatcatttaatgatgattgagcagccgctccaagctgacgatatcgttgaccaccgccacttgcagaaacatttgaaaacggccatttgccttgatgagagcatttgttcagttgatgatgcgagacgggcgattgagctaggaagctgcaaaattattaatataaaaccttctcgtgtcggcggcttaacagaagccttaaaaattcatgatttatgcaaagagcatcatatgcaggtttggtgcggaggaatgctggaaacaggcatatcaagagcgcagaacgtggcgcttgcttcactgcctcaattcacaatacctggcgatatatcttcatcctcacgctattgggatgaagatattgtaactcctgatattcgtattgataatggatttatttctgtgtcaaaacagcctggtttaggggttgaggtaaaccaagatattatgcgaaaatatgtgaccaaaatggatgttttcacacagcatggttaagaaaaaagcattttgctattttgaataaatgacactgtgctgttacagtaaaagtgttcgttgaatacatcccttctcgtttggaccggctgctgacccagccggtttttttatgtaaatcagcttgacaaaaatggccaaacgcgataattttgcatgagggaaactttttgtcctgtgtaaataaaacatgcttttggctaatttaatgtcacatgtctaagaactgacaacataagataaaacaatcggacattgatggcaaagaggaggagaaatatgagacaagggctgatggcagcagtactttttgcgacctttgctttaacgggatgcggaacggattcagccggaaaaagcgctgatcagcaattacaagtgacagcgacaacatctcaaattgccgatgcagcagaaaacatcggaggtaagcatgtaaaagtcacctctttaatgggaccgggggttgatccgcacctttacaaagcttcccaaggtgacacgaaaaaattaatgtctgccgatgttgttctgtacagcgggttgcatttggaagggaaaatggaggatgtcctccaaaaaatcggcgaacaaaaacaatcggcggcagtagctgaggccattccgaaaaataagcttattcccgcgggggaaggcaagacgtttgatccccacgtctggttcagcattccgttatggatctatgcggtggatgaaattgaagcgcaattcagcaaagcaatgcctcagcacgcagatgcctttcggaaaaatgccaaagagtacaaagaagatttgcaatatttagataagtggtcgcgtaaggagatcgcacatattccggagaaaagccgtgtgcttgtgactgctcatgatgcgtttgcgtactttgggaatgagtatggatttaaggtaaaaggcctgcagggactcagcacagattcggactatggattaagggatgttcaggagctggttgatcttctgacagaaaaacaaataaaagctgtgttcgtagaaagcagtgtatctgaaaaaatcaatcaatgcagtggtggaaggcgctaaagaaaaaggccatacagtcacaatcggcggtcagctttattcggatgccatgggtgaaaagggcacaaaagaaggcacatacgaaggaatgttccgccacaatatcaacacgattactaaagcgcttaaataaagaaaagaggtggaggatatgttccctgttgagcttgataatgtgacggttgcttatcataaaaagcctgtactgcaggacatttcgctgcaggtgcctgaaggaaaacttattggcattatcggcccaaacggcgcgggaaaatcaaccttgatcaaaacgattctcggtcttgtgcccagagcttccggagacatctctatttacggcaaagactataaggatcagcggaccagaatcggatatgttccgcagcgcggctcggttgactgggatttccccacaagcccgctcgatgtcgtcctaatgggaagatacgggagaatcggtttattaaagaggccaaagaaagcggatgtggagatggcgaaggccgcattaacaaaagtcgggatgcatgattatgcgaaaaggcaaatcagccagctgtcaggcggacagcagcagcgggtgtttcttgcccgggcactctgccagaacgctgacatttattttatggatgaaccgtttgcaggtgttgatgcagcgacggagcgcgcgattatgacgctgttggcagaactcaaagaaaaggaaaaaccgtgcttgtcgtccatcatgatctgcagaccgccgaggattatttcgattggatcttactgcttcatttaaggaaaatcgctttcggaccgacggaaaacgtttttacgatcgaaaacctgcaaaaaacatatggaggaaggcttacgtttttaaaagataaagtgctggcagaaggacataaggagtgagcgcaatgtttgaaagtttgtggctgcagcttcagcatccgaatacacagtgggtgctggccggtacgcttttgctcgggacggcaagcggtgttttgggcagctttgtgctgctgagaaagcaaagtttaatcggcgatgcgatggcccattcagctctgccgggagtgtgtctcgcttttctgttcaccgggcaaaaatcactgcctttctttttgctgggggcagcgctcgccggactgctcggaacgttttgtattcagctgattcctcggctttcaaaaacaaaggaggactcggcgatcgggattgttctttctgtgttttttggcgtcgggatcattctgctgacatatattcagcaacagggggcgggaagccaaagcgggcttgattcttttttattcggccaggctgcttcattggtcaggcaggatatcatccttattgcagggatatccgctgttctactgctcctatgtattgttttctttaaggaatttacattgattacttttgatctcgcgtttgcaaagggattaggaatcccggtgcgttttttaaacgggcttttggcttgtctgattgtctgtgctgtcgtcattgggcttcagactgttggtgtgatattaatggcggctatgctgattacacctgccataaccgcgagatattggaccgaacgattaaccgggatgatcatcattgccgggattacaggcggggtcagcggagtggccggaaccctgcttagcaccacgatgaagggaatggcgacagggccattaatgatcttatctgcaacgctgctctttcttttttcaatgatttgcgcgcctaagcggggattggctgctaaagccataaggctgatgaggctgcggcgcagaacaagcagggagcaagtgcttttggcgatttatgaacagtatgaaaagaataatctttgtgtaactgttgaaagtgtaagaaagaaaagacgcctatccccttcattatgccttaaggcattaaatgacttggaacaagagaggtgcattgagcgtatcgaaaatgggatttggcaaatcacaagcaaagggatagaaaaaggctatcacacagctttgaagcagcggatgtatgaagtgtatctcatgcatgaaatggaacttgccaatatagaatccgatcaggactactttgacccggaccgtttaccgagagaaacgagagagcggctttattcactcttaaagctgtatggacggatgcctgagcgtcgaaaagcgtctcatgatgccgagaagggacagatcgcaaatgagttttgaagcatggattatagctaccggtgtattagtcggtgtaagctgcggattgatcggcacatttcttgtgctgagaagcatggcgatgctggccgacgcaatcagtcacacagtgttgcttggcattgtcggcgcttttctagtgacgggaagtctcgatgggatttatatgtttattggcgcagccgcaaccggtctgttaacggctttcttggttcagcttcttcatagcaagggggttcaatcagatgctgccataggagttgtgtttacatccttatttgcaatcggggttattttgctttctgtgtatggagcgaatgtccatctcgatattgagcactcgttaatgggagaaatcgcttttgtgccgtggaatacggtgacggtattcggggttgatattgggccgaaagcgttttggatgctggcatctgttctggttttaaacgtagtgttgatcagtgtgtgctataaggagtttaaaatcgcttcgtttgatcctcaaatggctttagccttgggaataccggttttgctcattcattacgtgcaaatgggcatgctgtccttgacgactgttgcttcctttgattcggtgggtgccgtattggttgtggccatgctgattgttccgccggctgcggcacatttgctgacagaccggcttctttatatgctgattctcagcgcgttgattggcgggctgtcggcggtcatgggctatttcttcgcaacgtggcttaatgtttcgatttcaggagcgatggcggccatgacaggtgtatgttatgcaagcgcctttttgttttcacctgcaaacggggtcataactaaaaagctgagaacactcaacatgcaaaaagaaagagctggctgatgcagctctttcttttaattataaatcatgcggcttaaacgttttgcagtctgtttcccggctgttttcagccgtttcaccagtatggctgacaacataaatggcatcagcggtgcatttgttacctttgccccaataagaacagttgttgacctcacatagaattttctgctccatgccatcccctccttataaaggttctggattagtatagccggctggcttgccctctattcctcctggcggatatagcgtttatctcgcataaacattttccagaagaaaaagaagcccggaaatagaatgataaatgcaacgatatacgttgcaaacagcgctctgaacgttgctggctctgtgaagcctgacatgactgtcacatcgggataaatcatatacggaagatgcgcccgcccgtacgcgtagcttgcgagaaaatactgtatcccaatcgcaacaagtgcgagacgcggttttccgatgttttgaccaaagcttttgttaggcagaaaaagagcgattccagcaatgacaaatgtaatgaacgatgcaataatccaagaaaaatcattcatcattccgctgtacagccagtttgcttcattccgcatagttaccataatgcatacagcaaacaacagtgaaatcgggccggtaatcagggcgctttttctgtaggctcggtacgcatcctgttcctctgccacatttgaaaaatctgcaagcaacagcgaggacaaaaataaggtgcttaaaatcgcaaacccgataaatgaataggcgttggggcttgaaaagattttagacatatttaagttatagattccatccgttttttctataaaccctccgtgtgtcacaggaagcaccaaaattaaaatagcaggaatgataaagccggagatgccggaaatatatcttagcgttttccgctcctttgctgtatttgaaaacacgagaaatccgcttcgaattgctaaaagcagcaaaatcatgcttccgggaattaataaaacggtgccgagcacaaatgtcgcgccggggaaaaaactgaaaagcgccacgacgatggccacaataaagacgtttgtgacctcccaagtcggggacaaaaagcgattcgcaatatcggtggccttcatatgctccttgtttaaatagatcatagaccaaaatcccgctccaaaatccattgtcgccatgacggcgtaaataaacacaaagccccagataattgagatggcgatcagagcgtcagttgaaatctccatttgtacgatcttccttccatttggtttcctgtttgcggagccattacgactccgctgtatttaaatcttcgtcaaccgggtgcttgcggaaataatacagcagcacgtagacgacagctgcgcctaacacggcataaacaaatgtgaaaaataagaacagcaccccgatcgagccagtcgttgttacgacatctgacgttttcagcagatgatagatgacccaaggctgcctccccgtacatgcgaaaatccagccgaattcaatgccgatgagactaaaagggcctgctgtcatgaaaatgatcaaaagccacgttgggaaacggtctttcttgagcacctttctccagaccacaccgataatggaataaagaattagcagcatgcctacaccaaccatcgcattaaacagcgtgtgaatgaaaagcggcggccattcatctctcggaaatgcatttaatccttttacaacagtgtcaaaacggttcgctgccaaaaagcttaaagcccatggaatctcgattgcccattttactttttcttcattcgggtcggtaaaaccgccgatagcgagcggggcgtgggatcttgtttcaaataggccttccgcaccggctaatttttcgggctggtattcgtacagcatctgtgcagattcgtgtccgttcaaagcggtcagcaatgaaaaaataccgccgatcgtcagtgcgagcaaaagggctttccggtgaaagcgatagaccctttcctttttcctcgttcggatcattttatacgccgcaacagaagccacgataaacgcaccagtcataaacgcggacagcacgacatggccggcagtgataaaaaagctaggattaaaaaacgcagcccacgggtcaacatctgtaatttttccgtttaaaattttaaaaccggcgggcgtaccttcaaaagcgtgaacattcgtgatcagaacagcggatgctgctgccccgactaacacaaagaaaacagcaacaatcctcattgcaggtgacaaacggtctgcagcgtatacataaatcgacatgaatagggcttcaacaaaaaaagcatagatttcaatttgaaatggcagggacatcacccggccgatgacttccataaatcccggccataaaagcgcgagctgagtgcccgcgatcgttccggtcggtatggcgacccccagcaaaacggcttgtgctttcgtccatcttttcgccatgatcgcataatggtcatctttcgttttttgatagatcaattccgccactaaaatcatgagcggcagaccgactccaagtgttgcgaaaatgatatgaaagcccatcgtcgtgccaaaaaggcttctggccaaaactaaatcatccacaatcgtaaaccacctttccaaaaagacgttctgtatgtattttgggtttattatttgcttcctcggttagattattcttcctattcttaaatgccatgaggtttacgatgtgaaacagagggaaggatataagaagattgacaaaacgtttgtaaggttataaaataaaacgtaattattacgatttattgaaaggagatacccatgaaagaaggaattcatccaaagaaccacaaagtgatatttcaggatgtcaacagcggctaccgttttctaagcacctctacgaaaacatctaatgaaacagcagagtgggaggacggaaacacatatcctgtcattaaagtagaggtaagctctgacacgcatccgttttatacaggccgccagaaattcaatgaaaaaggcggacgagttgagcagttcaaaaaacgctataacatggggaaataaggcaggcctgagggtttgtctttttttattatgacgaataaacaagggttgtgatatattgaagagtaaaaagaatagaaagggacaacgaacatgagtcttctaaatgatattctcgaatttaacaagacatttactgaacaaagagagtatgaaaagtatcaaacatcaaaatttccagataaaaaaatggcgattctttcttgcatggatactcgtctggttgaactgctgccgcatgcgatgaatttgcgaaacggtgatgtgaaaatcattaaaagtgccggtgcgcttgtgacacacccattcggaagcatcatgagaagtatactcgtcgcagtgtacgagctgaatgcagatgaggtgtgtgtgatcgggcatcacgattgcggcatgagcaaaatcagcagcaaaagcatgcttgaaaaaatcaaagcaagagggattccggaagaacgcatcgaaacaataaagtactccggtgtagactttgatcaatggtttaaaagctttgattcagtggaagcgagtgtgaaagacagcgtagatgttattaaacatcacccgctgttccctgaaaacgttccggtccatggcttagtcattgatcctaaaaccggaaaactggatcttatcgtaaacggttataacaattaatgtttttgtttcttttcaggaacgggatcgactcctcccggatggaacgggtggcatttcaaaatccgtttgattgtcagccatccgccttttaaagcgccatgtgttttaatcgcttcgattccatattgggaacaggtcggataaaagcggcacgttggcggtgtcaggggcgagatgaatttttgatatcctctgatcagagcgatgaatagggttttcatgtttcttcagcaacctttctgatgcaagtataagaaaaaaaacacagattgaaaagttaatcaataattcttatcggaaaagtatgttataatgaaattacatttttaaaaaaggggagagtgccattatgccttcagtagaaagttttgagcttgatcataatgcggttgttgctccatatgtaagacattgcggcgtgcataaagtgggaacagacggcgttgtaaataaatttgacattcgtttttgccagccaaataaacaggcgatgaagcctgacaccattcacacactcgagcatttgctcgcgtttacgattcgttctcacgctgagaaatacgatcattttgatatcattgatatttctccaatgggctgccagacaggctattatctagttgtgagcggagagccgacatcagcggaaatcgttgatctgcttgaagacacaatgaaggaagcggtagagattacagaaatacctgctgcgaatgaaaagcagtgcggccaagcgaagcttcatgatctggaaggcgctaaacgtttaatgcgtttctggctttcacaggataaagaagaattgctaaaagtatttggctaaaatagaaaggacctttttgcgcttaagcaaaaaggtcttttttgtgacgtctcatattttgtgtaccatttgctgtaagcgtttgctactatttaggtaaacgatgaaagggtgatggcatgaaaaagatgttggttgttctgcttttttctgctttattgcttaatggatgcggatctggtgaaagtaaagcaaatacagctgagacgcccgaggttttggatgtcaagctgaccgggcctgaaaaagtaaatcccggagaaagcgctgcttatgaagcagctgtatcatatggtgatgaagctgtgacggatgccgatgaagtagagtttgaagtatggaaagaaggggaaaaagacgcaagccaaatgtttaaggtgaaacaagaaaaaggcgtataccgattggaaacgacgtttaaggaagatggtgtatacactgtccaatctcatgtcacagcaaaaaaacagcatagcatgccgaccttaaaagtccaagtcggagacgccgatgctgccagcaatcagtcagaagaggagcattcacatcatcattgattgtgtgaatcagagtgattttcttgtggtggatcaatggtatgctttacattataggcttttacagtcgtccaaatggttacaagcaaaacagccagcacaatcaaaatacttatcgtaatgagaagcgtcatgacattccacctcccgttttttaacaattgtagcataatagaagaaatcgtgacagataagggtaaaaaagaggttttagcgtacgatattaagggtatacatagtcatataacaaggaggagataccatgtcagaacaattgattcaagcagtgaacaaacaagtagccaactggacggtcatgtatgtgaaactacataattatcactggtatgtgaaagggaaagatttcttcactcttcatgaaaagtttgaggagctgtacaacgaaacagcaacttatattgatgacttagcagaacgtcttttggcgctgaacggaaaaccgattgcaacaatgaaggaatccttagaaacggcttctgtcaaagaagctgctggaaatgaaacagctgaacaaatggttcaaagcgtatatgatgatttcacagtcatcgcggaagagctgaaaaacggcatggatttagctgatgaagtcggtgacgaaacaacaggggacatgcttcttgcgatccatcaaaatattgaaaaacataactggatgctaaaagcttacctaggttaagttcaaaaatagaacggccggatgtcttaaaaaagacgtccggcttttctttttgtatctgaaaaataggcgacaaccagtccatttttctgaaaaatccaatccgttcggcttgtttaccatagaatatcgtaaggccgtttctgtgaaaggatgttgggataaatggatagagactttggcatcttttcgtttttagcagtcagcgtttcagcagcgggttttttctttggaggttttcagtattcatttctgattttgctctctcttatggcaattgaatttatcagtacgactttgaaggaaaccattattcacaaactgtcatttaaaaaggtatttgcccggcttgtcaaaaaattagtcacgctggctctgatctctgtatgccacttttttgatcagctgctgaatacacagggatcaattcgtgacttggctattatgttttatattctttatgaatctgtgcaaattgttgtgacagccagctctcttggcataccggttcctcagatgcttgtcgatcttttagaaacgttaaaaaataaatttaagcgcaaaccgtaacttttccctgttcgcgggtcataataaagcccagagcgtcggtcgcactttccggcaaaagtatcgcaaaaaaactgtacgagctagtctgcatgcagaacctgacggcgtgctgggtttcccttattttttgataaaaggcttccgaagaaacgtaactgtggtatgatgtatggaagatagctaggaacggatttgagggataaacatgtacgagtttaaagattattatcagaatactgttcagctttcctttgacgatcagcctttctcggacagcccgaagcatgtctgggtgatttgccgttttggcggcaaatggcttttaacagaacatgaggacagaggctatgagtttccaggcgggaaagtagagccgatggagtgcgcagaagaggctgcgctccgggaagtaaaggaagagacgggcgcgagagtcaaaagcctcaagtatctcggacagtataaagttctcggaaaagaaaaagtgattgtaaaaaatatatattttgcagatatagaaaagcttgaaaagcaggctgattactttgaaacgaaaggcccggttttgtttcacgagctgccggagaacctttcccgcaataaaaaattcagctttattatgaaggattccgttcttccgatcagcttgaaaaaactgaaagaatctggatggattgaataaaaaacccggcacatgtgccgggttttttatgtcctccccttcgtccatttcttttccagcagctcgacgccctgatacatcagagtggcgaagatggcgatgatcagcaggcttaagaagacgagtgtaaaattgaagacttggaatccgtaaataatcatatatcctaatccgaccttcgaaacgaggaattcccctacaataacgccaacccatgataaaccgacgttcacttttagtgttgaaataatcgcgggggaggatgcaggcagtatgacttctttaaaaataacccacttttttgcgccgaatgttttcatgactttcgtatagttttcgtcgacctcttggaaggcggtgtagacaacgatggttgtgataatgacgctgatgatggctcccatcgcaatgatgctgataaaactgggaccgagcgcgacaatcaggatcgggcccagggccactttcggcattgcgttcaaaatcacaagatacggatctaaaattctggcaagtcggttagaccaccataacaaagcggctaggcacgtgcccataaacgtcccgagcaaaaagccaagcaccgtttcaaataaagtgacgccgatgtgtgacagtaaagaaccgtcaccaagtttctccagcaataatcgccacacagctgatggagagctgaagatcagcggatcgatccagccctgcctgctggagatttcccagcccgagaaaaagagaataaatatggcaagctgaaaggaatggaccttccacttttcctttttctgtttgaattgatactgctcgtgaagcagatcaatggtttctttgctgtttctcaagagaattcagctccttccatatcgtttgaaacagtgtctggaaggaaggttcctgacgggcgtcaaaaggcaacatcgcggccaattccttaggaatggtaaaaatctgatggatggtgcccggctgatttgaaaataaaaagatcgtatcgctcatcgctatcgcttcccctatatcatgagtgacaagcactgctgttttttgatattcctttaatgtgcggaataccaggttttccaaagacagctttgtctgaaaatcaagcgcggaaaatggctcatccagcaaaagcagactagggttaggcgcaagtgttcttgcaagcgcagcccgctggcgcatcccgcctgacagttctttcggatattttttctccacatctatgaggccgaactccggcaatagaccgagtgcagcggctttgctttcttctgtcagcgtgtcggcgatttttaaaccgagaagcacattttcctcgatagatttccagggaaataagtaatcctgctgaagcatatagccaatattatgttctttttgattcggctcacggccttcaatcagaactctgccttctgatggctcaatcaaaccggcaataatggaaagcaatgttgtttttccgcagccgcttgggccgagaaatgagatgaaatcgcctttttcggcatcgaaatgaatatcccgcacagccgttgtttttctttaatagaaaaataagtatgggttacatggtcgacatgtaagaaagacatagatggcgcctcctatttctccgaggtgactttttcagcaatttctttatttacaagctgattgtatggaatgtgcttcggcagttctcccgatttatccataatggtttggagaagctcccattctttttcgttaagcagagggtctggtgaatatgaatgctgttttttatagcgttcaatggatgtttcgatgacgtctgggtcggtatcatcaaattcatctttaatggcatctgtgatgtccttcgcagaatgattttcaacccactgctgcgccttataaatggcttttgtaaacttgacggctgtgtcttcatttttcttcaaatagctttgtttcgccataaaagtcgtataaggaacctctcctgattcttctccgaatgaagccacgatatggccgatgccttttttctcaaagagagaagcctgcggttcaaagagctgtacatactcaccggttccagaagcaaacgcattggcaatattggcgaagtctatgttctggatgaggtctatatccttatgcgggtcaatcttatgtttgttcagtacatactcgccgaccatttgcggcatgccgccttttcgctgaccgagaaacgtttttcctttcagctgatcccagtcgaagtgttcaacatcttctctcgcgacaagaaacgttccgtctgtctgagtcagctgggcgaaattaatgacgggatctttagccccttgcgcttcgacataaatagatgtttctgacccgacaagcgcgatgtcggagccgttggaaagaagcgatgtcatcgttttatctccgccccaggtcgtattcacatcgacatcaagcccttcttccttaaaaaaacctttagactcagcaacatataaaggtgcgtaaaaaattgaatgggtcacttcagctactttgactttggtgagcgtttcttcctgcttgcaagccgccagggcgaacatcagaaagatactgccgacacaggcgaagcccagccttaaccatctgttcacatagacaacctccttatttcgcatcaagttaatatccttttttgctttacatatcgtatgatgggtataaaaatgtgtgaatgcctaaccaggttctccggatgtaattttggagtaaggaaagcatatagaaaaaaggaggcggctgttttgattgtagagaaaagaagatttccgtcgccaagccagcatgtgcgtttgtatacgatctgctatctgtcaaatggattacgggttaaggggcttctggctgagccggcggaaccgggacaatatgacggatttttatatttgcgcggcgggattaaaagcgtgggcatggttcggccgggccggattatccagtttgcatcccaagggtttgtggtgtttgctcctttttacagaggcaatcaaggaggagaaggcaatgaggattttgccggagaagacagggaggatgcattttctgcttttcgcctgcttcagcagcacccaaatgtcaagaaggatagaatccatatcttcggtttttcccgcggcggaattatgggaatgctcactgcgatcgaaatgggcgggcaggcagcttcatttgtttcctggggaggcgtcagtgatatgattcttacatacgaggagcggcaggatttgcggcgaatgatgaaaagagtcatcggcggaacaccgaaaaaggtgcctgaggaatatcaatggaggacaccgtttgaccaagtaaacaaaattcaggctcccgtgctgttaatccatggagaaaaagaccaaaatgtttcgattcagcattcctatttattagaagagaagctaaaacaactgcataagccggtggaaacatggtactacagtacattcacacattatttcccgccaaaagaaaaccggcgtatcgtgcggcagctcacacaatggatgaaaaaccgctgacagtgaaatatgttatgataaagaaaaaagagaacgaaaggggatttcactttgggaatgcctgttgaatttaatacactgattgtgacaaaaggaaaagaagttcgcatagatgaaaatatattcacgttagagaaggacggataccgagtatatccgatggagattccaatggatgtacgcaaaacaaagtttggcgaaaagtcaggcacagctgaagtgcagaagcttcaatgggaagaaggccggaccatcattacatacaagctgacttctttgcattccgtcaattaaaacaagccaagagcataattgctcttggcttttgttttttatacgagagggccgcctgcctgggcgatggcatcggtatgtgcgaactttttaaagttctctttgaattcatttgcaaggtagactgctttttctttgtattcttccttgttggtccacgtgttttcaggctgaaggatatgatcaggaacgccaggaacatgggccggaatgtgcaggccgaaaatctcgtcagttatcatttcagcatcctctaatttgccttcaatcgctgctttgaccattgctctagtgtaagaaagcttcattcgttcgcctgtgccgtagccgcccccggtccatccggtattgactaagaaaacgtctgcgccgtgttcatcgatctttttgccgagcatttcagcatagacgtgagcaggaagcggcaggaacggtgagccgaagcatgtagaaaacgtcgtttcaggagacgtgacaccacgttcggttccggcaagcttactcgtgtaaccgctcaaaaaatggtacatcgcctgctccttcgttagtttgctgatcggcggcaggactccgaaggcatcagccgtcaaaaatacaatggctgacggatggccggccatgcttggagtcacgatgttattaatcatatgaatcgggtaagctgcccgcgtgttttcagtatagaaggaatcatcataattggcttcgcgtgtatcttcatccacaacgacattttcgagaacagacccgaagcggatcgcgttaaagatttgcggctccttttcctcgcttaaatgaatacacttagcgtagcatccgccttcaatattaaagacgcctgtatcagaccagccatgttcatcgtcaccgatcagcttgcggtcagcatctgccgacagggtggtctttcctgttcctgacagtccgaagaaaagggcgacatcgcctttttcaccgacattggcggagcagtgcatagataaaatatctctttcaggcagcaggaaattcataatggagaaaatggacttcttcatttcaccggcatactcagttccgccgattaaaattgtccgcttttcgaaagagacaataataaacgtttcggaatgagtgccgtctgtttttggatccgctttgaaatgcggagcagaaagaatggtgaacggctgctcaactgttttcttatcatttccttccggacggataaacagctgccgcgcaaataaattgtgccatgcgaactcatttacgacagtgatcggcagcctgtatttctcgtctgctccggcaaatccttcgaaaacaaacagttcatctcgctcctttaaatagctgacaactttcgtgtacagccgctcaaacgcttcttctgaaatcggctgattcaccgggccccaatcgatcttatttttcgtgctttcttcctccacgatgaatttatctttaggtgagcgtcctgtgtaagcgcctgttgtcgcgcgaacagcacctgtggatgttaaaatgccttcgtttcgggagaggactttttctgttagctgtgctgctgataaattatgacgcacatttggacatgttaataaggcttgtaaatcagcggtcaaatcaactgagttcatatgaaaccttcctttatcgttttttgtgttttgctaattgtgaattagtataacatatattttcaaatagtctatactatttattgttttttgtgtgtgcatttccattgttttccctcaatataggtgcctatttcttctgaatcatattgacattgcaaacccttttacgataagatatttcattgagcggatactcttatcccgagctggcggagggacaggccctatgaagcccagcaaccggtttctctgttatttattatgttcaactgagtgagacaaccaaggtgctaacctgttgcaaggttgtatgattccttgagcgataagagtgaaaggcacaaagaccaaaccctttcctcgatggaaaaggttttttatttcataaatatgccaattaacattctctaatataactgtacattgtataagagggagcgagttccgtatcatatatacaaggtctttcgggaggccttgtgcaggaggaagcaaatcatgagtaaaaatcgtcgtttatttacatcagaatctgttacggaggggcatccggataaaatctgtgaccagatttctgacagcattttagatgaaattttaaagaaagaccctaacgcgcgtgttgcttgtgaaacatctgtgacaacaggtttggttcttgtaagcggagagatcacaacttctacgtatgttgacattccgaaaacggttcgccaaaccattaaagaaatcggatacacacgtgcaaaatacggatttgatgcggaaacttgtgcggttttaacatcaattgatgagcagtctgctgatatcgcgatgggcgtagaccaagcgcttgaagcccgtgaaggcacaatgagcgacgaagaaattgaagcgattggtgcgggtgaccaaggattaatgttcggttatgcgtgcaacgaaacgaaagagcttatgcctcttccaatttcacttgcccataaattagcccgccgcctaagtgaagtccgtaaagaagatattcttccgtaccttcgccctgacggcaaaacacaggtaacggttgagtacgatgaaaataacaaaccagtccgcattgacgcgattgttatttcaactcagcatcaccctgaaattacacttgagcaaattcagcgcaacattaaagaacatgtaatcaatccggttgttcctgaagagctgattgatgaagaaacaaaatatttcatcaaccctacaggacgtttcgtaatcggaggccctcaaggggatgcgggacttacaggacgcaaaatcatcgttgatacgtacggcggctatgcacgccacggcggaggcgcgttctcaggtaaggacgcgacgaaggtagaccgttctgcagcttatgcggcaagatacgttgcgaaaaacatcgttgcggctgagcttgctgattcttgcgaagtacagcttgcttacgcgatcggtgttgcacagcctgtgtcaatctcaatcaacacattcggttcaggaaaagcttctgaggaaaaactgattgaagttgttcgcaataactttgatttacgacctgccggcattatcaaaatgcttgatttgcgccgtccgatctataaacaaactgctgcgtacggccactttggacgtcacgatgttgaccttccatgggagcgcacagacaaagcggagcagctgcgtaaagaagcgttaggagaataattttatagccgcttactggttaagcggctttcccttttttatcgttgtattcatgtttatttttttacataactgtgaaaccaaatactattcacagcgtctataaataggggttcaatgatgacaattttaattatggaggcaatactatgtgtggatttgtcggggttttttaacaagcatccgttagctcaaaccgctgatcaagaagaactaatcaaacaaatgaaccaaatgatcgttcaccgcggtcctgacagtgatggatatttccatgatgagcacgtcggcttcggattcagacggctcagcattattgatgtagaaaatggtggacagcctttatcatatgaagatgaaacatattggattatctttaacggagaaatctataactatatcgaactgagagaagaacttgaagcaaaggggtacacattcaacacggattcggacacagaggttcttcttgcgacttaccgtcactataaagaagaagcggcgtccaaactgcgcggtatgtttgcctttctgatttggaataaaaacgatcatgtgctttatggggcaagagatccattcggcattaaaccgttgtactacacaacgatcaatgatcaggtttattttgcctcagagagaaaaagtttaatggttgctcagaatgatattgaaatagataaagaggcattgcagcagtacatgtctttccaatttgttcctgaaccaagcacgcttgatgcccatgtgaaaaaagtagagccgggttcacaattcacaatccgcccggacggcgatatcacattcaaaacgtatttcaaagcgaacttcaagccggttcagactgaagaagacaagcttgtgaaagaagtccgagacgcgatctatgactctgtaaacgttcatatgagaagtgacgttcctgtcggttcgttcctgtctggcgggattgattcttcctttattgtgtctgttgcgaaggaatttcatccaagcttaaaaacattctctgtcggctttgaacagcagggcttcagtgaggttgatgtagcgaaagaaacggcagcggcgctgggcattgaaaatatcagcaaagtcatttcgcctgaggaatacatgaatgagcttccgaagatcgtatggcattttgatgacccgcttgctgatccggcagcgattccgttgtactttgttgcaaaagaagcaaaaaaacatgttacggttgctttatcaggtgaaggagcggatgagctcttcggcggatataacatttaccgtgaaccgctttcgcttaaaccgtttgaacggattccgtccggcttgaaaaagatgcttctgcacgttgctgccgttatgcctgaaggtatgagagggaagagcctgcttgagcgcggctgcactccgcttcaggatcgttatatcggtaacgcgaaaatctttgaagagtctgtcaaaaagcagctgttgaagcattataatccgaacctttcatatcgcgatgtgacgaagacttactttacagaaagcagctcgtacagcgatatcaacaaaatgcagtatgtcgatatccacacttggatgcgcggcgacattttgttaaaggcggataaaatgacgatggcgaattctttggaactgcgtgtgccgttcttggataaagtcgtattcgacgtcgcttcaaaaattcctgatgagctgaaaacgaagaacggcacgacgaagtatcttcttcgcaaagccgctgaaggaattgtgcctgagcacgtattaaaccgcaaaaagcttggtttccctgtaccgatccgtcattggctgaaaaacgaaatgaacgaatgggtgcggaatattattcaagaaagccaaacggatgcttatatccataaggattatgtccttcagcttcttgaagaccattgtgcggacaaggctgataacagccgtaaaatttggactgtgctaatctttatgatctggcacagcatcaatattgaaaaacggtatatgcctgaagagctgagccatcagcctaaagaagtcatctttgtgtaacagacaacaaggctttcgagtagtcgaaagccttgttgttatccttttatttctccatcatcattgatttacccaatccgtacggaatattcagaaaaatgatataatgatatttttttctaggggagaagaagcatgcaaaaacaaaaacaagagctgcaccgcggactcgaagaaaggcatatttctttaatgtctttaggagctgctataggagtagggttgttcctcggctccgcatcagctattcaattagcagggcctggtattttggtagcgtatgccgcaagcggcctggtcatgttttttattatgagagcgcttggggaaatggccattcaaaaaccggtcgcaggctccttcagcaggtatgcgcgtgattatttgggaccgcttgcaggctatttaacaggttggaactactggtttttatgggttgtcacctgtatggccgaaatcactgctgtcggcatctatatggggttctggtttccggacgtgccaaactggatttgggcgttatcggcactggtcattatgacgggtgttaatttcctggctgtcaaagcttacggcgagctggaattttggttcgcattgattaaaattgttgcaatcttatccatgattgctgttggtttattgatgattattgcaggagtcggcaatgggggcattgcaaccggaatcagcaatttgtggaacaacggaggatttttccctcatggattaaaaggggttttattgtctcttcaaatggtcatgttcgcctatttagggattgaaatgatcggggtgacggctggcgaagtaaaaaacccgcaaaaatcgttagccaaagcaatcgatacagtattttggcggattttgattttttatgtaggcgctttatttgtcattatgtctatttatccgtggcaggaaattggctctcaaggaagtccatttgttctcacatttcaaaaagtgggcattccatcggccgcaggtatcattaactttgtcgtgttgacagccgcgctgtcttcatgcaacagtggtattttcagcacagggcggatgctgtttaacttggcggaacagaaagaggcgccacaagcatatggtcagctgacgaaaggcggcatcccgggtaaagctgttctggcttcagcgggcgctttattagtcggagtgctgttaaactatgttgtccctgcgaaggtatttacttgggttacaagtattgcgacgttcggagcgatttggacgtgggcaatcattttgctttctcaaataaaatacaggaaaagtttgaagccggaagaaaagaaacaattaaagtacaaaatgcctttatttccgtttacgtcttatgtgtcattggcatttctagcattcgtcgtcattcttatggcttacagccctgatacaagagtagccgtgattatcgggccgatatggtttctcatcttgctggctgtgtactatggaaaagggtttcataaaaaaaatgcggctgctgccagcgaacgaaatatcagctgacaaaaagagctcccagtgggctctttttgtgtgtgctcatagaaaatagagaacaggaaagaataggtatgtgtttttgcagaggctgtttatagttttgtgataagataaaagtcatacgtttcatgctatatgtgaacgttttatggaaaaatcgaaacccgaactgtatgacgtccgggttaacgatggttattgctttcaaatataatttgaaaaatggtaaagtaagacgaagcaggtcttatgtttgttgaagaaatttataatattggcccttttctacatattctgaccgtattctttgcatatcttttcggtcttcttccgtcaaagggcggatgacttttgcagggcggccaaaggcgagatggccaggcggaatgatttttccgggcgggacaagactgccggcaccaataaaagcgccttcgccaatttcggctccgtctaaaatgattgagcccatcccgattaaggcgttcttgcggataacagcgctatgaagtgtaacctgatggcctatcgtggcgtcatcttcaatgagtagcgtcttgttcgggctttgatggaggcagcttaaatcttggatattgactctgtttccgattctggtcggcgcaacatctccccttatgacaacagaaaaccaaatgctggactgttctccgatcacgacatcaccggtaattgttgcattatcagctataaaggctgttgggtggatatctggcttgtgttccttataagggtagatcataagattcatccttctttctctatttaaatttcgtatgaggtgaagatcatgtggacctggaaagcagacagacctgttgccgtgattgtaatcattcacggggcaagtgaatatcacggacgatataaatggctgattgaaatgtggcggtcttcgggttatcacgttgtcatgggcgatttgcctggacagggaacaacgacaagagcgagagggcatattcgctcgtttcaagaatacattgatgaagtagatgcttggatagataaagcgcgaacctttgatcttccggtttttcttctaggtcacagcatgggcggtctggtcgcgattgaatgggttaagcagcaaagaaatccccggattacgggaattattttatcatcaccgtgtctcggactgcaaattaaagtgaataaagcgcttgatcttgcatcaaaaggcctgaatgtcatcgctccgtcacttaaggttgattcgggattatcaattgatatggcgacgcgcaatgaggacgtcatcgaagctgaccaaaatgattcgttatacgtcaggaaagtttctgtcagatggtacagagagcttttaaagacaattgaatcggcaatggtgccgacagaggcatttttgaaagttccgcttcttgtgatgcaagccggtgatgacaagcttgttgacaaaacgatggtcatcaagtggtttaatggtgttgcttctcataataaagcatacagagagtgggaagggctttaccatgagatcttcaatgaacccgagagagaagatgtttttaaagcagcaagagcgtttactgatcaatatatttgaactagtagggggtgcatgtgttgacagtaccggaacatccttttggattgatggcaaaggtatatcgagatatttttccgctcgttcatcaagagctggacatatggaagcaaaaatcagaatcgattcataacagtgaattgaaagcacaggcaaccgcaagtattcgggacaaaacgtttcactgtgaaggcggcggcatactggccttattgtcaggcagccaaaagcagaaatgtgtcgagtttatcatcgcgtatcaaacgattagtgattatttggacaatctgtgtgaccgcagcacctcgctggacccgcaggattttcggatgctccatgcctcaatgcaggacgcactgacagttggggcggaactgcaaaactattatcaattcagggaagaacaggatgacagcggatatttgcatgaactggttaaaacgtgccagcgtgttctcggctccattgagcactatgacatgattaaaccttatctgcttgaactgtgcggctattattgcgatttgcaggtgcataagcacgttattgagcatgagcgtgttccgcggcttgaaaagtggtttactcaatatgaatcagagctgcctgagatggaatggtatgaattttcagcctgtgcaggctcaacgttaggcattttctgtctggttgcgtattcgttccagcctgatttcacagaaagcaccgctaaaaaaatccgagacagttattttccttacatacagggtcttcatattcttcttgattatttgattgatcaagaggaggacttgctggaaggagacttgaatttctgctcgtattatcagtctcatgaagagatgatggaccggcttgaacactttatccataaagccgacgagcatttacaaggcattccgcatgaaaacttccatcgtttaatcaatcgcggcttgcttggcgtttatttgtcagatgataaagtggcaggccaaaaggaaatgggccggctcgcaaagaagctgatcaaagccagcggaaaaacctcccttttcttttatatcaacggcagagcctaccggaaatttcaaaaaatgtcctggatgaaaaattcaaagaaaaaagctcaaatcatttgctgatctgagcttttttttcgatggcgacaataaatggcgggtcattttgctgattgataaacccgtatgttaatacacgggctgtttgctggtccaagtcccggcaaaactcgagcacgtcgtttttttcagctttgccttccgggtggccatgatagacgacgagaacaatcagaccttcgtctttcatgatgctgagaagctgttcaatggctttgatcgtagaactgccgtttgtcgtaattgatttgtccccgcccggcaaatagccgaggttaaataccgcggccgccactttgccatgtgtttcaggcgggagggattcagcgattttatcatggcttttgtgaaataacgttgttcgcgcttgatacatgtcaccgagccgttcctttgtattggccacggctgattcttggatgtcgaatgcgtatacatggccgttttcaccgacaagctccgctaaaaactgtgtatcatgtccgttgcccattgtcgcatctacgacaatatctccctctcccgcggccattttcagcagttctttgctgtaaggaagaattttcttcaaaatcatagcgctgattcctcctcaagccgttgaaagaactttccttgatagctgcctcgattttctagctctttattaatggcgccaagcacttcccatttgttgacgctccacattggcccgatcatcaactcaatcggtccgtcacctgtaatgcggtggacgatcatttcaggcggaatgatctcaagctgatcgcagacgagctgcacataatcatcttgagaaagaaattccagcttgcccttttcatattgtttgaccatcggcgtgcctttcagtaggtgaagcagatggattttaatgccctggacatccaaatctgcgacggcctttgccgtttccatcatcatgtcccggtcttccaaaggcagcccgttgataatatgcgagcagacacgtatgccgtgttttcttaatttattgacgccttccacatagcagttaaaatcatgtgcgcggttgatcaaaagtgcagtccgttcatgaactgtttgaagcccaagctccacccacaaatacgtacgttcattcagctctgccaagtaatcaacgacatcatcaggcagacagtccgggcgtgtggcgatcgaaatgccgaccacatcatctaaggcgaggacggattcgaatttctcacgaagcacctcaaccggggcgtgagtgtttgtgaaagcctgaaaataagcgatgtacttgccgtccttccatttttcgtgcatgcggtttttgatgtcatggaattgcgtaattaaatcatcggtccggtttccagcaaaatctccggagcctgctgcgctgcaaaacgtacagcctccgtgggctacggtgccatcccgatttggacagtcaaaaccgccgtcaagcgctactttaaacaccttatggccgaaatgttctctgagatgataattcaatgtatgatagcgtttttccgtatttgaataaggaaaaggattgttctgcatcacaattcatgtgcctccttgcgtacgattgcatcctaaaattgtagcacgcatttcacaagagaacaaatgaatatcgaccataaattactttattgaataaagtcagatgaggctacaatatgaatgatggatgatttccattaccaagaggaggggttactgtggcaacaagacaatcagtagatgaacatctccagcaatgtatgcaggcctatgattatgctgaagaacagctgaaaatcgcttctaaacaagagcattataacgatcaagaatatagtgatgcacaaatgcagctagaagatgcggtaaatgccttgaataaactatggctgtcgtcaaatgatcagcagagagaacagctgtacagaatgagacttcagcttcaatctttgcaaaataatatgatcctgcagcaccctcttgatgtgtaggaaaacggacccttttaaaagggtccgtttttttgtaaaaaaaggattgactttgtgagtcaaagtatttattgtattaagtgtactaattgaagtaatacactatagacactaatataaaatcatttatatattgacattaagggaggcagttatgaaacataaaaaacgaaacaaacgtaacgtgccaatgctgattgcggcatctgtgatcgcttgttctttttttcttgttcttgtgatgatcggttttgaatggcaaaaaagtataattgatcatttttatctataaaaggttcagatcgtatagaaagtagggaagtaaatgattcaaatcgatccaagaagctcaacacccatttacgaacaaattattcagcaaatgaaagagctttgtttgaaagggatcatgaagcctggtgataagcttccttctgtcagagaattggcaacgatcattattgcgaatccgaacactgtcagcaaagcgtataaagaacttgagcgagaggggattattgaaacgctgcggggcagagggacctatatatcggagaatgcaaaaacgacactggttgaagggaagatgacgatgattaaagagcaactcaaacagctcatcatcgatgcacactatgcaggggttgagctggaaaaactgcacgaatggataaaggaaatcagcgctgatgtgaagggaggcaaaaaaaatgattgaactgcggcagctgtcaaaagcgattgacggcaatcaagtattaaaagatgtttcattaacaatcgaaaaaggagaaatctttggattgcttggacgcaatggatcgggcaaaacgacgatgcttcgcttaatccagcaaatcattttcgctgacagcggaacgattttatttgacggcgtagaaatcaaaaagcacccgaaagtcaaacaaaatatcatctacatgcctgttcaaaatccgttttacgataagtatacatacaagcagttagtcgatattttgagaagaatatatccgaaatttgatgtcacgtacgcgaatgagctgatgaacagatacgaaattccggaaacgaaaaaataccgtgagctgtcgacaggcttaaaaaagcagctatcgctcgttctgtcgtttgcggcgagaccggcgctgatcctccttgatgagccgacggatggtattgatgcggtgacaaggcatgatgtgctgcagctgatggtcgatgaagtggcagagcgtgatacgagcatcctgattacgtcccaccggcttgaagacatagagcggatgtgcaaccgaattggttttcttgaagataacagcctgaccaacgtcatggatcttgatgagttaaaagaagaatacattaaaattcaaatggccttcgatacagatgtcaatttggccatcagagagcaaaacattccgatgctcgatcaggccggcgtgttttacacagtgctgattccgaaaagcgatgaggagaaaaagagctttttgagagagctgaagccaaaagtgtggaatgagcttcctgtcaacctggaagaagtgttcattgcgaagtttggagggaagcggagatggtagaccgaggtctcctctatcgagagtggaagcagaatcaagtggtgattttgttaagtatcgcgtttttagtattggcaaatccgctttctatcgttaatacgtatttgtcttatcaagggtgtcttgatcgccaagacccgcaatattgtgattttattgtgaattattccataagcaatctgatagatatcaactgggtgccgggtgtcattttggcggtctgcttcctcggaatggagcgttcgaaaggcacgatggattttatattaagcctcccgtataacagaagccaaatttttcagacaaaattttggttaggcggttttgtgattgtgctgtcacaattgattggctttttacttgcatggctgctgattcttgtctataaccctgaacacgtctacttttttgagcacagcagcattggagtaatcgtgataagttttatggctttttcactggtgatggccgccggagcgttaactggaaatgcttttgcccaactgttaacggcgttttcagcagctatattgccgtatttaattattgcattgccggttggaaacctagaagttgtttttggtgcgaatatatgggaaatattcccttcccctgagagttatttctctctggcaagcaatttatcgaacctagtaccgattagttacgttgtaaatgaatggctgattaacagtaaatatcttttattgattccagccgtaatgagcatgctattttacttgattggctttataagcttcaagaagcttccaagtgaacggaacggacactttttcttatggaacagattagatcgcccggtgcaaattctggttatggctttcggcatccttggatttggtttatttggatactataccggacattccattattggttatattttgggtatgatcattggagcagtggctggattctttgtgagctacttctctatttataagaaaacaaaagtgtaagaaatgccttaggtttggagggaagtgagttgccggattccggactgctttacaaagagtggcggcagaataaagtcgccttagttatcaccattttggtttttatattaggtaatccattatcaattttaaatatgtatctcatctatcaaggctgtgtcactggaaaagaaaattgggtcggcccctgcgtattcagcgttgattatttaaatagctcatttatctcattgttttggatttggggagtcgttttggcggtcagccagcttgggattgaacgtagcaagagcttctttgattttacattaagccttccatatacacgagggcagatatttcatgcgaagttccttaccggcggaatggtgattgtggtgccgcagctcataggttatgttttgtctgttttgctgatcatgcttttgaagccagatcaggccgtttattttcacaattacagcttgggaatgattattgttagcatgctggcttattctttggttatggccggaggagctttgacaggcaatagtttcgcacagcttctagtctcatttaccgtggccatttcgccgtttttactcatcagcctgcctgtgatcaacctcgagatcctttttggcggatcaatagattttatccatggtccagtacctaaatgggtgcagtatttcattccgataatttatgtagactcgaaatgggctgagaattcaccatattatttagtcattccggctatcatgactatcattttttacatcatcggctatattagctttgttaaaatgtctaatgaaagaaacggatatttcttcttatggaagccgcttaaccgcccggtgcagatcatcgttattatcataggaatcatgggcttcggctattttggatttactgcaagcgagagctttgccggttatctcattggcatgggtacaggtgcggtaatcggtttcttgattagttattttgcgatttataaaaaaatgaaacttttgtaagggagagagaacatatgattgatgttcagcatatcgaccattctttcacgatcggaaaaaagggccgtgagaatgaagttccagtattgaaggatgtttcattgagcgtggcgaaaggggaaatcgcctgcattgtcggacgaagcggctcagggaaatcaacgcttttgaatttaatttccggctacatatcgccgacaaaagggcggattgtcattaatggcactgatgttacggggtttaatgaaaaggaatgggcgcaatttcggcttgaccatttcgggtttatttttcagagctttcagctcatcccgggtttaacgacgtatgagaatgtggaaatgccgctggcgttaaaaggaatcaagccatctgagcggaagcaaaaggtgcaggacatgctgaaacgcgtcggtctggaaaaccacgccgctcattatccgaatgaactgtcaggcggccagcagcagcgtgtcagtattgctcgagcattgattttaaatccttcgattatcttagcggatgagccgacgggaagccttgattcagaaacggaacatgaagtgctggaattgatccagcagctgaatcgtgagcgtggcattacatttgtgatcattactcacgatgatgaagtcgcttctatcggacattcaaaatttcagcttcatgatggtgtgctaaaaggaggaattaccgttgaggtttaaggatcaggttcattttatcagaagaaatatgaagaaaaacaggcttcgcgtctttatgacgattctggcgacaacaatggcgtgtgcgtttttggttgtgttgtcgtccgttggatttgggattcaaaagacgattacagatatgacaatgagccagcagattgtaacgaaagtcagcgtaatgggcaaggaaggagacaagccgattaaaaaagctgatttagagaagtatgatcacgtaaggtcagttgtagaaagaacgcaagtgtatgaaccaaacaaagctactttaggcaatcgtacaaatgaaagctcaaatctcatttttactaatatgaatgatgaattaaaggccaatatggaattggaaaagggaagagtcgcaaagtcggaaaatgaaatcgtagtaggatacgacttcgcaaagagattattaacgaaaaaagaatcggaagaatataacaaaaaaatcgaggaagcaaaaggaaatccagaagatataaaagaaccaaagggctatacgaaagatattctaaataaaacaattgaactaagtgtatcgaagacagattctaaaacaggggatgttacaaaaacaaaaacatatgactttaaaattgtcggtattacaaaaaaaccatctcaagactggatggaggactcaaatatttttatcagtgatcaattcaaaaaagatttttcggaattcttagatttcaaaggcggaaatgttgaaacgaacattggtgtttttgctgataagtttgagaatgtggaacagctgacaaatgatctaacagatgacgggtactatgtcacatcagtgactactgaacttgagggagccaataccttcttcatggtcttcaaaatcggactgatctttgtcggatgtatcgcagttatcatttcagcgatcggcatttttaacacgatgacgatggcggtgacagagagaacgcaagagatcggcattatgaaagcgattggggcgagcccgtcaatcattcgccgaatgttcttgatggaaagcgcgtatatcggaattttaggctgtgtgattgggattatcatttcttacggcgtgagctaccttgtcaacctggccgttccgatgattcttgcggccacaagcggtggcgatgcgggcgatttgaattacacattctcctacatcccggcgagccttgtgatcattgccgttgtgatttgcggaggggtcgcagtcatttccggaatgaacccggcgagaaaagctaccaaaaccaacgtgctgacagcgttgagaagagaattataatgcgaacgagccggctgagacagccggctttttctatagcgcatgctggcgttttgctatacacttgataaaaaaggaaaaagtgcggtgagtcgattgtttaaacttttgctgattgaagatgatgaatcgctgtttcatgaaatcaaggatcgtttaacgggatggtcctatgatgtatacggcattcaggatttcagtcaggtgctgcaggaatttgcggcggttaatcctgattgtgtcattattgatgtgcagctgcctaaatttgacggctttcattggtgccgtctgatccgctcccggtcaaatgttccgattctctttttatcctcccgggatcatcctgctgatatggtgatgtccatgcagctcggggcagatgactttattcaaaagccatttcattttgatgtgctgatcgcgaaaatccaagcgatgttccggcgtgtgcaccattataatacggagccgagtacgattaaaacgtggtgcggcgctgctgtagacgcggagcagaacctcgtcagcaatgacaaaggatctgttgaactgaccaaaaatgaaatgttcattctaaaacaattaatagagcaaaaaaacaagatcgtcagccgggaagagctgatcagaagcttgtggaacgatgagcgttttgttagtgataatacgctgaccgtcaatgtcaatcgcctgcgaaaaaaactggacgccctgcagcttggtgcatatatcgagacaaaggtgggccagggctacatcgcgaaggaagaggacaagttctatgattaaagcattccttatcgaaaggcggagctggattgccgcgtttttgtttcagcaggctttgatgctgttcattgcttttgtcgatccttccatatcatttgggaatgtactttatatggtgtatttgtgcatcttgttttttatcatattcctttggttccgctatcggaaagaaacagcgttttataaaagcttgaaaacatgggagaacaatctcgatgtgacagccataaatgaaccggaaacgccgtttgaagcaatggttgaaagaagcattgccgggcaaacagaacacttgaagcagaccgcagcacggcatcgcttagcattggaaaatgaaaaagatgagctgatggcatggatccatgaggtcaaaactccattaacagcgatgcatttaatcattgatagaatggaagaaaaagcactgaaatcccagctgtcatatgaatggctgcgtattcacctgcttcttgatcagcagcttcatcaaaaacgcatttcatttattgaaaacgacctgtcagtagaattcattcagcttcagcctttgatctttaaagaaatcaaagatttacaatcgtggtgtatccaaaaagggatcggttttgacatacagctcgaggccaaagaagtgctgagcgatgcaaaatggctggcgtttatcatcaggcagctgctgacaaacgcggtgaaatacagcgaagcctctgaaatcgagatcaaaagctttcaaaaaggggaacagacgcagctccaagtgaaagattgtggcaggggcattgatccaaaagatgtaccgcgtatttttgataaagggtttacatccacaacggatcaccatgatcaagcgtcaactggcatggggctgtacttggcaaaaaaagcagcggcgccgttattgatccatattgatgttgagtcggagtttggtgcgggaacagtttttacattaacctttccaatacggaatcaatttgaacatgtcataagcgtgtgacgaaaatgtcacatgcttttcttttttgttcgccgtatcgaaggaaaagcccggcattcctttttataatgagattatccaatataaaggagactgcgtaaatggtgattttagaagcgaataaaattcgaaaaagttatggaaacaagctgaataaacaggaagtgctgaagggcatcgatattcacattgaaaagggcgaattcgtcagtattatgggtgcttccgggtcgggaaaaaccactttgctcaacgttctgtcctcaatcgatcaggtcagtcacggaaccattcatattaatggaaatgacatgacggctatgaaggaaaagcagctggctgaatttagaaaacagcatttaggctttatctttcaggattacaatttgttagacacattgacagtgaaagagaatatccttctgcctttatcgatcacgaaactatcaaaaaaggaagccaatcgcaagtttgaggaagttgccaaggaactgggaatatatgaattgcgggataaatacccgaatgaaatttccggcggccagaagcagagaacatccgctggaagagcgtttattcatgacccgagcattattttcgctgatgaaccgaccggcgcgctcgattcgaaatcggcctccgatctattaaataagctgagccagctcaatcaaaaacgcaacgcgacgattattatggttacccatgatcccgtcgctgccagctactgcggcagagtcatttttattaaggacgggcaaatgtatacacagctgaataaagggggccaggacaggcaaacgtttttccaggatattatgaaaacgcaaggcgtgttaggcggggtgcagcatgaacattaatcagctcatcctgcgaaatttgaaaaagaatctccggaattactatttgtatgtgtttgcgctcatctttagcgtggcgctttatttcgcctttgtcacgctgcagtatgatccagcaattaacgaagtgaaggcttcaatcaagggagccgcggctattaaaaccgcttcgattttgcttgtggctgtagtggcgatcttcattttatatgccaatacgatttttattaagagacggagtaaagaaatcgggctgtttcaattaattggaatgacgaagcataaaatttttcgcatcttaagtgcagaaaatgtcatgctgtatttcggttcattagcgatcggggtagcggccgggttttcgatatcgaagcttgtcttgatgattctgttcaaaattgtcgatgtcaaagcggatgcgaaactgcatttttctgagcaggccttggtccaaacggtcattgtgttctgcggcatttaccttttgatcatgatcatgaattatacgtttatcaaaaaacagagtattttatctttgtttaaagtaacgtcctccactgaagacaaagtgaagaaaatatcatttttccaaatgctgatcggcgctttaggcatcgtgttgattttgacaggatactatgtgtcttctgagctgtttggcggaaaatttaagaccattaatgaactgtttgttgcgatgagcttcattctggggagcgtcattatcgggacgtttttgttttataaaggatcagttacgtttatctcgaatatcattcgaaaaagcaagggcggctacttaaatatttctgaggttctgtcactgtcttcgatcatgttcagaatgaaatcgaatgcgctgctgctgacgattattacaaccgtttcagcgctcgccatcgggctgttatctcttgcttacatctcgtattactcgtcggaaaagaccgctgaacaaaatgtagcggctgatttttcattcatgaatgagaaagatgccaagttatttgaaaacaaattgagggaaagcaacatctcgtttgtaaaaaaggcaacacctgtcctgcaagcaaatgttgacattgcaaatattatggatggaactccgaaagagatgcagggcgatcccggcaatatgcagcttgctgttgttagcgacaaagatgtaaaaggagtcgatgtggcggctggagaagccgttttctcaggatacaccgacttgctgcaaaaaataatggttttcaaggactctggtgttattaaagtaaaaagcaagcacgagacgcagccattaaaatataaaggattaagagaagagtttcttgtgtcctacacgtttacaagcgggggcatgcccgctgtcattgtggatgacagcctgtttaaacagctggacaaggataaagacccccgcattcagctggcgcaatctacatttatcggcgtcaatgtgaaacatgacgatcaaatggaaaaagcaaatgagctttttcaacaggtgaacaagaaaaacgagcatttatcaagactagatacaagcgctgcgcaaaaatcactgtttggtatggtgatgttcatcgtcggcttcttagggttaacgttcctgattacatcaggttgtatcctttattttaaacaaatgggtgaaagtgaagatgaaaaaccgagctatacaattttaagaaaactcggctttacgcagggcgacctgataaaggggatacgcatcaaacaaatgtacaacttcggcattccgctcgttgtcggcctcttccacagttactttgccgtccaatccggctggttcttattcggatcagaggtatgggcgcctatgattatggtgatggtgttatatactgcgctctactccatttttggttttctgtcagttctttattataagaaggtcattaaatcgtcgttgtgaaacagaaaaagctccagacattctggagctttttgtttatcgttttggcgcccgataaccggcggcttcagcttcttcaactgagcaaaacatttcagccggatcggttgtccggtcgtagtatgtactgcctggcgtgtggtagatgccgtttctgcttcctttgatattacagccttctgctttgtcagctgttttggtttcatcacttttactcgtattgtttgaagaacttccagtgtcttcatgagagctggcggtttggctttccgtctcttttaattgattttcaagctttgttttatcttgtcgaagtgtttcattttcagcctttgccgtttttgcatcttctttgagctgctttttgattttcttgaagctctttaatctcagcttttaatgatttctgagtcttttttagatcgctattttcgtttttaagcttctcaagcttgtcttgatcttctttgttgtcttttaatttctttgcttcagagctgacagatttatattctttctcaagttcttcgtgctcttttgtgaggtttttatattcggcgtttagcgctgaatattttttctcggcatttgctgcggcagtgtcaggttctgccaatgctgccccggtaaagagcagcacaaggcctccaatgaaaagcggccaaaaaagtctctttgagaaacgtttttcctttttcagtacatatctgacaaggtgatataatccatagcccagtgcaatgagacatgccagaaaacctaagaatgctaataccatttccataatatgacccctttttctatttattttacatttttcaaacaatatttgttagattttttcacgctcatcagttgaaaaatgtgagagagacagatagaatgaatgtgctatgataactggattcgtacggagccgttttaggtttcgttttttcatgagcttttttaggtaagaaagggggatgagtatgccgcgtgctcttaaaattttagtcattggaatgtttatcaatgtgacgggtgcttcttttttatggccgctgaatacgatttatatccataatcatttaggaaagtcgttaacagtagccggacttgtcctgatgctgaattccggcgccagtgtggctggcaatttatgcggaggttttttgtttgataaaatcggcggttttaaatcgattatgcttgggatagccattacgttagcaagcctgatgggtcttgtcttttttcatgattggccagcctatattgtgctgctgacgattgtgggctttggctccggtgttgtttttccggcaagctacgcaatggcgggatcggtatggcctgaagggggaaggaaggcatttaatgcgatatatgtcgcgcaaaacgcgggcgtggccgttggttcagcgcttggcggtgtcgtggcatctttctcgttttcatatgtatttttggcaaatgccgtattgtatctgatctttttctttattgtatatttcggatttcgaaatattcaaacgggcgatgcatcccaaacatccgtgcttgattatgatgctgtgaacagcaaagcaaaatttgccgcactgatcattttaagcggaggctatgtactcggatggctggcttattctcagtggtcaaccacaattgcttcgtacacacaaagcattggaatatctctttccttatacagcgtgctgtggacggttaacggaattctcattgtgctcggccagccgctcgtcagttttgtggtgaaaaaatgggccgagtcgctaaaagcgcaaatggtcatcggctttatcatttttattgtgtctttcagcatgctgctgactgcaaagcaatttccgatgtttctcgctgcgatggtgatcctgactatcggagaaatgcttgtttggcctgctgtgccgactattgccaatcagcttgcccctaaagggaaagaaggcttttatcaaggctttgtcaacagtgcggcgacaggcggcagaatgattggtcccctgttcggaggagtgcttgtcgatcattacggcattagggctcttgttttatctctgttggtattgctgctgatcagtattgccacaacgcttctatatgacaaacggataaaatcagctaaagaaacaaataagcaggcatcaatctcttcataataaaagatcccgccgaatgagcgggatctttcagcgtgtcgacaaaccctcgcattcgttgtcaggcctgcgcttcggtgctcacgaattagaacattcgctccgctcctatgctcgtccttcctagacttcaagggttttcaatcacgctgaaaagatgacaaaatcctaaaatgaaaaccattttaggattttgtcaacaatctgaaagatccagctgggtgagcgggatctttttacataatcggaagcactttaacggcatcctttacatttgaatatgttttcagcgacgaaaaattggcatccagtttattcattttcatagccaattcaggcttaatgccagtaatgattaactcagttccggtcaatttcagcaaatggctcagcttgaaaatttggtcggccgtttgttcgttcacttgggccaatccggataaatcaatgatcaaataatcatctttggatgttgataagatattcgtcaatgtgcaaacgatggaattaaatcgctcctctgtcaggtttccgactagcggaagagccgaaatgccattgcgaatcgggacaataggagttgaaagtgcagtaatttccgtgagggaatcctcgagaagcttttcatattctttttgcttggtgatatcattctgaattccgacaaaatacgttttatcctctatttccattggatcaatatttaattcattccagaacatcgttccgtcttttttgtagttttggatctgaacggtgaccggttctttattttgtaaagcggttctgatgttgtccacttctgcaggatctgtgtgtttcccctgtaagaagcgacagttctttcctaaaatttcctcggtctcgtagccggtcatttgaacaaagccttgatttacgtagacaataggattatcttcaagtgcgggatctgtaattaccacaccgactcgcacgtgatcaagtgcttttttgatgacttccagctgtcctggtatcccaaatgattgaaaactagccatataaatcccccttaggccgtcagcttgctatgcgaaagcctgatattcccctttttaaaaatgaattctacagtaaccgtagcacaacacatgttctgattcaagcaagtgcagtttgttgtttgtcattagggcttgtcctcgtatacactaaaaataagaacagaatttgaacatatgaacggaaaggttttctacatgctaaataggtgactaggtcaatgtcactgggtgaaaaatgaatccaatgcatcaagcttaccgatcatgtgttcacatataatggaagaaacaagctttttacagatttgccggtatgtagatatcgaaaatcatcggaatcgtttaagggggctggatggcctgaagtcgctttacgaaataagggctttaggaaggtgatgatgaagatgctgcatcaggtactcattgcttgtgtaattggaggaatcatggggattctcggtcatgtgaaaaagagaggcaggctggagaagcccagaatgacgaagcggtttatctaccttggatttttggaagattggtttatcggcatgacggcttccattttacttgtattatccgctgaccccgattcaggaattcaacttgtcatcttatccattatctcaggctacggcggtgaagctgttctcagaagttttgactttgtgagagaactgaacagcggcggcgaaccggccgagtccaaacgtcaaaccaaaactccacccgaataattgtcctcaatctccgcccgttcagggtacattcccattgtatacaaacctgcttgcacttatgaacagaattctataaaatacagttagattacggttgcgataagaacaatgaagaggagcagtaagaaacagatattgttgcagagagttgacggctggtgaaagtcaatcaagtttgtttccgaactcacctcagagttgcagcggtgaaaagccgctgacgcataactgcgttaaaagtatcaagtgagtgcggcgtatgccgcgctaacgagggtggtaccgcgggaaaacgaaagtctctcgtccctttttgggatgagggagttttttttagtttgggaatattctgaatataatcctctccttcccgtcaatacttgaaccatacacgccgtattcaatcagaaggaggtttttactttgagttttcagcacaaagagatagaaaagaaatggcagacatattggcttgaaaacaaaacatttgccactcttgataataatgaaaaacaaaaattttacgcgctggacatgtttccttatccgtctggagctgggttgcacgtcggccatcctgaaggatacacagctacggatattctgtcccgcatgaagcgcatgcagggctatgatgtccttcatccaatgggctgggacgcattcggcctgccagctgaacagtacgcgcttgacacagggaacgaccccgctgtgtttacgaagcagaatattgataacttccgccgccaaattcaagcgcttggcttctcatatgactgggatcgcgaaatcaatacgactgaccctgaatactataaatggacgcaatggattttcttaaagctatacgaaaaaggccttgcttacgttgacgaagtgcctgtaaactggtgccctgcgctcggtactgttcttgccaacgaagaagtcattgacggcaagagcgaacgcggcggccatccggtagagagacgcccaatgaagcagtggatgctgaaaatcaccgcttatgcggacaggctccttgaggacttggaagagcttgattggccggaaagcattaaagatatgcagcgcaactggatcggccgttcggaaggcgctcacgttcattttgctatagatggacatgatgattcctttacagtgtttacaacaagaccagatacgctgtttggcgctacatacactgtccttgccccggaacacgcattggtggaaaacatcacaacggcagagcaaaaagaagctgttgaagcttatatcaaagaaattcaatcaaagagtgacctagaacgcacagatcttgcgaaaacaaagacaggcgtatttacaggagcgtatgcgatcaatcctgtaaacggagaaaaactgccgatttggattgcggattatgttcttgcatcatacggaacaggtgctgtcatggcagttccaggacacgatgagcgtgattttgaattcgccaaaacattcggccttccggtgaaggaagtcgtaaaaggcgggaacgttgaggaagcagcctatactggcgacggcgagcacgtgaactctgatttcctgaacggccttcacaaacaggaagcgattgaaaaagtgatcgcttggctggaagaaacgaaaaacggtgagaagaaagtgacgtaccgtcttcgtgactggctcttcagccgccagcgttattggggcgagccgattccggtcattcattgggaagacggaacgtcaacagctgtcccggaagaggagctgccgctgattttgccaaaaacggatgaaatcaaaccgagcggaacgggcgaatcaccgcttgcgaacattaaagagtgggtggaagtcacagaccctgagacagggaaaaaaggaagaagagaaacgaatacaatgccgcaatgggcgggaagctgctggtatttcttgcgctatattgatccgcacaatccggatcagctggcatcaccagaaaaattggaaaaatggcttccggtcgatatgtatatcggcggtgcagaacatgccgtgcttcaccttctgtatgcccgcttctggcataagttcctttatgatatcggcgtagtgccgacgaaagaaccgttccaaaagctgtacaaccaaggaatgattctcggcgaaaacaacgaaaaaatgagtaaatctaaagggaacgttgtcaatcctgacgaaatcgtggcctctcacggtgctgatacgctgagattgtacgaaatgttcatgggacctcttgatgcttcaatcgcctggtctgaatcaggattagacggtgcgcgccgtttccttgaccgtgtatggcgcctatttattgaagacagcggtgagcttaatggaaaaatcgttgaaggcgcgggtgaaacattggagcgcgtctatcatgaaacggtcatgaaagtcacagaccattatgaaggccttcgtttcaacacgggtatttcccagctgatggtctttattaatgaagcttataaagcaacagaactgccgaaagaatatatggaaggcttcgtgaagcttctttctcctgtcgcgccacacttagcggaagagctatgggagaagcttggccattccggcacaattgcctacgaagcttggcctgtatatgatgaaacaaaacttgtggatgatgaagttgaaatcgttgttcagctgaacggaaaagtaaaagcgaaattacaggttcctgccgatgcaacgaaagaacagctggaacagcttgctcaagcagatgaaaaggtcaaagagcagcttgaaggcaaaacgattcggaaaatcatcgcggtgcctgggaagcttgtcaatattgtggcaaactaagcctagaaaaaatcccctttgccaaaaggggattttttttcatcagtctcagaatagcaatcgttcggctgactttgatatactgaacatgatcactgtgaataggagtgttttctttggaaataaaagaaatcagcacagccgctttgaaagaaaaaattgaggcggacgaagaattatatttaattgatgtcagagaagatgaagaggtagcggaaggcatgatcccgcaagccgttcatattcgcatgggggatattcctgaaaaaatggaaacccttgataaagacaaagagtacgtatttatctgccgctcaggaatgcgcagcatgaacgtctgcaagtacctggatgagcaaggctttaaaacagtcaatgttgaaggcggcatgatggcctgggaaggcgaaacaaaaccaaaaactaggggagagcggtcccctagtttttatttgtattccggaagccaatcgccgtgtgctgcaaataaatcgtcgcacatggagatgatgtccttcatggaaagctccgcgcttgtatgcggatcaagcattgcagcttggtaaaccgcttctttttttcgtgtgacagccgcttcgattgtcatcagctgtgtattaatattcgtccggtttaaggctgcaagctgctcaggcagttctccggcgaagcacggtgtaattttttttctgtcggcgacgcatgtcacttccacaaccgcttttgaaggaaggttggtgatcagccctgtattcaagacgtttcctccgaaggtgaatggttcgtttgtttccattgcttctataattcttgaaccatattcctttgagcgttcgtgcgtaaggtttttattattgacgatatcatcccgcattttctcccaattttcaatctgcttgacgcaccttctcggatattcgtcgagcgggatttgcagctcgctgatcagttcagggtaattccgtttaataaagtacgggtgatactctgcgttatgttcggacgattccgtgacataatagccgaacttatccattaattcaaaccgcaccatatcatgatgctttgtttttgtttttctttcgctctccttttgatttctggatataaatctgtgccgtcttttttgacttccaaaagccaagccatatgattaatgcccgcaatgcgttcctcaattccgtcatgctccattccgagagctttaaataaatccttcgtgcacacttgaacactgtggcagagcccgattgttttgatattggtatagcggagcatggcgcctgtaagagtggccattggatttgtatagtttaagaaccatgcgtcagggcacatttcctccatatcttttgcgatatcaaataagaccgggattgttctgagagatctgaatatcccgccgatgcctactgtatcggcgatcgtctggcgcagcccataccgtttaggaatctcgaaatcgatgactgtgctcggtttgtatcctccaacctgaatcgcattgatgacatagcctgcgttttgcaaggcgagttttctgtcatcatagctgttgatggccacacttgggttataacggtctcttagattttcgagcatgagctgggattcctgcaggcgtttgggatcaatgtcgtaaagagcgaactcaaatccattcagtgcctctgttaacaggcagtctcccaaaacatttttggcgaaaatcgtgctccctgcaccgataaatgtaatctttttcatattgcttccccctttaatgttaaccctttaccgctccggaagacaggccggcaataaagtatttttgcagcgccaaaaacagaacaaccatcggcagcattgccataagtgccgctgcggcaactaaatgaaggttgtttgcgttttctccgaaaaaacctgccatggctactgttaatgtctgaaccttttgatcttgtaaaaagaaaatggcaaattgatagtcgttccaaataaagacacaagaaatgatacagatggtcgcagtgatcggcttcagcagaggaaacacaatcgtaaaaaagattttcagcatgcctgcaccgtcaattcttgcggcttctacaagctcttttggaatggtcgatcggataaagcctgaatataagaatacggttaacggcatgtaagccgctgtattgatgaaaatggcgattgcgtgtgtattgaccattccggcgtccacgaccattcggtacaaaggaaccatggacgttaacggagggatgatcataatggaaatcagcaaggcaaaaacggctttattcagtttcgtttcccgccgggcaagcgggtaggcggcaagtgagccgaatataattaataacaaggcagaaaaacctgtgatgatcatggtgtttataaaagagtttcctagcgaagcgcgctcccacgcctctgaaaaattatgaaaggagatgtcggctggaaatatccatttcgaactgtagtctccttttgctttcaatgaagtggtcagcaggatataaaaaggaataaaatgcgcacaggccacaatggctgcaagaagcgtaatgatccgcatgctttttgtacgggcggctctcatgacatttccgtctcctttcttttaaagtacgcaagcgcgcaaaagctgatgatcaaaatgacaaatgccataaatatgccttgcgttgcggcatagccggcatcctgccgtttgaaatacaaatcatacataaacgtggacatggattgtgacgcatttccggggccgcctgcggtgagtgcaatgatgacgtcaaacagctttaagcctccgataatgttgatgactatattaatggtaatggagggcattaacagcggcagcgtgatggtaaaaaactgctggccttgtttcgcgccatccatttgcgccgcttcatagtagtctttcggaatgctttgcagaccggctaagtagacaaccatagcgatcccgacatattgataggtgttaatcatgacaatgatccatggattgagcgagggactggcgagcgcattaatagggctgatgccgaagaccccgagcaaatcgttgagcgcgcctccgtcataggagaagaaaaagtaccaaatgtagcccataatgagcgggctgatcatcaccggcaaatacacaattgttcttgttaccgctttcgttttaatgctttgatttaagaggagagcgtacagaagcccgaccacattttgaaaaaaggtgctgccaagcccgtaaagcagcgtgttttttaagatatgccaagtatcaggatcagaaaacagcctttcatattgcgcgaatccaacccattggtagacttgtgaaaatccgttccagtttgtaaaggtaatcaatgtgcctttcacaaacgggtaaatcataaagaccagaacggagagcaaagcaggaatgtacatccaccaaagtgaggactgcttttttggcttaacctgtttcacatgaacgtcccttgcgatctcactcattgttttcagctccctgtgtttcggattgctcccggagtcgtttatattctcttcccagcttctgcgaaatgtcttgaggcgccaaaatgtcagccgcgagctcctgcccaaccgtgcccaggacatcccacattccgtttggcaagtataaccggtcgaagtaaggctcgactttgacatcttgataatactcataatcgtttgcgtagaaaatatcagctttcacattggtcagccctgaaggaagcgatgtggcttcagccatttgtttggcattggccgggcgggccataaatgcgataaaatcttttgcctcttttaattgaggcgaatctttccatgctgcaagggtgtagcgttcaccgccgatccatatcgggtcatcaccgggatggatggcaggtgtcgggataatgccgaccttgacgttcgggttgatctgggcaacgtcttggccgagtgtgccgccttgcattgtaaaggcgattttgttttgggccattaattcaatgagctgtgatttttttgccgtgacggcgtcgatattgatcaatttttctttctgcatttgtttgaggatttctgataaataagtgaatttactccattgaaaagtgccgttgatgagctgttttttttcattatgggcagggtctgtgatgagaagaggtgtagcgaattggtcgtaatattgggcgaatgagcttttgtcatatccggcaaaccagaagggaacaatgcttcccttgctcttttctttaatcgttctcagtgctttgataaagtcatccatggtttccggcggagcaatgccgtaacggtctaaaatattgcgattatacgccagaccgtcttttgcctgattgattggataggcatacacctttccgcttttatttttgaggatgctgtttaaattgggatcaagatcttgagtccatttcatatcccggagatccgctgtatattctccgtacctgattttcccccagccatgtgtatcgaatagatctggcaaatcattggccgccattctgacacgcatcatattttcatagtcattgcctgggaaatgaaggctgacatgaatgtcactgtgttccttttcgaatgctgccgctagttttctgaacgtatctctttcactgtcggttgacattgtagaataaatggttaacgtcttttttgcggtatctgctgagcttttctctgctgaacacccgggcagaacaagcagaataagagagagaaataaaacaaaagtgtgtttcatcttttcctccttatcatcgtgatgaatctttgcttatgtcacctcctttgctgtacatccgcagctttgtcttacgattaatgttgtaggcagggtgacatgttgaggaagcgttcggccattgagacggtcaagcagcagttttacgcctgtccggcccatttcctctgtgtataccttcaccgtcgttaaaggcgtgctggcaaattcagcttcctcaatgccgttaaagctgacgattgcggtatcccgcggcacttgcagtccggcttcctgcagcgcttttaatgcgccgatcgccatagaatcgctggcaataaagaatgcttccggcagatggccttgatcgattgctttcttcatcaggcgatagccctcacgcatgctgtattctccgatcagcacatgctcaggctggggggcggctgactccaaaaaagcggtcaggcgtttatcttcaatcgttctgcgaatgctttggccgtccttcagcgtatgctctttttcttgtccgccaatgtagcctaaccgtttgtagcctaagtcgaaaaggtgatcaatcgcctggcgtgaagccgattcaaaatcgatgccaatcgaatcgtatgcttgcggatctggtgaatgattgataaatacggcatgctccagcctcccgctgatatgcttaaccgcttcatcatgaacacggccgatgacaatgacaccatccaattcccgaaagatatgttcctgaaaggagccgagatgaatcgaatttgtaatgaaaatttcctgttcaaagcattccttttcaatccctttccgaatggaagaaaaataagggtcctgcctttcctgatcaggggacagacagctcagcacaccgatcagcggctgagcccgctgtttttgcccgcgggattttcggcgtttggcaacggtttgataaccaagctcttcagcgatgttgatgactctttgtctcgtttcgcccgcaacagaaagcgactcatcttcatttaaaattctggacacagttgcgctggaaactttagctttcaaggcgatatctttaatacgaaccatgggtatccctctcatctatttagtaaaatattaactcatctgtttttgataaattgatattatcatataaaagtaagcggttacaataattgttttcgaaatattccataatatttactaaatatttagtaaatgatgtgatttatgttggaaaaataaaggggaacccagatctgtctcgtaaatgtgaagtaagcgaataaggaagggtgatgggatgagagccgaaagaagaaagcaactgtttcgattgcttggtgatttgcctgatcggaggccaatcagtgttgagacattacgtattgaagaaagagaagaaaatatcgttgaaacgctcctgctcgatttaaatggacatgaaaaggcgcccgcttattttgtgaagccgaagaaaacagaaggaccgtgcccagccgtattgtttcagcattcgcatggaggccagtatgataggggaaaaagtgagctgattgagggagcggattatttgaaaacgccttctttttctgatgagcttacttcactcggatacggcgttcttgcgattgatcattgggggtttggagatcggcggggaaaagcggaaagcgagatatttaaagaaatgcttctcaccggaaaagtgatgtgggggatgatgatttatgacagtttaagtgcgttagactatatgcagtcacgctctgatgttcagcctgacaggatcggaaccatcggcatgtctatgggaggtttgatggcgtggtggacagcggcgctcgatgaccggattaaggtgtgtgtggatttgtgcagccaggtggatcatcacgtgctgatcaaaacacagaatcttgacaggcacggcttttattattacgtcccatcgcttgcaaagcatttttccgcatcggagatccaaagcctgatcgcgccgcgcccgcaccttagtcttgttggtgtacacgatcggttaacgccggctgagggcgtggacaaaatcgaaaaagaattgacagctgtctatgctggacagggagctgctgattgctaccgagtggtccgttctgcttcgggacatttcgaaacagcagttataaggcatgaagctgtccggtttttgcaaaagtggctgtgactgtaaaaagaaatcgaaaaagaccgttttgtgtgaaaacggtctttttgtttccttttaaccaactgccataaatcgatcctttcttctattgacagaaacaggagagaataatatattctaattgttaacctttgaatataattggttaacaatttaggtgagaagcgctacacgttcttcagttatcagtgaaagggcgagaaatgatgcaagaagaaactttttatagtgtcagaatgagggcttcaatgaatggatctcatgaagacggcggaaagcatatatccggcggagaacggcttattcctttccatgagatgaagcatacagtcaatgctttattagaaaaagggttatcccattcaagaggaaaacctgattttatgcaaattcaatttgaagaggtacatgaatcgataaaaaccattcagccattgcctgtgcatacgaatgaagtgagctgcccggaagaaggacaaaagcttgcccgattgttattggaaaaagaaggcgtttcacgagacgtgattgaaaaagcatatgaacaaatccctgaatggtcagatgtcaggggtgcggtgttgtttgatattcatacaggcaagcgaatggatcaaacaaaagaaaaaggggtgcgggtctccagaatggattggccggacgctaattttgaaaaatgggcgcttcacagtcacgtgccagctcattcaagaataaaagaggcccttgcgctcgcttcaaaggtaagccggcacccggcagtcgttgcagaattatgctggtcggacgatccggattacataacaggctatgttgcgggtaagaaaatgggctatcagcgtattacagcaatgaaagaatacgggactgaagagggctgccgagtcttttttattgatggatccaatgatgtaaacacgtacatacatgacctggagaagcagcctattttaatagagtgggaggaagatcatgactcatgatttgatagaaaaaagtaaaaagcacctctggctgccatttacccaaatgaaagattatgatgaaaaccccttaatcatcgaaagcgggactggaatcaaagtcaaagacataaacggcaaggaatactatgacggtttttcatcggtttggcttaatgtccacggacaccgcaaaaaagaactagatgacgccataaaaaaacagctcggaaaaattgcgcactccacgttattgggcatgaccaatgttccagcaacccagcttgccgaaacattaatcgacatcagcccaaaaaagctcacgcgggtcttttattcagacagcggcgcagaggcgatggaaatagccctaaaaatggcgtttcagtattggaagaacatcgggaagcccgagaaacaaaaattcatcgcaatgaaaaacgggtatcacggtgatacgattggcgccgtcagtgtcggttcaattgagctttttcaccacgtatacggcccgttgatgttcgagagttacaaggccccgattccttatgtgtatcgttctgaaagcggtgatcctgatgagtgccgtgatcagtgcctccgagagcttgcacagctgcttgaggaacatcatgaggaaattgccgcgctttccattgaatcaatggtacaaggcgcgtccggtatgatcgtgatgccggaaggatatttggcaggcgtgcgcgagctatgtacaacatacgatgtcttaatgatcgttgatgaagtcgctacaggctttggccgtacaggaaaaatgtttgcgtgcgagcacgagaatgtccagcctgatctgatggctgccggtaaaggcattacaggaggctatttgccaattgccgttacgtttgccactgaagacatctataaggcattctatgatgattatgaaaacctaaaaacctttttccatggccattcctatacaggcaatcagcttggctgtgcggttgcgcttgaaaatctggcattatttgaatctgaaaacattgtggaacaagtagcggaaaaaagtaaaaagctccattttcttcttcaagatctgcacgctcttcctcatgttggggatattcggcagcttggctttatgtgcggtgcagagcttgtacgatcaaaggaaactaaagaaccttacccggctgatcggcggattggatacaaagtttccttaaaaatgagagagttaggaatgctgacaagaccgcttggggacgtgattgcatttcttcctcctcttgccagcacagctgaagagctctcggaaatggttgccattatgaaacaagcgatccacgaggttacgagccttgaagattgattcctggttaaacgagcggttagacagaatgaaagaagccggcgtacatcgtaacctgcggtcaatggatggagcgccggttccagagaggaatattgatggcgaaaatcaaacggtctggtcctcaaacaattatttagggctcgcaagcgatagacgtttgatcgatgcagcccaaacagcattgcagcaatttgggacaggaagcagcggttcacgtttaacgacaggcaattcggtctggcatgaaaagctagaaaagaagattgccagctttaaactgacagaagcggtcctgctgttttcgagcggttacttggccaatgtcggtgtcctttcatccttgccagaaaaggaagatgtcattttaagtgaccagctcaatcatgcaagtatgatcgacggctgccgactttctaaggctgatacagttgtttatcggcatattgatatgaatgatcttgaaaacaagctgaatgaaacacagcgttatcagcgccgttttatcgtaacagacggagtattcagcatggatggcacaatcgcccctcttgatcagatcatctcacttgcgaaacgctatcatgccttcgtggtcgttgatgatgcccacgcaacaggagttttgggcgattcgggacaaggaacgagtgaatactttggtgtttgtcccgacattgttatcggcaccttaagcaaagctgttggcgcggaaggaggttttgcggcaggatcagcggtcttcatcgactttttgctgaaccatgccagaacatttatctttcaaaccgctattccgccagccagctgtgcggctgctcacgaggctttcaacatcattgaagccagcagggaaaaacgacagcttttattttcttatatcagcatgatcagaaccagtctgaagaatatgggttatgtggtgaaaggagatcacacaccgattattcctgtagtcattggcgatgcccataaaacggtcctatttgctgaaaaactgcagggcaagggaatttatgctcctgccattcggccgccaaccgttgcgccgggtgaaagccggattcgaattacaatcacgtctgaccacagtatgggtgatattgatcatttgctgcaaacatttcattcaatcggaaaggagctgcacatcatttgaggggtttttttgtgacgggaactgatacagaagtagggaaaacggttatatccagcggtcttgctgccttattgaaagacaataatagacatgtcggggtgtataaaccatttttaagcgggatatcgcgccatcatccagatagtgatacaagtttgctgaaagatatgtcgcagaccagtctttctcatgaagacattacgccttttgccttcaaggcgccgcttgcaccatacgttgcagggaaacttgagggaaagactgtcaccatggaagaggttttaagccattgggggcggattagagaaaaacatgaatgcttcatcgtagaaggtgcaggcggtatttctgtgccattgggagaggactatttggtcagtcatgtcataaaagcgttgcagcttcccatgattattgtggcgcgtcctcgccttggaaccattaatcatacctttttaactgtcaaatatgcagaaagcatggggcttccaatcgccggaattatcatcaatggaatcagtgactctcctgatgaagatgaaaaaaccaatcctgagatgattgagcgcttatgcggtgtgccgattttaggggttacgccaaagcttgccaacgtgacgaaagaaacggttctacatatggtaaaagaccatatcaatctatcattactgatgaatcaagtgggggtatgagaatgaatcaatggatggaactcgcagaccgggtgctggctggagcagaagtgactgacgaagaggcgctttcaatattacattgtcctgatgaagatattttgctattaatgcacggggcttttcacatcagaaaacacttttacggaaaaaagtaaagctcaatatgattatgaatgcgaaatccgggctctgcccggaaaactgcggctattgttcacagtctgcgatttcgaaagcgccgattgagtcttaccggatggtgaataaggaaacgctgcttgaaggcgcgaagcgggcgcacgatctgaatatcggcacatattgtatcgtggcaagcggcagaggtccgtctaacagagaagtggatcaggtcgtagatgcggttcaggaaattaaagagacgtatggactgaagatttgtgcatgtcttggactgttgaagccagagcaggcgaagcggctcaaagatgcaggagtagaccgctataatcataatttgaatacgtcacagagaaaccattcaaacatcacaacctcacatacatacgatgacagagtcaatacggttgaaatcgcaaaagaatcggggctgtctccgtgttcaggcgccattatcgggatgaaggagacgaaacaggatgtcattgacatcgccaaaagcttgaaggctcttgacgcggattccattcctgtgaattttttgcatgcaattgatggcacgccgttagaaggcgtcaacgaattaaacccgctgtattgtttaaaagtgctggcgctgttccgttttatcaatccatcaaaagaaattcgcatttccggaggaagagaggtcaatctccgcacattgcagccattagggctttacgccgcaaactccatttttgtcggagactacttaacaactgccgggcaagaggagacggaggatcataaaatgctgagtgatttaggctttgaagttgaatcagtcgaagaaatgaaggctagtttaagtgcgaaaagctgaaagaatcaataaaagcaatcggtatgatgtcgattgtttttatttttgaacagaaaggagaaaatcacgtgacaattgcatcgtcaactgcatcttctgagtttttgaaaaacccatattctttttacgacacattgcgagctgttcatcctatctataaagggagtttcttaaaatacccgggctggtatgtcacaggatatgaagaaacggctgctattttgaaagatgcgagattcaaagtccgcaccccgctgcctgagagctcaaccaaatatcaggacctttcacatgtgcaaaatcaaatgatgctgtttcagaaccagcctgatcatagacgattgcggacgcttgccagcggagcgtttacgccgagaacgacagagagttatcagccgtatatcattgaaactgtccatcatttgcttgatcaagtgcaaggtaaaaaaaagatggaggtcatttcggactttgcttttcctttagcaagttttgtcatagctaacattataggtgtaccggaggaagatagggagcaattaaaggagtgggctgcgagtctcattcaaacgattgattttacccgctcaagaaaggcattaacagagggcaatattatggctgtgcaggctatggcatatttcaaagagctgattcaaaagagaaaacgccaccctcaacaggatatgatcagcatgctcttgaaggggagagaaaaggataagctgacggaagaggaggcggcatctacgtgcatattgctggcgatcgccggacatgagacaacggtcaatctcatcagcaattcagtcctttgtctgctgcagcatccagaacagcttttgaaactgagagaaaatccagatcttattggtaccgcagtcgaggaatgtttacgctatgaaagccccacgcaaatgacagccagagttgcgtcagaggatattgacatctgcggggtgacgatccgtcaaggagaacaagtctatcttttgttaggagcggctaatcgagaccctagcatattcacgaaccccgatgtcttcgatattacgagaagtcctaatccgcatctttcattcgggcatggccatcatgtttgcttagggtcctcgctggcacgattagaagcgcaaattgcgattaacactcttctgcagcgaatgcccagccttaatcttgcggattttgaatggcggtatcggccgctttttggatttcgggcgcttgaggagctgccggtgacttttgaataagcctaagaatgtgagtgccaaaaaagtgtcagccccgccgaaaatgggcaatctataaaaaaggggagtgaacatcgtgaaaaaagtgctgatcgccggcggaaatggtgtgattgggagactgcttgctgaagggcttatttcagactatgaagtgactgtgcttgataaagatcatttcgatggcaaagcctcttccattcaggctgacgcggcaaattatgaggagctgttgaagaagattccaaaagataccgatgccatcttgaatttactcgctgtgaaaatcaaatacgatattatggacatcgctgagtttgaaaaaatgacggatgttttctatagggcaagctattatctgtgccgtgcggcagcggagctcggcattcaaaagctcgtgttcgccagcagcaatcatgtcacagatgtatatgaaaaagacgggcgctcgctcttaggacgggaaatcacaacaagcgattatccgctgtcaaaaaacttgtacggtgtattaaagctgacctctgaacagatcggccatttgttttatttggaaaataagctatcagtaatcaaccttcgaatcggaacagtcgtgacagatgaaatggatacgctgcatgaaaaagaacggacgaaaaagacactgctttctcaccccgatctgctgtcgattttcaaagccgccattgagaccaacatccggtatggcacttattacgccgtctctgataatccgggccggccatggtccattgaatctgccgtgaatgaacttgggttttcgccacaaatcaatacggctgaacttctgaacgaggaggagaacggagcataatcattttctaagattatgctctttttcttttgttatcggtctcaattcgcggcagcccccgcccggccggggacactgttcaaatgattatagacatggcaatcacagatttgctacattttagacacgatatcgtcacatgctgagctcggtttccaaaaatatgataacgcttacaaagggaggtgggagctatcgcacattcactgaaaaaccgtctgtttgatatgttgatttatggtttcttgctgatgttcgctttaatatgcgtacttccgttcattcatgttatcgcagcatcctttgccacagtagaagaagtcgtgtcgaaaaaatttattttaataccgaccactttttcgctagatgcttatcgctacattttttcaacagatattatttataagagtttgcttgtttctgtgtttgtgacagtgataggcactgcggtcagcatgtttctttcgtcactgatggcttacgggttatcccgccgtgatttaatcggccggcagccgctcatgtttctcgtcgtatttacgatgctgtttagcggcggcatgattccgactttccttgtggtcaaatcgcttggattgctcgattcttactgggcgcttattttgccgacagccattaatgcctttaacctgatcattctgaaaaacttctttcaaaatatcccgtcaagcctggaagagtccgcgaaaattgacgggtgcaatgatctgggcatattctttaaaattgtgctgccgctgtctcttcctgcgatcgcaacgatttcactattttatgcggtcacgtattggaacacgtatatgacagcgatcttgtacttaaatgattcagcaaaatggccaattcaggtgcttctgcgccaaatcgtcattgtatcaagcggtatgcagggggatatgtctgaaatggggtcgggcagcccgccgcctgagcaaaccattaaaatggcggtcatagtggtggcgaccatccctgttctgcttgtctatccgtttatacaaaagcattttgcaaaaggagctttgctgggatctgtcaaaggataaagaaatatgaaacggaggggtacgatgggaaacaaatggagggtgcttttgattgtgcttgtactggcactcggcggagtgctggcgggctgtaaaggaactgatcagtcttcggctgaaggcaaagctggcccagattcaaaggtaaagctgtcttggatggcgattttgtatcaccagcagccgccgaaagacagggcgattaaagaaattgaaaagctgacaaatacagaactcgacatcacctgggttccagacgcggtgaaagaagacaggctgaatgcagcgcttgcagccggcaatcttccgcaaatcgtgaccatccaggatattaaaaattcgtcagtcatgaatgcctttcggtcaggaatgttttgggaaatcggcgattatatcaaggattatcccaacttaaacaaaatgaacaaactcattaataaaaatgtgacaattgacggcaagctctacgggatatacagagagcgcccgctttccagacaggggatcgtcattcggaaggactggctggacaatttaaatttgaaaaccccgaaaacgttggatgagctttatgaagtggccaaagcatttacggaggacgacccggacaaggatgggaaagatgatacattcgggctggcagaccgtaatgacttgatttacggcgcgtttaaaacgattggctcgtatgaaggcatgccgacagattggaaggaatcgggcggcaaattcacgcctgatttcatgacacaggaatacaaagacacgatgaactatatgaaaaagctgcgtgataacgggtatatgaataaggattttcccgtcacaagcaaaacccagcagcaagagctgttttctcaaggaaaagccggaatttatattggcaatatggtagatgcggtcaatctgcgcgaccatgcctctgataaatcgatgaagctcgagatcatcaaccgcataaaaggcccagatgggaaagagcgggtatgggcatcaggaggccataacggcgtgtttgctttcccgaaaacgagtgtgaaaacggaagctgagcttaaacggatcttggcgttttttgaccgaattgccgaagaagatgtctatagcctgatgacttatggcattgacggcgttcattacaacaaaggtgaggacaaaacgtttacacgcaaagaaagccaggtaaaagactggcagactgatattcagccgctgtccgctttaattgccattgataaagcctacttaaaaaacactggagatccgcttcggacggcgtacgaggagctgaccgaggacaatgaaaagattatcgtctcaaacccggctgaaagcctgtattccgcatcggagtcggaacggggtgacgaactgaagaaaatcattgatgacgcgacctacaaatatatgattggagacatcacagaaagccagttcgataaagaagtggaaaaatgggagtcaagcggaggaaaacaaattattcaggaatacgaagaagcgtttaaacaagcaaaataacattggaaaaacccaaaacgcgcaagcggttttgggttttttacatgcttcttttttgctggcggtagtttcccggtgtaatcccttccagcttcttaaatgatctgatgaagttttgggagtttttatatttcagcttttcggcaatgtccttgaccgccatgtcggtttcggcaagccagcttttcgccatatggtgtcggtagcttgagacatactcgctgaatgaaattcccatttcttttttgaaaatactgcttaaataatttgggttgtaatgcagcctgcgtgcgatttcgtccagtgtcaattcggattcaaactcatgatggatgatatgaatgatgttgtcggaaatatttttgtactgggcatccgcgcgggcgttcactttgtctgtcatcggatcaataaactcattctttagccagttttcggtatcctcgaacgttttcagctcaaaaatttggtcatacagcattttgttttcttcaagctcaaacaattcgatcccaagcacatgcatcagctcaatcacatggttcaaaaaacgggcgatggcgatttgaaattgatacgggttggtgttctgggtgaaaatggcttgtaaaatcgcgtgcaggcatttatccgctttctccttgtctcctgctttgacagcatcgaacagctcatgctgaagctgctttggaaaatgggttttgaaggtttttttctggtcaaggtcttcgtaaaagatgatcgacttgttttccgctttcagccgatatttcaacgcttctgagccttccgcataggctgttttcgcttttgtcagcacatcaaacggctggctgatgccgatgctgacagacagctgcagctcagcttccgctttttcctgaatcatccttgcagtctcattcagctcagccatgaattcttcctttgtcccgctttgattgatcaaaatcgtcgcctgctgtttgtcaactacggcgggggcaagatgtttgtccgtcgggatgttgcgctcaatcaggctgttgacggcaaacaaaagcagatccatatcttttttctcataaggcgtatgattcagtgtgtcaatttggagcacaagcagggcaaggtgccgccaattttgctttaagccgaggctttcaaaacggttatcaacctcctcatccgtcagttttccaagcataagcctgaccataaaatattgctgcagatgagtggcctgctgcttcatcgtttcttcaaggtcgtcatttctgtccttcagctgcttaaagctctgttcaattaactcaaattcattttgaggaggctgttgtttctcttgtatggctccatgtcttgcgaatgattcgtaaagcaccctgatcggcttgtaaaaatggcgggagccaagccaagagaacagcaatgaaagcgttaacaaaatgaggcatactgcaaaagtgatccagccgattgatttggcttctttttttaactcaggcagggaaacgagagaaaaataagtccatgcattatagtcagatttttgataggtgactttataatgaatccggtcaatcactgtttcaaactgtccgctattggccgtttgcgccagcactttttggacaaagccgtcgttatgaagagattcaccaacgtcagacatattgttatgaaggatgatgaggcctttttcatcgatgataaacaggttgttggcgtttgaatagccgggcatatttttgacaagcgaacagctcgggatgcttgcggcggccaatccctttgtatttgtgctgttcaaaggaagctgcttaattaaattgatattgtagcggcagttttctgctgtgccttctttggttgaaatcaaatgattgttttcctcaagcgtccaataggagcggctcgctttttgtttcgtgtacgctgaggctgcttcatgaagagtgtctgtattcaaacggtacaaaccggaattgttcatgtaccattttttcgtataactgactaacgtcatgttggacagatcggtatcaaagctttgcagataattgagctcttggttcacttggttatagatttgaaattggtctgagtgcaaaggctcggacaatgtgcgaaggagaggcggcgaactcacatagtgggttaaagagtgatcgacggttttcaatatatgctcgatgctttgctgggtctgctggagtgtgtcgaatttttcctccgaaacgttggaaatagccgttttctgagagtgctcgtacgaaaataatccgaccaaaataaccggaatggtgctgagcaggcagaaaaacgtgatcagtttgtagtaaaacttgtattggcttcttttcataaaaccccccatttcataacatccacttcaccttaatacaattaatccaaagattgatagatattgtcaataatcattttctaatatcggtgtctttttttcaggtggaccggctgaacccttgattataaagggataaaacaggatgtgatcatatgattgtagacggacttttgcctgctgcgctacagtgaatgcaagaatccgtgaaaggaggctaggaaaaaatgaaaacagcagaagcgcaagcgccggctgttgatgcagtcatttttaaaaaagaaaaagaaagcgcttactaatcaagctgattcaacaaaaatatttgtacttgatgattttgccggggtgtatttattttttgctttttaagtatgtcccgatgtggggaattgtgattgcgtttcaggattatcagccgttcctcggcattttgggcagtgagtgggtggggctgaagcattttatcaggctgtttactgagcctacattttttctcttgttaaaaaacacgctcgtgttatttgctttgaacctggccatatttttcccggtgccgatactgctggcgcttctattgaacgaagtgcggattgctctctttaaaaaatttgttcagacgctgatttatatcccgcattttatgtcttgggtcattgttgtatcgctttcgtttgtgcttttaacggtagacggaggcttgattaatgaactgattgtgttttttggcggtgaaaaaatcaattttctgctgaacgaagaatggttccggcccctgtatattctgcaggttatctggagggaagcgggctggtcgacgatcatttatctggcggccattacagcggttgacccccagctgtatgaagcggcgaaaatggacggagcgggacggctgcggcaaatgtggcatattacgctgcccgccattaaaagcgttatcgtcgttttgctgattttgaaaatcggagacacgctggagcttggcttcgagcatgtgtatttgctgttaaatgcgactaacagggaagtggcggaaatttttgatacgtatgtttatactgcagggctgaaacagggccaattcagctacagtacagcagtcggcgtatttaaagcggcggtcgggctgattttggtcatgctagcgaatcgtttggcgaagaaatttggcgaggaaggaatttattaggaaagggatgggatcaatggatcaatcaatcgctgtaaaatcgcctcttacgtacgcggaggcattggcaaacaccattatgaacacgtacacagtcgaggagctgccacctgcaaaccgctggcactaccatcagggtgttttcttatgcggtgtattgcggctgtgggaagcaaccggggaaaagcggtattttgagtatgcgaaggcttatgcagatctcttaatcgatgataatggcaatctattatttagaagagatgaactggacgccattcaagcaggtctcattctttttccattatacgagcagacgaaggatgaacggtatgtcaaagcggcaaaaaggctgcgcagcttatatggaacactgaaccggacgtctgagggcggtttttggcacaaagacggttatccttaccaaatgtggcttgacggcttatacatgggggggccgtttgcactgaaatatgccaatctgaagcaggagacggagctgtttgatcaggttgtgcttcaggagtcattgatgagaaagcatacgaaggatgcaaaaaccggacttttttatcacgcctgggatgaagcgaaaaaaatgccttgggccaatgaagagacaggctgttcaccggaattttgggcacgttccatcggctggtacgtcatgtctcttgctgacatgattgaagagctgccgaagaagcatccgaaccgtcatgtgtggaaaaacacgctgcaggacatgattaaaagcatctgtcgctatcaagacaaagagacggggttatggtaccagatcgttgataagggagacaggtctgataactggctggaaagctcaggatcctgtctgtacatgtacgcaatcgcaaaaggaatcaataaaggctatctagacagagcttacgaaacaacactgctaaaagcgtatcaaggcttgattcagcataaaaccgaaacatcagaagacggagcgtttctcgtcaaagacatatgtgtcggaacgtcagccggtttctatgactattatgtcagccgcgaaagaagcacaaacgatctgcacggagccggcgcgtttattttagctatgacagagctggagcctctttttaggtcagcggggaaatgacaaaaaggatacgtacggctttgtgtgtgatcgtctcagtgctctttttggcatcatgctcaagcaggccggacggaatgcatgtcattctcttttctgatatgcaggctggcgtacaggaaaaaataaaaaaggccgccgagcagaatgccgggaaggtcgatatctttccagcttttcaggaaaaactgctgactgaaattaccgcccatgagggagatgttttcatcgtgcctgaagacatgtttcaagcttacgatgatccggaaaattttcagccgttaaacggattgcctcctgaaaaaacatctccttatacaactgttaataaaaaacaggagaaaaaacgatctatgccgttcagatcgaaaaagggaaaaaacagctgaacggctattcttttcaattgaatcgcgatatggcggcgtttatccctgtgtatgctgaaaaaacagaggaagcgctgcagctgatttctcaactaactgaagcccgatagaggtgaggatattgaagaacatcgtcttttgcggattgagcagcagagcattcagtatgtttatcaaaccactgatggagcggttttcaactcattatgagattacgggattgctggatgccgatccgaaacgttttgccgtttgcaagaagaaatttcccgagctggcccacgtgcctgagtttagcgaagatgcttttgacgagatgatgcgcgtctcaaagcctgatatcgtcattgtggcaggcagggacgatacgcatgtcgcatatattgtaaaaagccttcagtggaatacagatgtgattactgaaaaaccaatggtgacaacagtgcaggatgcgaatcgggtgcttgaagcggaggccaaaagcgaagggaaagtcaccgtcgcgtttaactatcgctacagcccgtttcatcggaaaataaaagaaatgattctggacggaaaaataggcagggtcacttctgttgatttaaattggtatattgatacgtatcatggcgccagctattttaaacgctggaacaggtcgagacagttttccggcggtctttctgtccataaatcaacacatcacttcgatctcgtcaattggtggctcgggcaaaatccggaagaggtatttgcttatggcgccttgaattactatgggccggacagtgagtggaaccccttgccggaagaagacgggcgtttttgcgggacgtgccgtgttaaagaaaaatgccactactattcaaggtggcatccccgttcctctaaagcttctataaaggatgatcatcttgaagcaggagaccagtccagcttatatactgcatacaggcctgacgcgtgtatttttgacgaggaaattgacatcgaggatacgtacgtggcggcagtcaaatatgatggcggcgcactgttaagctactcgattattttttcggccccgtatgaaggctaccggctgacgatcaacggcacaaaaggacgtattgaatcaaatgaatttcacgaaccttccagaattccgtttgcttttcctgagcagacaatcgaatactatccgctttttgaatcaaagcagacgatacaagtggtcaaaaatgaaggggggcatggcggaggtgatccgcttttgcttgaggatctttttttagggaaagacccgctgcgccgctatgatattttagccggggctgaagctggagcctactccatcgcggttggtgagggaatgtggcgctcggttgccgaaaagaagccgatcggcatgaaagagctttttcagatgcagaatgtataatgcaaaaaaggagggggcgccatggaacatgatggctcactgggacggatgctgcgtttttgcgaatggattatgagatttgcgtatacaaacttgctgtggctgttttttacgttgctcggtctcggcgtgtttggcatcatgcccgcgaccgcggctttattcgctgtcatgcggaagtggatccaggggcaggacaacgttccggtgctcaaaacgttttggcaggaatacaagggtgaattttttcgttcaaatctgctcggcgctgtactggcgctcatcggagtgatcatttatattgatttggccttaatttatccaagtcatttccttctgcacatcctgcgcttcgccattatgatatttggctttttgttcgtatccatgcttttttatgtgtttccgctgcttgtccattttgactggaaaaaacgtctgtatgtgaaattttcgctcttgctcagtgtggcgtatttgcaatatacgcttactatgcttgcgctgactgttgctctctttttcttgcttgcgtacctgccgggcattgtcccttttttcagcgtcagccttatcagctactgccatatgcgcattgtttatgccgtgctgctgaaagtggagcagcacggcggcgagccacagaggaaatcccatatacggaaagctttttatccggaaacgagataatcatcatttctctatcataacgctgttccaaacggaatagattgatagagaaaggagagcggataaaatgctgaaggtagcggtatttgatgaagagcatgaaaaagacttacaaacggaaatcaattcatttttaaaagggatatcggaggagcagctgatagatatcaaatatacggtttcggcggcgtgcgacccagacggcgagcagctttactgtttttccgcccttattttatatcgcaaataaaaagatctttccgcaggcgcggaaagatcttttttgttaatatgcttttttcactcttggacttcttggtttatcgagtttctccgcttttttgatctctcttctttcttttgagagcgattgatagagagaggcaatcatcagcaggataacgatagaaaacggcagcgctgccagaatcgctgtgttctgcaaagcggcaagccctccggaatataggagcacagccgccatggcggactgaatgataccccagctgagtttcacagaattcgccggatttaaagaaccgtacgacgtctgcatgcccagcacgaatgtagctgaatcagctgacgtgataaagaatactgcgatcagaatcaatgcaaggatcgatgtcaccattgtcagcggatagtgatcaagtgttccgaacagcatcgtttcagtggacagctttgctacattgaacgcgcctttttgctggagatccatggctgatacgccgaaaatggagaaccatagaaatgtcaaaatacaaggtgtcaccaagacgccgattaaaaattcgcggatcgtccggcctctggatacacgggcgatgaaaatgccgacaaatggagaccaggaaatccaccatgcccaatagaaaatcgtccagctgttaatccattcgcgtttttcaggatcgttcggtgtcagtctgaagctcatttgaacgatattttgaatgtattgtccgatagaatctgtaaatgagttcattatcagcactgtaggcccgacaacgagcataaacaacattaacaatccggccaataccatgtttgtgttgcttaaatacttaattccttttccgagtccgctccacgcagaaagtaaaaagagcactgtcacaataatgattaaaaccaattggacgataaacgcattcggaatgccgaacaggtaattcaaaccgccgttaatttgggttgcgccaagaccaagacttgttgacaccccgacaacagtggcgaaaactgcaatacagtcaatggcctttccgatcggtccgtttactttatccccgagaatcggtgacagtgtgctgctgattaacccgggtgcgcctttgcggaattggaaataggcaatgcataatgccacaatggcataaatggcccaagcgtgcaaaccccagtggaaaaacgtatagcggagtgcatctctgaaggcttggggggtttctgtttcacctgatggagagctaattgcgtaatggctgatcggttcagccgcaccgtagaatactaagccgattcccatgcctgcgctgaacagcatggcaaaccatgataataacccgaattccggtttttcatcaggctttccgagtttgatttttccgatcgggctgaaaatcaaaaagagacaaaacccgacaaacaaagagacaactaaaagataataccaaccaaatgaatcggtaataaatgcttgtgccgattgagacacattttgcaggctgtcaggagaaataacaccccataatacagctgcagctgtgattgcaatcacaatccaaaatacactagatatatgtttcaacatttctcaccctctaattttttgtgtacgcctatatcttgctcgcaggcttagtatggtcgtacgatggcagctcattcctctcttaaaattaccccgcaatcaggtgaaacaaaacaagtctcaccctaacatgaatgcggggaatgttcaaatgtgagtttggcggcaagagatttaaagagtaatgattaagaacgggcgtattgcccggcatttagccctgcaagcctgcctgtgacaagggcggaggtaatattgtatccgcctgtgtagccgtggatatccagaatttcaccgcaaaaataaagcccctccatttttttagaagccatctttttcgggtcaatttcttttacagataccccgcctcccgtgacaaatgccttatcaagcgacagtgtgccatttgcgaggacagtaaactgcttgcagtcccttacaaattgtctgaaaggatccttcggcagctcagaaaacgatacgttcggagagatgccgtttttttcgagcaggaataggagatagcgctcctgcatccaaggcttcagcacgtttttaatggtttttttcggtgcttccttcagttctttatacatcttttggaaaagcgtttcttcattgatatccggatacaagtcgattctgatcggcacttgaggctgttttttcagctcttttacgacaaattggctgcatctgagaatggcaggtcctgagaggccgaaatgggtaaacagcatgtccattttatgtgtgataatcggtttgccttttttatttaacacactgacggctacatctcttagtgataagccctgaagtgttttttgcttaatgaacggttcgccagaagtgacgggaacctctgtcggaaacagctctgttatggtatggcccgcggcttcagcccattcatagccgtctcccgtgcttccggtatgaggcacgcttttaccgccgacagcaataatgactgcctggctatggatcatttcgccattattcgtcacaatccctgctgcctgtccatcttcatataaaacagatttaattttctcgttcgttctgattgttacgcggagctgctttagcctgtttaacagcgcgtcaacgacactttgggctttgtcggtcacaggaaacatccggccgtgatcctcttccttcaattgaatgccgaggttttcaaaaaacttgataatgtcctcattattaaattcagaaaacgcgctgtataaaaaacgcccgttgccggggatgtgcttgataatttcttccacaggaaggcggttcgtcacattgcagcggccgcccccggaaatcgcgagtttccgtcctaatttatttcctttatctatcagcaacacgccagcgccctgttctcctgctgcaatcgcagccatcaagcctgaagggcctccgccgattacgattacgtcatattgtttcatctttatcatcaactttcttttcatttcgtgtgcggacacccgtccgcagtactattatagcgaaagaaagccgctccttaaacgtcttttgccgcggacatgaatgttcacaggattgcttttgtatttattaccgtctaaatgcccagttgtggtaaaatagaaaagttgaatcttcgtagaaaatggtgatgaagaaacatgtcaagcaaactgttaagaggcacgtttgtattaacgctcggtacatatatatcgcggattctggggatggtctatttaattcccttcagcattatggtcggggcgacaggcggtgcattatttcaatacggatacaaccaatacactttatttttgaatattgctacgatgggctttccggccgctgtttctaaatttgtttccaaatataattcaaaaggggattatgagacaagcaggaaaatgctcaaggcgggcatgtcggttatgctagtcacaggaatgatagcctttttcattctgtatctatcggctccgatgtttgcggaaatatcgctgggaggcaaggataataacggcctgacaattgatcatgtcgtttatgtcatccgcatggtcagcttagcgcttttggtcgtaccgattatgagccttgtccgcggattctttcaagggcaccaaatgatgggtccgacagctgtttcccaagtcgttgaacagattgtccgcatcatctttctattgagtgcgacattcttgattttgaaggttttcaacggcggccttgtcatcgctgtgggctatgcaaccttcgcagcgctgatcggtgccttcggagggctggtcgtgctttatatttattggaacaaacggaagggcagcctgctggcgatgatgccgaatacgggtccgacagcaaacctaagctacaagaaaatgtttttcgagctgttcagctatgctgctccgtacgtttttgtcggactagccatccctttgtataactatattgatacaaatacgtttaacaaagcgatgattgaagccggtcatcaagccatcagccaggacatgcttgcgattctaaccctgtatgttcagaagctcgtgatgatcccggtttccctagcaactgcttttggactgacattaattccaacgattactgaatcgtttacaagcggaaactataagctgttaaatcagcagattaatcaaacgatgcagacgatcctgtttttaattattccggctgttgtcgggatctctctattgtcaggaccgacgtatacgttcttttacgggtcagagagccttcatcctgaactgggggcaaacattttgctttggtattcgcctgtcgcaattctgttctctttgtttacagtcaacgcagctattctgcagggcatcaataagcaaaaatttgcggttgtcagccttgtgatcggtgtcgtgatcaagcttgtgctgaatgttccgctgatcaagctgatgcaggctgacggagcgattttagcgacggcgcttggatatatcgcttcccttttatatgggtttatcatgattaagcgccatgcaggctattcgtataagatacttgttaaacgaactgttttgatgctggtcttatcagccattatgggtattgccgtgaaaatcgtgcagtgggtattaggcttctttatttcctatcaggatggccagatgcaagctgcgattgttgtggtgatcgcggccgctgttggcggagctgtctacctgtattgcggctaccgattaggatttttgcagaaaattttaggccgccgtttgccaggtttctttaggaaaggcagacatgcaggctgatgaactagatatgatgaaactgagggctcgcatgctgcgggctttcttttataaaggagagattgggaatgagacttgataagctgcttgccaacagcgggtatggttccagaaaagaagtcaaagccgttgtgaaggctggagccgtgatgatcgacggcaaacctgccaaagatgtaaaggagcacgttgatcctgatacgcaggaggtgaccgtatacggggaaccggttgattatcgagagttcatttatcttatgatgaataaaccgcagggcgtgctgtcggcgactgaggacagccggcagcaaacagtggtcgatctgctgacgccggaggagatgagatttgagccatttccagccggcaggcttgataaagatacagagggctttttgctgctcacaaatgacggccagctcgcacatcggctcctttctcctaaaaagcatgttccaaaaacgtatgaagtccatttaaaatcacagatttctcgggaagacatttccgatttggaaacgggtgtctacatagagggcggctataaaacaaagccggcaaaagcggaaatcaaaacaaacgacagtggcaataccgttatatatctgacaattacagaaggaaaataccatcaggtcaagcaaatggcaaaggcagtcggcaatgaagtggtttatctgaagcggctttcgatgggacgcgtttccctagatcccgctctggcacccggagaataccgtgagctgacagaggaagagcttcatttgctaaatgagccgcaagcatgacaaaaaccccgcataccgaatgcggggttttatttataagcacacaaaaacaaggctcagtagtttcttcgccctgttatctatcggaccgctctcaggcggccctatgtaattttcaatttatgaggtaatctttactttctttctcgttgtctcccacttgccacggcttggactatgaacaagatcattatatgccaacacatttaagtctctttgaatcgttctaggtgtaatgccgaattcgtcaaccagttcctgtgttgtcacaagacctttttcttgaataaacatgtaaactgatttgattcgagttagcatacggtttgttgaaggtttcaaaaaaccactccctatcataagatcggatggacttgactaaccacaactcacgactatcaactgcgtacgaaatagcaacaaaggcagacatctgtaattgttaaaataattcgccctcattatacacgatattgcagtgatgaatctagggataactcctattaattttttccaatttcgcgttgggcagccatccttgttggattactatgtatttcggctcaatattattatggttaaagaaacttttttattctatttcgtagtaaattttggaggtgagtgagttttgacaaatttgcttgaagcttcaatagaacaggccgggtatacaagccgaaaaaaagtgctcaccgatgtttttctggaagtcagaaaaggggaactggttggactgatcggagctaacggcgcaggaaaaagcaccgcaatcaaggcgatactcggcctttcagaagattttaaagggcatattgcctggaacgactgttcatttgcatatattccggagcatccgtccttctacgaagaactgacgctgtgggagcatttggatctgatcagcacacttcacggcattgaagagagtgaatttgcgcatcgggcccaaagcctgctgcagacgttttcgctagatcatgtcaaacatgagctgcctgtcaccttttcgaagggcatgcagcaaaaactaatgcttatccaggcctttctctctaagccggatatgtatgtgattgatgaaccgtttatcggccttgatccgatatcgacgaaacgctttgtggacatgcttaaggctgaaaaagaacgtggagccggaattcttatgtgcacgcatgtactcgataccgcggaaaaaatctgtgaccggttttatatgattgagaaaggttcattatttctccaaggcacgttaaaagatgttcaggacaagaccggattagaggggcagtcattgcttgactgtttttataaggcagttcaaggtgatcggctatgaacgggcgtacgctcttttttcgaaggctgtttgactattataagtatcagtttaaagtgttgcatgcggtcattgactggacagtcgctctctatatcgttttgccggcgattgcttttgtcatctatcagtatattgatttgatgaacggaagaggccttctttatgagtggtctgaagtggcggaatggagatggctgtatgctgtgtgtgtgctgatcatgtttacaggttcgattcgtacatttttaatggaagcggacaaagtgtttttgctgcaaaagaaggaaatcatctatcagctcaaacggtatgcgcttttgtattcttttctggccacgctggctaaatggctgcttctctttttcattgtccttcccttgatcagtcattctgttctcatcacattcgcagaaagcactgctctattgtgttatttgtttggccttcatatattctttttatccttaaagcaagacaggatcagaaagccgcgctccatttcgagatggattggcgatacccttgtcagagctattctttttgctggttctgctatcctgattgtttttactgagcggcacttgcttgcgctttttggcattttatttttgtttttctcagttatccgcagtttgaaaaagacagcctcgttcacggcttttgaagctgaggtgactgaagagaaaaaaagcaggcttgcccttgcaggacttgtgatgatgatgagtcaggaggcgggaatgccaaaagtaaaagacaggatgagaagaaaaccattattataccgaaattcaaaaaggatatttaaaagacgaacgatctgcacaggctataaggagttgttttttaaagttatgctgaggaatggcgagtatgcaaggcagatgtacatgctactgtcagctttcactgttctcatatttgtttccccaatttggctgaaggtgattgcgctgctggtatacacaggggtttgccgttatatcctgacgcttatttttgacaaggtcatggatgccccttttttaattggcaccgataaggaaagtgatgaatattatcgggccagaaaaagctgtatcaacatcctgcactatgcgtttgccgcctgttgttttttagcggccgctgtctctttattgtttacataaaaacccaaacggcgacgtttgggtttttggtctatccttataaaataaacagctggatgaaaaacagaatggcgaaaacgatgacgagcggatgaatctctctccattttccccgcgccgcttttacaattgggtacgaaataaagccaagcgcgattcctgtagaaatgctcgaggtcaaaggcatggctagaatgacgagaaacgcaggaaatgcctcgtccatctctttccagttcatattggaaactgagcccatcatcaggctgccgacgataatcaaagcaggcgaggtgatggcggctatacctgacaaggcgctgacaagcggactgaaaaacattgaagccgcaaacatcaccgcgacagtcaaagccgtaagccccgttcttcccccggctgcgacaccggcggaagactcgataaatgcagtcgtcggacttgtgccgaaaacagctcctactgtcgtcgcggttgaatcagcaagcagcgcttttcgcacgttcggcagcttgttgtttttcatcagcccggcttgctcggcaactccgatcatcgtgcctgtcgtatcaaaaatggtgactaatagaaaagaaaagacgacagcgtacaggccgtgatgaatgacatcgccaaaagcggtaaatggatttgagatcatcaatccttccggcaaatgaggaagcgacataaatccctttgaaaaatggagctgaccggtgaaaaaggcgatcaaagcggtagctgccattccgataaataaagcgccgcttacattcagcaccatcaggaccacgctgatcaaaaggccgaccagcgttaagataacaccaggtgaatgcagattgccgagagtgaccaggtttgactcatcagctgccacaattcccgcttgacgcaaaccgataaaagcaataaacagcccgatccctgttgtgatcccgtattttaaattgtttggaatcgcttctataagttgttttcttaaaggcgttaacgatagaataatgaagagaacccctgctgtaaatactgcgctgaaagctgttgcgtacgtgatgccgccatcgcttgcgcttacgacatgaaaggctaaataagcgttcaagcccatgccgggcgcaatagcaatcggataatttgctgccagggccatccacagcgttccgacaatggaggcaataatcgttgcggtgaaaacctggtcgaaaggaaccccggcgttagccagaatgaccggattgaccacgacgatatagaccattgtgaaaaaggtcgtcagccctgctatgatttcttgctttatggatgtttgctgctcttttagatgaaacatagtatcctccaattacgaacgttttaacaaaacaccattaatattattcgttttatttggtttttgcaagtcatttcttgcggaaaggggatcattatgaactgggaagttgaagtgatcagaaaaaaagaggatttaattcgtgatacacaggaatttttgagaatcaacagtgtcatggacgaaacaaccgccggacccggtaaaccgtttggagaaggggtaaatgccagcctgacttcattgctggagcttggagaaaaagaaggctttacaacaaaaaatcttgacggcttcgcaggtcatattgaatggggggagggcgatgacattatcggcgtactttgccatgttgacgtcgtgccgccgggagatgggtggacgagtgatccattttcagctgaaatccgcaacggacggatttatgcaaggggcgccattgatgacaaaggcccgacaatggcggcattctacgcgctgaaaatcgtgaaagacatgaatttgcccctgtccaagcgagtcagaatgattatcggaacagatgaagaaagtgattggagatgcgtagagcattatttcaagcatgaagaaatgccaacaatgggctttgcgcctgacgccgattttccgatcattaatgcggaaaaagggatcatcgatgcttctttacttattccgcaccgcccaaatcaagctgaaccaaaggcagtgcttgtctcgtttcaatcaggccttcgcttaaacatggtgcccgacgctgcggaagctgtcattgaagggccgaaaaatgaagagattctgtcttcatttaaagacatgctccgcacgacggaccaaaaaggggaagctgcaatagagaacggacagctcattttgcgtatgtacggtctttcctgccatgcgatggaaccgaacaatgggatcaatgccggcattttattgtgcgaatttctccagcagactgagcttgacgatgcaggaaagcggtttgtgcaagttgtgacagataagttctcaggtgatacaagaggaaaaaaactggacatcgactgtgaggatgaaatcagcggagagctgacattaaatgtcggaacactgcgctataaagaagggcaaggaggcgagctcgggatcaatatccgctatcctgtgacagcagaaagcaaagtgatccgcgatacattcgaaagcgcatctgaatttgagctgggagaattcaaagacagcaagccgcatcacgtgtccgcagatcatccgttagtcaaaaccctgcaaaaggtttatgaaggccagctgggtaaaaaagctgatttaatctcaatcggcggggggacttatgcgagatccttaaaagccggtgtcgcgttcggcccgctgttccccggacgccctgacagcgcacaccaaaaggatgaatatatcgaaattgatgacctgctgagatcgacagcgttatatgctcaggccatttacgagcttgcaaaataaaaggaccggcttctgctgaagccagtcctttttttaaataaatgaccataaatcagttgataagtaccgttctcctgtatcagctgtcatgcagaccacaactttgtcaggagagaggcgtttcgctgtttcgattgccgcgaagcaggcagcgcctgatgaaggaccgacaagaattccttcttcagcagcaagccgtcttgtcgtcgtatacgcgtcttcatcagagattttgataatttcatcataaacgtcttcatttaaaatcggcggtataaagcctgggctcgttcctacaagtttatgcgcgccaggttttccgccggataatacaggcgaacccgctggctcaacaacatgaaccgtgatatccggaaaaagctctttgagcgcctcacctgttccggtaatggttccgcccgttccagaggaggctacaaaagcgccgagcggttttccgatttcctctattgcccgggcgatttcaggcgctgttgtttttcggtgcgcatcaggattagcagtgttatcgaactgcattggaatatagctgttcggaatttgttcggcaagctccttcgcttttttgatgctgcccggcattctttcctctccgggagttaatacaacctctgcaccgtaagctttaagtaggttgatccgttccttcgtcatcgtatcaggcataactaagattgctttatatccgcgtgctgccgcattcatggcgagcccgatgccggtatttccgcttgtcggctctataataactgatcccggcttgagtaaaccgttttgttcagcttctatgatcatttgataagcggctctgtctttcacactgccgctcggattgaaaaattcaagctttaaatagacttgtgccgcattttccggctgaagccgattcaatctcactagcggtgtatctcctatcagatcagctgtgtttgcaacgattttcaacattgtcattcctttctgaataaaacaagtgtcatataatatcctaacataataaacgtttgtgcgagagtgttttcatacactgttcctctatccgcacagcctctttattgataaaataatagctgtcaaagaagggagtgtcagacggatgccagatatacggcctcattatttcatcggcgttcccatacctgagggaattgcaaatccgatctaccaggctgcgaaaaacgaaccgatattgacgtttcaaaaatgggtgcacccgcttgactatcatatcacgttaatttttctcggagcggcggatgagacacaaataaagaagcttgaaggttcgctagcagagattgcttcagaaattgatccattttcaattaagtttggcaagatagatgtattcggcgaccgcagaaagccgcgcgttttacatctggagccaaagaaaacaaaacgcttgatagactgcgggaacatacgaagcaggctgtacttcaggccggctttcaagtggaaaaaagaccgtatcatcctcatatgacgctggcaagaaaatggacaggcgaagatggatttccagctcatgttccgtttgaaagcggcgaggtttcgatgatggctgaacgattttcgctctttcaaatacacttgaaccaatcaccaaaatacgaggaaatattcaaatttcaattatcttaattcattgcggagtggagaaacaaacatggcacaaatcatcaaaattcatgattatatatcgagatatgagcttgatccgtaccattatatcaaccagtttgtacgtttgaaaaaagagcgctggctttcactagtagaagcagcggagcgccagcatgaagaaaggcaagccagtgctgaagaaccggaaccggtgcagaaacgaaaaaaattttcattgaaaagaagaaaagaagagataaaagccgatatacaagaagagagacaccaatggtttgaggacgaagaagatattcatgtaaggctcccgaagagcagggtggcgcttgcttctttttataaaaggcatttatatgattttcagctcaaatgggcaagctctactctttcagaaatatctcaactctcaaaccaagtgaagcaggaccgcattttgcgttatctgacccagcagctgcctgattcttattttattatgtataagcctgtgctgaaaattcagcaggcggcggttgaattaagcattgtgattatttctcctctggaaatttattgcgtttcttttttagaggctgaggaagacagtgtctacatagggtctaaaaatcgtttttgggacaagaaaacagcctctcagactgcatcagtgttaaatccagggcttagcctgtttcgtacggactcggttgtgtcaaagatcgtaaaggaaaaacaggctgagattccggttcgaaaattgcttctgagcagaacgtcgtacatcgattacccggagccgccatacggcttagaaatagcggataagcggagcgcggaagaatggattgagcggcagaagaaaaacactgctccgatcaaacatcatcaggtaaaggctgcaaaggctctattgtcttactgcatgtctgactcctatcgcagacaggagtggctggagtaaaagagaacgatttgagcggttttctcataacataagcaggtgagaaagatgagccattggttttttattattaatccgacagcaggacatcgaaacggcctgcgtgtttggaagtccattcaaaaagaattgatcaaacgaaaggttgagcaccgttcatttttaactgaacatccgggacacgccgaggtgctcgccagacagatttcaacgatacaggaatataagctgaagcgcctgatcgtcattggcggagacggaaccatgcatgaagttgtcaacgggctgaaagatgttgacgatattgagctgagctttgtgccggcgggcgcgtataatgatttttcgcgagggttctctattaaaaaaatcgatctgatacaggaaatcaagaaggtaaagcgcccgttaacaagaacctttcatttagggagcgtcaatttccttcaggataaatcacagattctttattttatgaatcatatcgggatcgggtttgacgcatatgtcaataaaaaggcgatggaatttccgttgagacgggtttttctttttctccgccttcgatttcttgtgtatccgctttctcatttgcacgcttcggcaacctttaagccgtttacattagcttgtacgacggaagacgagacgcgcgaatttcatgatgtctggtttgccgttgtatccaaccatccgttttacgggggaggcatgaaggcggcgcccctagcaaatccgcgcgagaagacatttgatatcgtaatcgttgaaaaccagccgtttttgaaaaaatattggcttttatgtctcatggcatttggaaaacatacaaagatggatggcgttacgatgtttaaagcgaaggacattacattttacacgaaggacaaaatcccgttccatgctgacggagaaatcatgggcactaccccgtttcgtctggcatctagtccttcacccctaagaatcaaaacataaacgtgtttggaggagagagcttccgatggtcagcatccgccgcagcttcgaagcgtatgtcgatgacatgaatatcattactgttctgattcctgctgaacaaaaggaaatcatgacaccgccgtttcggcttgagacagaaataacagattttcctctggctgtcagggaggaatactcccttgaagcaaaatacaagtacgtctgcgtatccgaccatcctgtgacatttggaaaaatccattgcgtcagagcatccagcggccacaaaacggatctccaaattggcgcggtcatccggacggcagcgtttgatgacgaattttattatgacggagagctgggcgccgtttataccgcggatcataccgtatttaaagtatgggcgcctgctgcaacctcagctgctgtcaagctttcacaccccaataaaagcgggcgcacattccaaatgactcgcttggaaaaaggcgtctatgccgttacggtcacaggtgaccttcacggatatgagtatttgttttgcatctgcaacaattcagaatggatggaaacagttgaccagtatgccaaggctgtgactgtaaatggagagaagggcgtcgtcttgcgcccggatcaaatgaaatggactgctcctcttaaaccattctcacaccctgtggatgccgtcatctatgagacgcatcttcgcgacttctccatccatgaaaacagcggcatgataaacaagggaaaatacttagcgctgacggaaactgatacacaaaccgcaaatggcagttcttcgggattagcgtatgtaaaagagcttggtgtgacacatgtggagcttctgccggtgaatgattttgccggagttgatgaagagaagccgcttgatgcatacaattggggatataacccgcttcatttctttgccccggagggaagctatgcctcaaatcctcatgatcctcaaacgagaaaaacagagctgaaacaaatgatcaataccctgcatcagcacggtctgcgagtcattctggatgttgtttttaaccatgtgtataagagggagaattccccctttgaaaagacagtgcccggttattttttccggcacgacgaatgtgggatgccatcaaacggcaccggcgttggcaatgatattgcatcagaaagaaggatggcaagaaaattcattgcggattgcgtggtctattggcttgaagaatacaatgttgacggcttccgctttgatctcctcgggattttagatattgacaccgtgctttatatgaaagagaaagcaactaaggcaaagcccggaatcctgctttttggagaagggtgggacctggctacaccgctgccgcatgaacagaaagctgctttggcgaacgcgccaagaatgccgggcatcggcttttttaatgatatgtttcgtgacgctgtaaaagggaacacctttcaccttaaggcaacagggtttgcgctcggcaacggtgaatcagcacaagctgtgatgcatggaattgccgggtcttccggatggaaggcattagcaccgattgttccggaaccaagccagtccatcaattatgtcgaatcacacgacaatcacaccttttgggataaaatgagctttgcgcttcctcaagaaaatgacagccgaaagcgaagcaggcaaaggcttgcagccgcgattattttgcttgcccaaggggtgccgtttattcacagcggccaggaatttttccggacgaagcagggagtggaaaacagctatcaatccagtgacagcatcaaccagctcgactgggatcgccgtgaaacattcaaagaagatgttcactatatccgcaggctgatctcgctgagaaaagcgcatcctgcattccgtcttaggtccgctgcagacatccagcgccatcttgaatgcttgacgctaaaagaacaccttatcgcatacaggctttatgatcttgacgaggttgacgaatggaaagatatcattgttatccatcacgcgagtccagactccgtcgagtggaggctgccaaacgacataccttatcggcttttatgtgatccatcaggatttcaggaagacccaacagaaatcaagaaaacggttgcagtaaacggcatcggaacggttatcttatatttagcatcagatcttaagagttttgcttgacgaagtttgtgctatagcgctaaaatttaaaggacggctattgattagcatatgagactctcaatagctgtcttttttatttttatacgattcgtacgaaaaaggcattcgctggatagactagaaacgattagccttaattctaaaatattttaagaaatgatgggttgaacattgatatgaactggttgggacaattactaggtagcgattgggagatcttccccgccggaggagctacaggagatgcatattatgcgaaacataacgggcagcagctttttttaaaacgtaatagctcaccttttttagctgttttatccgccgaaggcattgttccgaagctggtttggacaaaacggatggaaaatggggacgtcattacggcccagcactggatgaccggcagagagctgaagcctaaagacatgagcggacggcccgttgctgaattgcttcgtaaaatacacacatcaaaagccttgctggacatgctgaagagacttggaaaagaaccgctgaacccgggggctcttttgtctcagctgaagcaggctgtatttgctgtgcagcaatcttcgccgctgattcaagaagggatcaagtatttggaagaacacctgcatgaagtgcatttcggtgagaaagtcgtttgccattgtgatgtcaatcataataactggctattgtctgaagacaaccagctgtatttaattgactgggacggcgccatgatcgctgatccggcgatggacctcgggcctttgctgtaccactacgtcgaaaagccagcttgggagagctggctgagcatgtacggcatagagctgacagaaagccttcggttgcgaatggcttggtatgtgttatctgaaacaattactttcattgcctggcataaagcaaaaggcaatgataaggaatttcatgatgcaatggaagagctgcatatcctcatgaaacgaattgttgattaatcaggaatacgaatccatttgctctacccattgagacaggctgttctgatgctcttgtatgtgtgagtcgatggatttggacgatattcctgattggctgtagcggtaaacatcttcaagcacgtttttgaaatttgaatcaagctcggtgtttgccatcagtgatttaatcacacgctcaagctgctcgtactctgcgactgttccgcagcagtccaattgatggtcagtcaatatatccttcaataaatgaacttgatgctcataatgtaaacccataacggtacacatcccttcagtatcatacgggttaaattgttcaaaacagagcgtttttatacatgggaaaggagtgttccagcagacgggaccctctttttttatgcgctcggccttaagagagatacactggaaaaacgagcttgcgggtctttttaattcatggtatgttgttagtcgaaataatagatagaggtgtcaatcatatgagaatgcgccacaagccttgggctgatgactttttggctgaaaacgcagatattgccatcagcaatcctgctgattataaagggaaatggaacacagtgtttggcaacgacaatccgatccatatcgaggttggtacaggaaaaggccaatttatttctggtatggccaaacaaaatcccgacatcaattatattggtattgagttatttaaaagcgtcatcgtgacagccgtccaaaaagtaaaagacagcgaagcgcagaatgtaaagcttctgaatatagatgcggacacgctgacggatgtgtttgagccgggggaagtgaaacgggtctacttgaacttttctgatccttggccgaagaaacggcatgaaaaacgccgcctgacatattcccacttcctcaaaaaatatgaagaagtaatgggcaaaggcggatcgattcattttaaaacggacaaccgaggtttatttgagtactctttgaagagcttctctgagtacggcctcctgctgacatacgtcagtctcgatttgcataacagcaatctggaaggcaatattatgacagaatatgaagaaaaattctctgcactcggccagccgatctatcgggctgaggttgaatggagaacgtaaagacagactctgacaggagtctgttttttttatgggccgtttgctaccatgatgataggggggggtgaaaatggaaacaatgaaaattggaaacatcacgttgacctggcttgacggaggcgtgacgcatatggacggaggcgccatgttcggcgttgtgccaaagccgctttggtctaaaaaatatccagtcaatgaaaaaaaccagattgaactaagaacagaccctattttgattcaaaaggatgggctcaatatcatcattgacgccggaattgggtacggcaagctgactgataaacaaaaacgaaactatggcgtgacacaagagtcgaatgtgaaaccctcattagctgcactcggattaacggttgccgatatagatgtgatcgcaatgacacaccttcattttgatcatgcatgcggtttaacggaatatgaaggtgaacggctcgtctctgtctttccgaatgcagtgatttatacatcagctgttgaatgggacgaaatgcgccatccgaatatcaggtcgaaaaatacgtattggaaagaaaattgggaggctgtagctggccaagtcaaaacctttgaagacaccttaacgatcacagagggtattacaatgcatcacaccggaggccatagcgacggacacagtgtcctgatatgcgaggatgcgggtgaaactgccgtacatatggcagatctgatgccgacacatgcccaccgcaatccgctatgggtgctggcttacgatgattatccgatgacctctatcccgcaaaagcagaaatggcaggcgttcgcagcagaaaaagatgcttggtttattttttaccatgatgccgagtatcgcgcccttcaatgggaggaggacggaagcatcaaaaagtcagttaagcgaatgaagcgatagcatatttttatgtttaccctgcatgttttccggctaataatgcaaacctagtactattatgctcagaaaggaagaggcagggtgaaacaattcagagtaacaaacgaaggagacattcaaacaacattaagaggccttgaagtgctctctgttccttttttgaacaaaggtgttgcttttactgaggaagaaagaaaagaacttggtttaaaaggctttctgccgcccaaggtattaacaattgatgatcaggcgaaaagagcgtatgaacaatattccgcacagcctgacgatttgagcaaaaatgtctatttaacggcgctgcacgatcggaatgaaacgctgttttaccgcctgttaaatgaccatttaggggaaatgctcccgattgtctacacaccgacagtcggaacggcaattcagagatacagccatgaatacagaaaaccacgagggctctatctgtcaatcgatgacccggacggtatgaaagaagcttttaaacagtataaagatcaaagcgatacgatcgatttaattgttgcaactgatgcggaaggaattttaggaatcggtgactggggcgtcggaggaatcgcaatttctattggcaagctggcggtttatacagcggctgcgggcattgatccgagcagagtgctggctgttgttttagatgcggggacaaatcaggagagcctcttgaacgacccgctttatgtcggcaaccagcattccagagtgcgcggggaacgttatgaccaatttattgacgactacgttgcgctggcgagagaaacatttccgaatgcattgctgcattgggaggatttcggggcgaaaaacgcgcgaagcattttgaaacgctataaagataaagtgtgtaccttcaatgatgatatccaaggaactggcgctgtttctttggccgcagtcttatcctgtgcaaaagcgtctaaagttccgctgagagatcacagagttgttatattcggagcgggaacggcaggaatcggaattgccgaacagctgcgggaagcattggtgcgcgagggactgagtgaagaagaatcatacaagcgcttctggtgcatagacaggaacgggctgttaacagatgatatggatcagcttcttgatttccaaaagccgtatgcccgttcggctgatgaagtgaaggattatcagcggaacggagacggcggaggcattgatcttcttgaagtggttcggcaggcgaaaccgacgatcctgatcggcacatctacggtttccggcgctttcactgaagaaattgtaaaagaaatggcgtcacatgtgaaacggccggcgattttgccaatgtcaaatccgacaactctttctgaagcaaagccggaggatttaatcgaatggacagaaggccgtgcgctgatcacgacaggaagcccgttcccgccagttgaatataacggagttacgtatcatatcgggcaggcaaacaacgcgcttgtcttccctggtctcggtcttggaacgattgttacaaaatcaaaattaattaccgacggcatgtttgaagcatgtgcccgggcaatcgcaggtatggtcaatgtcggggtgcctggggcgccgatgcttccaaaagttgaagatttgcgcactgtttcggcaaccgttgctgttgaagttgcaaaaaccgcaatgaaggaaggcgtcgctacggaagagcctgaagacattatacaggcagtgcaggatgcgatgtggtatccggtatacaaaccgattcgcgcgatataataaaaaagagccgctgcataggcagcggcttctattttttgcttgtccggtgttaagaggcgattgtatcaatgacatcaacaatttctcccgttttcgcatccaccatgacttcatactgttctaattctccgaaagctgatcgtgtaatgccggttttgtatacctgtaccgtttctccgttaatattgtagggctccggctgggtgtaaatccatgatccgtcaatcgggccccgctgcttaaaagcagattttacaattcgaagcgctttttctgaagaaatataaggcttcatcacatattgtctcacaacgacagccgtacaaattccaagtcctgctcctaaaagaagatgacgcaatttcaaaataaagcacctcctggttgatcgtacttttcattatacagaaacagccaaatcctgttaagcaatacgcggctgatcgagcagattgggtcagagtgcttggaaaacttcattgtttctaataaaataaaaggactacatagaaatgaggggaaaacatgaatcaagaaacgaaagcgcttttccaaacactgacgcagcttcccggcgcgccgggcaatgagcatcaggttcgtgcttttatgaagcaggagctagccaaatatgcagatgacatcgttcaggacagactgggaagtgttttcggagtcagacgaggcgcagaggacgcaccgagaattatggtagccgggcacatggacgaagtcggcttcatggtgacatccattacagacaacgggctgctcagattccagacgctcggaggctggtggagccaagttttgcttgcgcagcgggttgaaattcaaacagataacgggccggttccgggtgtgatttcaagcataccgccgcatttattgacagatgcgcagcgaaaccgaccgatggatatcaaaaacatgatgatcgacattggagcggatgataaggaagacgccatcaaaatcggcattagaccgggacagcagatcgtgcctgtttgtccgtttacgacgatggcgaatgaaaagaaaattttatcaaaagcatgggataacagatatggatgcggcttaagcattgaacttctgaaggaattacacggtaaagagcttccgaatacactctatgcgggtgcaacggttcaggaagaagtagggctaaggggcgcgcagacggcttctcatatgattaaaccggacttgtttttcgcccttgacgccagcccggcaaacgatatgagcggagacaaaaatgaattcggccagcttggaaaaggctttttgctgcgcattcttgacagaacgacagtcatgcatcgcggaatgagggaattcgttcttgatatggctgaaacgcatgatattccatatcaatattttgtatccggcgggggaacagacgcaggcaaggttcatatttcgaacagcggtgtgccgtcagcggttatcggaatatgttcccgctatattcatacaaacgctactatcattcatattgatgattatgctgctgctaaagaaatgctcatcaaacttgtaacagcctgcgataagcagacagtggatgcgattaaagaaaatatgtaggtttcataaaagcttgttgaacgagcagtaagcccggatcgacaagcttttttcttattctgtttcaaatagataggaaagggccttaatggcttggttaacggtttcaaccgtaatattcgctttattggaaagctcttttaaaggatggtggagcgattccggccggatgataatcaggggttttccttttgcgatcgcatatgatgcatccattgccgtgttccactgtttgtacttttcgccaaacagggcgatcacaaagtctgctttattcatcaggacggcggttctgaagttgttgatgtcagaggctttgtcatcctttaaaacggcatttggctgtacgcccataatttcttcaccaatattgtctgagcggtcatgattctccatcgggccaacaaacgtaatcgggagcttcagtgattttgttttttctttaatttcctcgcgccaattgctgtggatttctcctgctaaatagacgataaactccataataaaaatccctccttatgtatatccatctgtaaatttcaccctcatgtacacgatgttaaacgaaacgagcttgataatgcaaataaaatatgataatgataatgggaaagccaatcttacatattcattcgttgcatataagtggttttgcctcaagcagtttggtatgatccaaatggacgagtatcgataaaaaacatgtaagaacataaacaactggagggatatgaaatgaaaaaaattgaatcaactcaagagctggaaaaagcggtaaaggatgattggtctgtatttatgttttcggccgattggtgcccggattgccgttttgtagagcctttcctgcctgaactggaagcgaatttccctgaattcacctactactacgtagaccgtgacaaattcattgatacatgtgcagagtgggaaatttacggaatcccaagctttgtggtgtttaatgaaggaaaagaagtaaatcgttttgtgagcaaagaccgcaaaacaaaagaagaaattgaacagtttttaacagactctctcgctaaagcgtaaaggaggacatcggtttgaaaatgacctcaaggaagctgtcagatatactgaagcagcgccttcagcacgagaatcgctcctttctgtttgacagagaaaaagacaccctccgtgttgaggatcaaacgactaaaaaagggattacactcgatttgccgccgattattgcaaaatgggaactgaaaaaagacgaagccattgatgagatcgtgtactatgtctccgaagcgatgacggcaatggaagggaaggctcaggaaatgaccgggaaagaaactcgcatttatccggtcatccgctcgacttccttcccggacaagtccagcgaagatatcccgctcatttatgacgatcataccgcagagacaagaatttattacgcgctagatctcgggaaaacctaccgtttaattgaccagcgcatgcttgagaaagaaaactggacaaaagagcggatcagagagacggccgcatttaatctccgttccctgccgacggttgtcaaagaggatacggttgccggcaattacttttatttcttcagggcaaacgacggatacgacgcaagccggattttgaacgaagcgatcttaaatgagtataagcagcatgcagaaggtgagctggcgatctctgttcctcatcaggacgttttgattcttgctgacatccggaatgaatcggggtatgatattctaggacaaatgtcgatgagcttctttgcaggcggcaccgtcccgattaccgccctatcatttttgtacaatgaaggaaagctggaaccggtgtttatcctggcgaaaagccgtccgaaaaaggattagaaaggatttttacttatgaacgctttttataataaagaaggtgtgggagacacgctcctgatctctcttcaagatgtgacacgcgaacaattaggctatgaaaaacacggcgacgtcgtcaaaattttcaataacgaaacaaaagaaacaacgggcttcaacattttcaatgcgtcttcttacttgaccattgatgaaaacggccctgttgcgctctcagaaacattcgtgcaagatgtgaatgagattttaaacagaaacggcgttgaagaaacattagtcgttgatttatctccgaagtttgttgtgggttatgtagaatcaaaagaaaaacatccgaatgcggataaattaagcgtatgtaaagtcaacgtaggagaagaaacgcttcagatcgtctgcggcgcgcctaacgttgaccaaggccaaaaagttgtcgttgccaaagtcggtgctgtgatgcctagcggacttgtcattaaggatgcagagcttcgtggcgttccgtcaagcgggatgatctgctcagcgaaagagcttgatttgccggatgcccctgctgaaaaaggaatccttgtgttagaaggagactatgaggcgggagacgcatttcagttttagactcccataaatccgccaaaaaaaacgaatcatgtgaaaagccgctaagcccttgtttagcggctttgtttctgctgatagcttaatcttttctgggccgaccagcagtggtatactaaaaaccgtcccagaaaactataagggagttagagataaattatgagttggcttcataaattttttgatttgtttttaggcgaaagcgaagaggatgctgaacgggagacaaaacccgctcaaattccgcagcaacaagaagtacatcatcctgaaggacaattaaaaagattggaagatcctaaaatatattatgaatatccaaaaggcaaattccgttttccagtcgtgcctgacggatacaaaaatcatgacctgagaaggcgccgcacaccatcggacgaaccgaaatccgcgcctcgtccaagtgctgcaccttacagagagcgtcccagaaatgaagaagagcagcatacatatcaagcagcagagccggcgaagaaaccgtttaaaccgacaaatatcccttcgcctgtctatggattcaatcaaaaaccatctgttaaaaaggatgtgccgaaaaagccttctgaaacattgaacgaaccggataaatcggtaaaagagaaggtaacactgctgtcagaagagatcgaacgtgaacgcggctatcctgcttcagacacacaggcgcattccaaaatagaaagtcctttcttcccggatacccaatttgaaaaacagccttctggcgttttaaacagaaaggatacggagcatgatgaggcgctggcgaaacggccagccgagccgtcaggtaacaaagtgccatttgagtcaggcgttcaacagccggaaaaagaggagcctttcttcccagctgaacaagccgaagagcaaacaccgcctgagatgctcacagatacggcggctgaagggctttcagacagtgaagtaggccgcgaagagcctgcaacggctgaggaagaacaaagggagcagcagccagagaaatttgaagagcctgttttctccgctgaacttgatgaagagcaaacagctcctgaatctcagacagaggcagtatctgaggatgaaaaagcaaaagagccgtcagacagcccagtatacaatcatcatgaaaacgcggcagaaggtgctgagtccccgttcgttcaagaagaacaaatggacattcgtcaggaagagcctttatttactgatcatgagtattcatcagaggctctggctcaagcagaaactgtggcaaaagaatcagaagagccatcagaaagcataataaataatcattatgacaccctgggagaggctcaggaaacgaagatagatgttcagccagacagccatacagagcttgagaaaactgaacacatggagcagggttccaaatcgtctactgcaactcttgaaaaccggcaggaaattcgcgcagacaaacctcgcgaagcttcagaagagccgaaaaaaaggcctggtgtacaggagaaaaggactgaacaaagcgcatcttctcaaaaagggccatccgttccttttaatgtgatgatgctgaaaagagatacgcataaacagcaaaaagcagaggagcgccgcggcagctatgtatttccgaatgttgcactgcttgatgtcccgccagcgcaggttcaagatgatactgcgtggatcgaagaacagcgtcagcttcttgatttgaccttgaaaaatttcaatgtccgcgccaatgtggtccatgtaacccagggtccgtctgtcacgagatttgaagtgcatcctgaaccgggtgtaaaggtgaataaaatcaccaacttgtccgatgatattaaactcagtctctcagctaaagatattcggattgaagcgccgattccggggaaaaacacgatcggaattgaagtgccgaaccgcacgagcaaggtggttgatttgcgccaaatgattcgcagctcagctttcaggacaagcaagtcaccgctcacagctgcgctgggattagatatttcgggaaatcctgttgttatcgacttgaagaaaatgccgcatggcttgattgccggcgctacaggctccggaaaaagcgtatgcatcaatacaatattagtaagcctgctttataaagctgacccgagtgaggtaaaggtgctgctgattgatccgaaaatggtagagctggccccttacaataaaattcctcacctcgtcagcccggtcattactgatgctaaagcggctacggctgctttgaaatgggtcgttgaggaaatggagcgccgctatgagctttttgcccattcaggtgtccgcgacattgaccgctttaatcaattaaccgctgaacaccaaatgggtgaaaagctgccgtatttagttgtcattattgatgagcttgcagatttgatgatggtggctccaaacgatgtggaagaaagcattgcgcggatcgcccaaaaagccagagcgtgcggtatccatcttctcgtcgcaactcagcgtccgtcagtcgatgtcattacaggtctgattaaggcgaatatcccaacgagaatcgccttttctgtctcaagccaggttgattcccgaacaattattgatatagccggtgcagaaaagcttctcggaaaaggggatatgctctttttggaaaacggctcgggaaaaccggttcgtctgcaaggtaactttgtgtcagaccgggaaatcgaccgcgtcgtttcccacgtcagaagccaaatgccgccgacctatttatttgaacaagaagagctcgtaagacaaggatctgccctgaaagaagaggacgaactgttttacgaagcgtgtgagtttgttgtagagcaaaacagtgcgagcacttcaagcctgcaaagaagattcagaatcggttacaatcgtgcggcaaggctgatcgacatgatggaagcggaaggcatgatctctgaggcaaaaggaagcaagcctcgagaggtgctgatcacagcaagtgatttaataaacgaataatatgggttcattttcacaccaaacatggtatgatagtgtttagagcatttaacagctatgccgctttacagcagctgtgcatagacaaatcttgatatctgggtttaatcggaaagaaataacctgatactaaacataacaaaacatataaaatacgccgctaagggaggcttttcagccgccgcggtcgcaaattgaaatgagcgtcatatactggggaacagatagacgtttgttggaggtacaattatgactgtttatcattttgttggaataaaagggaccggtatgagtccgcttgcccaaatacttcatgataatggatatactgtccaaggatcggatatcgaaaaatttatttttacgcaaacagcgcttgaaaaaagaaatattacgattcttccttttagcgcggaaaatattaaacccggcatgacagtcatcgccggaaacgcattcccagacacgcatcctgaaatagaaaaagcgatgtctgagggaattccggtgatacgttatcataagtttttaggcgactacatgaaaaaattcacgagtgttgccgttacgggcgcacacggcaaaacgtcgactacgggtctgctggctcacgtgatccaaaacgcaaaaccgacgtctttcttaatcggagacggaacaggccagggaaatgaaaacagcgaatactttgtgtttgaagcgtgcgaataccgccgccatttcttaagctatcagccagattatgcgattatgacgaatattgattttgatcaccctgattacttctcaagcattgacgatgtatttgacgctttccaagagatggctcttcaagtcaacaaaggcattattgcctgcggagacgatgagcatctgccgaaaatccatgcgaacgtcccggttgtgtattatggcacgggggaagaaaatgattttcaagccagaaacatcgtaaaaagcacggaagggacaacttttgatgtctttgtccgcaatacgttctatgatacgttttatattcctgcgtacggccaccacaatgtattaaactcattggcggtcattgcgttatgccattatgaagaaattgattccagcatcattaagcatgctctcaaatcctttgggggcgtcaaacgcagattcaatgagaagcagcttggggatcaagtgctgattgatgactatgcccatcatccgacagaaataaaagtgacaatcgaggcggcaagacagaagtatcctgatcgggaaattgtcgcggtattccagcctcatacatttacccggacgcagcagttccttgacgaatttgcagaaagcctgagcggcgccgactgtgtgtatttatgcgatattttcggctcagcccgtgagaatgccggaaagctgacgatcggtgatctccagggaaaaattcataatgccaagctgattgaagaagatgacacatctgttttaaaagctcatgataaagccgttctcatcttcatgggagcaggagatatccaaaaatatatgagagcctacgaaaacgtcatggcataataaaaagcagtgatctcactgctttttatttatctgatgggaaagcttattaaaggattttcttacataacggagaatagtatgtatacagcccagtacacatgtttatgattgaagaaaacgggtaaacagcagtatatcctgcagcaaggaggtttgagatgattattattctttatttgagcgttgcactcatcgcagttgcatttctcgtattagtgatctacttgtctaaaacattgaagtcactgcagctgacactaaaaaacgtcgcatccactcttgaagggctggagggacaaatgaagggcatcacaactgaaacagccgagcttttacataagaccaaccgcctggctgaagatattcaggaaaaatcagaaaagctgaacacggtcgttcatgctgttcaaggagtgggagcttctgtacagcagttcaatacatccatgaaacaagcggcagggtctgtatcggcatcagttagagagaatcaagataagatcaatcaagttgtcacttggagtcaagcagcaatggaaatttgggagaaatggaagcaaaagaaaaaatcagccctgtaagagaaaaaaatactaagaggaggaataatgatgagcaaagatggaattaatagtaaagattttttaatcggaactttaatcgggggaatcatcggtgccactacagctctttttctagcgcctaaatcaggcaaagaacttcgcgacgatctcggcagccaggctgttgccttacgggacaaaactgataaaatgacggcagatgcgaaggaaaaaggcacgcaatatgtcagcatcgcaaaagacaaaacttccaacatcacacagcttgtagcggatcagtctggacagatcatgaacaaggtaaaggatttgagagaccgttccaaatctgacaaaacggattcatcgactgcaatgcaagatatgagggaagaagcgatgcaggcagctgatgaaacaaaagatcaagtcctccagacgaaagaagatgtaaaagacgaactgaaagatgcacaaaaacaggctgagcagttgaatcgctgagcagggaaggaagagcttgagtcatggctaaacagcttattcaatctgaggaagaatttaaacggattgcagaacaggaaggcgttttcgtcttcttgaaacacagcaccacatgcccgatcagccaggcagcatttcatgagtttgatgcctttgcaaatcagcatgaggatgtgccggcttactatcttcaagtacaagaagcccggccgctgtccaatttcattgcagaaacatatggggtcaagcatgaaagccctcagatattcatcatccagaacggtgaagtgaaatggcatacctcacattcacaaattacagaagccgctattgagcagcatttgtcatagaaaaaagcgtccagatatcatctggcgcttttttttgtaaaaaacccttgaacattgccctcacatcatgtaggatagcttcatagattactttatcacttaaaagcgtttgggtaataaagtagagtttttataaaatttttagtatttcagtatttccatttggaattacttatagtaagatgcatgataactacaaaataaaaaatgaatgtgcagggaaaggatgaaaaaaatgagcaacacagagttagagcttttaaggcagaaagcagacgaattaaacctacaaattttaaaattaatcaacgaacgcggcaatgttgtaaaagagatcggtaaagcgaaggaagcacagggtgtcaaccgatttgaccctgtcagagaacgcacaatgttaaacaatatcattgaaaacaatgacgggccgttcgaaaattcaaccatccagcacatttttaaagagatattcaaagccggtttagagcttcaggaagaagatcacagcaaagcgctgcttgtctcccgcaagaaaaaacctgaagatacaattgttgatatcaaaggcgaaaaaatcggagacggccagcaaagattcattgtcggcccatgtgcggtagagagctatgagcaggtagctgaagtcgctgcagctgcgaaaaaacaagggattaaaattttgcgcggtggagcctttaagcctcgtacgagcccatacgatttccaagggcttggtgttgaaggccttcaaattttaaaacgtgtagcggatgaatttgatctggcggttatcagtgaaatcgtaactccggctcatatcgaagaagcgctggactacattgatgtcattcaaatcggagcgcgcaacatgcaaaacttcgaattgctgaaagcggccggcgccgtgaaaaagccagtgcttctgaagcgcggtcttgctgcaacgatctctgaattcatcaatgctgctgaatacatcatgtcacaaggaaatgaccaaattatcctttgtgagcgcggaatcagaacatatgaaacagcaacgagaaacacgctggatatttcagctgtgccgattttgaaacaagaaacgcatttgccagtctttgttgatgttacgcattcaacaggccgccgtgacctcttgcttccgacagctaaagccgctttagcgatcggtgctgatggcgtaatggctgaggttcaccctgatccgtcagtcgcactttctgactctgctcagcaaatggcgattcctgaattcgaaaaatggctgaatgaactgaagccaatggtgaaagtcaacgcttaattgaacaatccaaaaggccgcgcctgcggccttttttatgctttctcgtttatttagttataaaaaccaagtatacgttttcatcatctataaaaacgtgtataatttcatgagaagtaattaaatttgatgaataatgaaaaataatgtacactactgacttacgcttacaaatcataaacgacataaattcggacattatgacatttctctacataaagtgtttatgctatagataaggataagtgtatccagtaaaaggagtggttttaggatgagcaatattacgatctacgatgtagcgagagaagctaatgtaagcatggcaaccgtttcccgtgtcgtgaacggcaacccgaatgtaaaaccgacaacgaggaaaaaagtcttggaagccattgaacgtctcggttaccgtccaaacgcggtggcaagagggctggcaagtaaaaaaacaacaactgtaggtgtcatcattcccgatatctcaagcattttctattcagagcttgcgcgcggaattgaagatatcgcgacaatgtataaatacaatattattttgagcaactctgaccaaaacatggagaaagagctgcacttgttaaacacaatgctcggcaaacaagtggacggcatcgtgtttatgggcggaaacattacggacgagcatgtggcggaatttaagcgttctccagtgccgattgtacttgccgcttctgtagaagagcaggaggaaacaccgtcagtcgctatcgattacgaacaggcgatttatgatgccgtgaagcttttggttgataaaggacatacagacatcgcgttcgtttccggaccaatggcagaaccgatcaaccgttcgaaaaaactccaaggctacaaacgtgcgcttgaagaagcgaaccttccgtttaatgaacaatttgtagctgaaggggattacacatatgattccggactcgaagcactgcagcatctgatgagcctggataaaaaaccgacagccattctttctgcaactgatgaaatggcactcggcattatccatgccgctcaggatcagggcttatccattccggaggatctcgacattatcggttttgataatacaagattaagcctcatggttcgtcctcagctttcaacagttgttcagccgacatatgatatcggcgccgttgcgatgagactgctgacgaagctcatgaataaagagccggttgaagagcatatcgtcgaactgccgcaccgtatagagcttagaaagtcaaccaagtcataagaaaaacaaagagcaagcttcacctttatggtgaattcttgcttttttcatggggagaaatgatgaaacgttttgattatcttacacctgttggatttgtgttaggaacgattattattgttatcgggattatttcaggatcgggagtaagcggtttccgctcttttcttgatctgacctctttcttcatcgtaacagggggactttgcgccgctgtttttatcagttttccgccaagtgagctgaaaaaagcgccctctgtgttaaagcaggcattcatccgccaggaagacaatgtgaaagatcttgtgaaaacctttgtttccctttccgatcacgcgcgaaaacacgggcttttatcattggatgatcaggctcgggaaatcaaagatccattcttgaaaaaagggctgcttttagcgattgacggctgggatgaagaaacgattcggctcgtcatggattcagaaatcgcagcaatggaggaacggcaccgaaaagggcggcgagtttttgaaaaagcgggagaattcgctccggcatggggaatgatcggaacactcgtcgggcttgtgctgatgctcaaaaacttaaacgacccgcatatgctcggaccaaacatggccattgcgcttctgacgactttatatggttcattactggcaaatatggtcttcaacccgatcgcggctaagcttgaagagaaaacagaaagtgaaattttcatcaagcaggtaatggtggaagggattatcggtgttcaatccggaaaaaacccgcgcaaccttgaaagccagctggtcgttttcagctcacgggaagaatggcagaagcagccaaaacaagtaaaaacaaaaaagggatctgtacatgaagcttagaagagaacgttttgaaagaaggaatggaagcggaaaaaacagtcaatcttcatccagctggatggtaacctttacagatctgatcaccttgatccttgtgttctttattttactcttttcgatgtcccaaatcgatctgcaaaaattcaaagcggcagtggactcgatccagaaggaaggcaacgggcttcagccggaccaaacatccatagaaaaaaagaatacatccccatctgatacgaagaagcaagaggatcagcaggatcagcttctcaagaaagtaaatacatatataaaagacaatcatttgaaggcccaaatgacagccaaacgggatgaacgcggtgtcgtgctcgttcttcaggaggctgtgctgtttgatacaggtgaggcaaaggtgctgaaaaatgccgaaacacttcttcaccaaattgccgttcttcttcaaacaattccaaatgacattcaggttgagggacatacagacagccgaaacatttcgacataccgatacccgtcgaactgggagctatcagcagcacgggcaagcggagtgattcaatacttcacgtctaaagagaagcttccctccaagcgctttattgctgtcggttatgcggatacaaagccagtaaaggataacaagacaaatgaacacatgaaggaaaatcggcgtgtggaaatagtgattaaaaaatcaaaaacgacctcttcgtaaaggtcgttttttactttgttctttgctgttcagaacgtatcgcatataatgctttgctgacagtttgggcatttttttctgtaatttcaggcttgcggggaatcggaggatataaatcagccggatcgctccagctcgacggaagggccacggggcattgtttttgccatttaacaatccattccggcgggatctcgtgacccgggtcaattcccttcatttcaagccatattctggcccaggcgcggggcacgacacgccaaatatcatatccgccgcctccgactgcaatccatttccctccgcaatattgatgagccaaagtgtgtgcaagacgggggatttcttcgtatatattgattgttgctgataaatgcgtcagcgggtcgtagtaatgggcatcggcgccgttttggctgataatgacatcgggctcgaaatacgcggcgacttctgaagctgctgtccggtaagcctcaagaaaagaatcatcctctgtaaaagcgtcaagcggaatattaaaggaatagccatatccttttccgcttcctttttcttggatctgaccggttccagggaataaataccttcctgtttcatgaatggacagcgtgcatacgtcaggattatcgtaaaatgtaaattgcacaccgtccccgtggtgggcgtccgtatcaatataaagcactctggcgctatattttttctggatatattgaatagccacagcgctgtcgttgtatatgcagaatcctgatgctctcccgcgaaagccgtgatgaagccctccgccaaggtttgccgcatgcagggcttgtcctgacatgacccagtctgcggccgttaaagtgccgccgaccaagagtgatgccgcttcgtgcatgccggcaaagacgggtgtgtcttcagtgccgagcccgtagctttctccttcttcagcggggagctttccggcgcccgcaagctttacggcctgaatgtaatcgtccgtgtggacaagggaaagctcctcttctgaagcgagtctgggggtgacaatgtctccatcatcaaaggcattgatcgtcttaagcaaatcatatgttaacagaacccgctgctgattaaagggatgctcctgatgaaacatataggtttggtaggatggagaatagataaatacactgtctctcatagcagatccctttgctctgacggccatacgacgtggtgtccatttctttgtaatgcctgcaaaaacggcagcggattcatcgtttttacacggaagacaagcacttttacaccgggatcgtcatgcggataaacaagcacgcttaatattttcacttgaaggtcttggcaaagactgctgatctcagcgaggcttttggtgatgtcgtttacttttatctcaatttgcgagcccggctggtcagcgcctgtcaatttgacaaacgtccgcagcaaatcggtttttgttaaaatgcctattaatttttgatggtgtaccactggtaggcagccgatgccatgctcgtagaacacggctgatatttcttcgacaaaatctaacgggtgggcgcagacaacatcctttttcataattgaatctacgcttcgtgtgagaaataggcttcgtttgttttcttcaaaaatactcgggctggcctgtttcatgtccctgtctgtaatcatgccgatcacgtgtcgttcttcatctacaacaggcagatgcctgatatggaattccttcagtttgcatattgctgtttcaagcgtatccgtcttcgttaatgtaatgacatctcttttcatgatttgctcaacaatcattattttttcccctttgtcagtgtcagttaatacatataacgatgataaaaacggagcctgtcaaattgctcaattgattcttggctgacgttttttccaatgcgggccatcagacagtttgcagggtgggagctgatctccggctcatccgttgcaaaccagaccaatccgcctgcattcatcatcttttccatgatctttctgtattcccacacatcttttttcatcccttttaaatcccaatgccagtaatattctgtcgtcatcacaatgtagttttccatttgttcatccatcatgctgacggtcaggagcgtctttccgacagcgcatccccgatagtccggcgctacttcgatggctccgagctcaatcaaatcctccatatttccttcagaccatctttcgagcgggtcaggatataaatacgtgacatagccgacaatggttcggccgtctctggcaataataatgcgcccttcgggaaggcctgcaatgtcgactagcgcttcatgctgctcgcgaggcgggcgaaatgcggttaaatctttatgaaactcataacctgccaaatcctctggagagacaggcccttctatcagtaaagagccggttgctgttttgatgtttgctgaatggtatgttttatgatgttccactaattcaccgtcccatcaattcttatcaaaaatacatgccttctttaagaataccaaattataaagcgttttcaacatggtttatattttaaaaattgagaagaatatgaatatatactataataattgtgacaacttcagcaaagggggatgtttgggcatgaacttgaaagcgttaccagcaatagagggggatcataacttaaaaaactatgaagaaacgtaccggcattttgattgggccgaggcagagaaacatttctcttggcatgagacagggaaactgaatgcggcgtatgaagcgattgaccgccatgccgaatcgtttcgaaaaaacaaagtagcgctttattataaagacgcaaaaagggatgaaaaatacacatttaaagaaatgaaggaagaatcaaacagagccgggaatgtgctgagacggtatggaaatgtggaaaaaggggaccgcgtttttattttatgccgagatcacccgagctttattttattatgcttggcgcaatcaaaattggcgccatcgccgggccgctgttcgaagcatttatggagggagcggtgaaagaccggcttgaaaacagtgaggcaaaggttgttgtcacaacgcctgagctgctggagagaataccggtagacaaactgcctcacttgcagcatgtcttcgtagtcgggggagaggctgagagcggcacgaatatcatcaattatgatgaagcagcgaaacaggaaagcacaagattggatatcgaatggatggataaaaaagacggctttctgcttcactatacatcaggttccactggtacgccaaagggcgtgttgcatgtccatgaagcgatgattcagcaatatcaaacaggaaagtgggtccttgatttaaaggaagaagacatttattggtgcacggctgatccaggctgggtgacaggtacggtatacggcatttttgcaccgtggctgaacggagcgacaaatgtcatcgtcggcggacgtttcagcccggaaagctggtatggaacgattgaacagcttggcgtcaatgtctggtacagcgcgccgacagcttttcggatgctgatgggagcgggagatgaaatggctgcgaaatatgatctaacttcactccggcatgtgctcagtgtcggtgagccgctaaatccggaagtcatcagatggggacataaagtttttaacaaacgaatccatgatacctggtggatgaccgaaacgggcagtcagctcatctgcaactatccttgcatggatattaaaccgggttcaatgggtaagccgattccaggagtggaggcagcgatcgttgacaatcaaggcaacgagctaccgccgtaccgaatgggcaatctcgccatcaaaaagggctggccttccatgatgcataccatttggaataaccctgaaaagtatgaatcgtatttcatgccgggcggctggtatgtgtctggggattctgcttacatggatgaagagggatacttttggttccaaggcagagttgatgacgtcatcatgacctccggtgagcgcgtcggcccatttgaagtggaaagcaagcttgtcgaacatccggctattgcagaagcaggcgttatcggaaagcctgacccggtgcgtggagaaatcattaaagcctttattgcactcagggaaggatttgagccgtctgataaactgaaagaagagatccgcctatttgtaaagcagggtcttgcagcccatgcggctccgcgtgagatcgaatttaaagataagcttccgaaaaccagaagcggaaagatcatgaggcgcgtgctgaaggcatgggagcttaatctgccggctggagatctgtcaacaatggaggattaaaaggcggcgttgacacaggattttatttatgttaaaaatgatatagcttcatatgaaaaggtaaagattgagacaagtagaatatccttacgttccagagagctgatggccggtgaaaatcagcacagacggatatatcgaatacactcatgaaccgcttttgcaaacaaagccggccaggctttcagtagtgaaagaacggacctgatccgttatcaggcaaagtgataagacgaatgtttgcattctcttattagtagggtggtaccgcgataatcaatcgtcccttcgtgtaaacgaaggggcgttttttattttaattaaaaaaggagctttatcttatgactaacttacttgaagacttatccttccgcggattgattcagcaaatgacagatgaagaagggttaaataaacagctgaatgaagaaaaaatccgcttgtactcaggctttgaccctacagcagacagcttgcatatcggacacctgctgcctattttaacacttcgccgttttcagcttgcagggcatcatccgattgcgcttgtgggcggcgcgacgggcctcatcggtgatccaagcggaaaaaaagcagagcgtacattaaacactgctgacatcgtatccgaatggtcccaaaaaatcaaaaaccagctgtccagatttctagattttgaagcagcagaaaacccagctgtcatcgcgaacaactttgactggatcggcaaaatgaatgtgatcgatttccttcgtgacgttggtaaaaatttcggcatcaattacatgctggcaaaagatacggtcagctcaagaattgaatccggcatctcgtacacggaattcagctacatgattcttcaatcttatgatttcttaaatctttacagagacaaaaactgtaaactgcaaatcggcggaagcgatcagtggggcaacatcacagcgggtcttgaactgatcagaaaatcagaagaagaaggagcaaaagcgtttggcctaacgattccgcttgtcacaaaagcagacggcacgaagttcggaaaaacggaaggcggcgcgatctggcttgataaagaaaaaacatcgccatatgaattctatcaattctggatcaacacagacgaccgtgacgttgtcaaatacttgaaatacttcacgttcctttcaaaagaggaaattgaagcatacgctgaaaaaacagaaacggcgccagaaaaacgtgaagcgcaaaaacgcctggcagaagaagtgacatcacttgttcacggacgcgaggcgctggagcaagccatcaacatctcccaagcgctgttcagcggcaatattaaagagctttctgctcaagacgtaaaagtaggctttaaagatgttccttctatggaagttgacagcacccaagagctttcacttgtagatgtgttggtgcaatctaaattatctccttctaaacgccaagcgcgtgaagacatccaaaacggagctgtttacattaacggtgaacgccagacggaaataaattataccctatcaggtgaagaccgcatcgaaaaccaatttactgttctgcgccgcgggaagaaaaaatacttccttgtgacgtataaataagaaaaagatcctttgccactgaaggcaaaggatctttttgtttaccgcataggaatgaaaggaaaagagtatattagatagggcaaacacgaccaatcaccaccttttaaatgaaaggagcgctaaagcgtgaatctcatgtgtacgattgcaaaagaacggctgcagcgggatcattgggagcagcaggcgcaagatagtgttggccagcaagaggcgaaagccgataaaaaaaccccgaccgcatagcggcaggggtttttaaaacgattaacgagagtagaactcaacgataagcgcttcgttaatttccggagcaagttcagaacgctcaggaagacgagtgaaagtaccttcaagcttttcagcgtcgaaagtaaggtattcaggaacgaagttgttcacttcaacagattctttgatgatagaaaggtttcttgatttttcgcgaacaccgattgtttgaccaggtttcactaggtaagacgggatgtcaacgcggcttccgtctacaagaatgtgaccgtggttaaccaattggcgagcttgacggcgagtacgtgctaaacctagcttgtacacaacgttatcaagacgagaatctaaaagaatcatgaagttttcaccgtgtttaccagctagtttgccagctttgtcaaacaaagtgcggaattgacgttcgtttacaccgtacatgtgacgaagcttttgcttttcttgcaattgcaaaccgtattctgataattttttacgttgtcctgggccgtgtggacctggagcgtaagggcgtttttctaattcttttcctgtaccgctaagagagattcctagacggcgggacagtttccaagatggacctgtatagcgagccataatgtgactcctcctttggttttatttttgtggaaaataaaaaccgtctgctctattcgaccatgcacattttgttttcatgtatcctcgctccagcagcagagagttacacgatacaccttattgataaggaacaaaatgaaaacatagaagctgaacaaaaaggctgcaatatttcacacaaaggtcattatataatttatttgttttgaagtcaaccattcctccattattgcttcaccgtttatgatataataaacaaaaattagtggtaaacttttaggtgataaaaacatggtagaacaaactaaagatcaattatccgcctttcattatcatatgctcgattttttattaaccaaatctgaaaaagtcacattcaccgactctttcatatggctgacttcggctattcaaacctatttttcaaccctttgtgtttcgcttacaccgtcaccatcagactttgtgacaaaactggcagatggtgaagcgcgtttttccgcttcaaaaataaacgcttcatgttatctgattgaggacggctccggcaggcgtttccatcttgcgtgcaggcaggatgaagagattcctgaagggcttccggacgtggttgcttcatttttaaaccagtcgatgaaacaggaaagactctataacaaaacgatctaccaaaaaaagatatacaaaatgacagagctgttccattcactgcttgatcagacagatgtgctgaagcagcttttagaaagcttgacaagcacattttctctttttgagttttctttatttatatcgcacgatcaagaccaatgtttagggattcctgcaaaagagctgtatatggaaggggaaaaatccgattcctttgcgctcaaagtgtatttgtccggagacattttgcggaaaaatgaatctgtcgcctatattccgatcaaaggacagcagggcacatacggggtgttgaaggctgaaggaacgggtgacagctttcttactgatgcctgccttgatgaaatgtcgctgttagcaaacgccgcgggaaaagcgtttgaaaatgcccagctctacgaacaatccaaagcaagcatcgcaaatttggaattgattaatgaaacatcacgacgcctgaatcagcggctgacattgactgatacaatgaatgatctggctgtgagaatggcagaatcgtttcaggcagaagaagtgggattttttcatatagaccattttgaaaacctaacattgctcccaggcagcacagcattttttaaagaagcgaagccgtcagatttttataatgagctgaaagaaaagctgtatgaaggtgaaaaaggggttttcatcgggaatggccagtctgtttttgggaaggcggggtacggctcgctgatggctgctccgatgattcaaaacgaccggcttttaggctttgcggttttattgaaacaggagctgtacgcttttacatttgaaatgtacaagctgtttcaggcgctgattcatcacgcgacactggctgtaaccaattcaatgcttcgcgaccgccttgagcatctcgtgaaaacagatcagctgactgaactgtattcacgagcgtatttagatgaaaaaattcaatacagcatgaaaatccatcaaaagggtgtttttattcttgttgatattgataattttaaaaatgtaaatgatacgtacggccatcagactggggacgagattttaattcaagtcgcttcagtgattaaaagcaacatccgaaagcatgatgtcggtgcccgctggggaggagaggagctggcgatttatttgccaaatgtgccggttgcagtggggaaacggattaccgagcgactggtttacgcggtcagaaaaaatacgaaacccgaggtaaccatttcctgcggtatctcctgctggacgacagaaacaaaaaagtcgctgaaagagcttgtgcatgaggcagatgaagcgctctacagcgcgaaacggagcgggaaaaaccgcttgatgattcatgactcaataaaataaaaaaagcccaaaacgatatcagttttgggcttttatattactgcgctaacgctttttctagcgtttcggcaaattgagttaagtatttttcatcaatttcgtcgaaacggtttttcactgggctgtcgatgtccaagacgccgacaatttttccgtctacacgaatcggaagcacaatttctgattgagacgctgcatcgcaggcgatatgtcccggaaacgcgtttacatcctcaatacgttccacttttccgtttgcgtacgctgtgccgcaaacccctctgccgaaaggaatccgaacacatgccggcaggccttggaacggacctaacacaagctgtccatcctcttctttggcaaaatagaaacccgcccagttgacttcaggcagcgaatgatacagcagtgctgaggcatttgcatagttagctatttggtctgtttcgtcttcggtcatggcttcgagctgttttagcagaagctgatagtctttttctttatctccagattgtttttcgacatggaacatggaaaaccctcactttttctataatataaaacaaagttccggcttttctgccggcatttgtcgataagttcttacaggaacagcggctttctgcttgaatagtatcaagaggaaggagtgagccgtatgaaagtaagcaccaaagacaaaattattgaatctgctgtcatgctttttaaccaaaaaggattttctggcacgtctgtccgtgaaatcgcaaagtcagctgatgtaaatgttgcgcacatctcctactattttaaaggcaaaggaggcttgatggaacacttagtttcagagttttacgaaggctacagcaaaacgcttgaaacagcggcaagcaatatctctactcaaagcacgcaggaacagcttcttcaattggttttcgatattttatcctatcagcataatcatcgtcaattaactcgttttgtctaccgggaagtcacaattgactccacattaatcagggaaattatgtcgacatatctaatgaaggaaaagtatatcttccagctgatcattgaggaaggagaaaaacagcgtgaatatttaacgctgccgctgcctcattttattctccaattaaaatctctcttgatgatgccctatctccagcctcaatatatttcagaagtactctacatgcagccgcacgagccgtatttttataaaatgtattttgaagaaatcaagatttggatcagaagcgtcttccggacaggagacgtggcgctcaccaactagcaccgttccaaaaacgcctcatacgcatatccgacatctcccgcttgatgggcatcagacccaaacacaagcgggatcttcttttgcttcgcttcattcagcatccaatcctcgatataaataccgccagcgtaagtttttcttaagccggaagtattgaagtcgagctccattccgttttcttcaatggcattcaggcacagagaaacgaggccgcgaatatgctctgacatgctgtatggaaacagcttgatgaatttttggacgagtgtgatgtgaccgactctttttggcttataaacgccgagagatgctacaatggaagaatagatactccggtaatattgttcatataccgcttcaatgcttccgcaggctgaaatcagctctttgaaggtatgctcgtcataatcaaggcatagataggaagagtctgtgcgcaaaaaatgaacggataagatgctgtcatctaaatatggcccgtatgtgtctaggaataatgtaatttcgtcttcaaattcagcgatataatcgacttcaagccctgtccgtatgctaagctgtccgcgatattctttttttaatccggaaatttcatgaatatagcgttccaaagaagcttgcgccatcgcgctgtctttcagcggcgtgggatcggtaaaagatggcggcaatggggcgtgttcggtaaaagtaatcgattcgaaccctttttttaaggcttcttctgcatattgtctgagtgtgtcattggagccgtgagggcaaaatggtgtgtgaatatgtccgtctcgcttttgcattgatgtcaccccatgaaaaaatagtcaaatcctgccgattttgcacaaaaagtttttgatttctggtcaaaaaatgtttgttacatggtatcataataacaatgaaaacgacagtttttctcaatacatatcctgaaatctttctgaataaataaaacaccctgacagattaaggtaaacagcaagggggctcattatggagtttgtcattggattattaattgtactgcttgcgctgtttgcggcaggctactttttcaggaaaaaaatctacgccgaaatcgaccggctggaatcgtggaagattgaaattctgaatcggtcgatcgtggaagaaatgtctaaaataaaacatttaaaaatgacgggtcagacagaagagttctttgagaagtggcgtgaagaatgggatgagattgtcacagcccacatgccgaaagttgaagagctcctttatgatgccgaggaaaatgcagacaaataccggtttaaaaaggccaatcaagtgctcgttcatatcgacgacctgctgacagcggctgaatcaagcattgaaaagattcttcgggaaatcagcgatcttgtcacaagtgaggaaaagagccgtgaagagattgaacaggtgagggagcgctattcgaaatctcgaaaaaacctgctggcttacagccacctttacggggagctttatgacagccttgaaaaggatctggacgaaatttggagcggcatcaaacaatttgaagaagaaacagaaggcggaaactatattactgcacgaaaagtactgcttgagcaggaccgcaatcttgaacggcttcagtcatacatagatgatgtgccgaagctgttagctgactgtaaacagacggtgcccggacagattgcaaagctcaaggatggctatggcgaaatgaaagaaaaagggtacaagcttgagcatatccagcttgataaggaattagaaaatctgtcaaaccagctgaaacgagcggaacatgtcctgatgactgaactggatattgatgaagcgtccgcaatcctgcagctcattgacgaaaatattcaatctgtttatcagcagctggagggcgaagttgaagccggtcaatccgtactaagcaaaatgcctgaattgattattgcttacgacaagcttaaagaagagaaagagcatacgaaagcggaaactgagctggtgaaggaaagctacaggctgacagccggtgagctcggcaaacagcaggcttttgaaaagcgccttgatgaaattggaaagctgctatcatccgttaaagataagcttgatgcagagcatgtcgcctactcacttttagtagaagaagttgcttcaatagagaagcaaattgaagaagtgaaaaaagagcatgccgagtatcgtgaaaatctgcaagcgctgagaaaagaagagcttcaggcgagggagacgctcagcaatttgaaaaaaacaatttctgagacagcaagactgctgaagactagcaacattccaggcattccgagccatattcaagagatgctggagaacgcgcatcatcatattcaagaaacggtcaatcaactaaacgaacttccattaaatatggaagaagccggagcccatttgaaacaagcagaagatatcgtcaacagggcaagccgggaatcagaggaacttgtcgagcaggtcatcctcattgaaaaaatcattcagttcggaaaccggttcagaagccagaatcatattttatctgaacagctgaaagaagcggaaagacgtttttatgcttttgattatgacgactcttatgaaattgccgctgccgctgtagaaaaggctgcgccaggtgcagttgaaaaaatcaaagctgacatatccgcttagataatcacgaccatgaaaaagagcccgcagtgtaatgagcaggctctttttttattacaaaacgcctgcgcaataacgcaggcgttctgtgacattaacttatttcattaagctgtttggatggtccgatgaataaggtcagcacatagccgataaccgctccgacgattcctggaagcacccagccgatgccgaggctgtaaagaggaagattcgcatttagaaacacatctaaagatccaagtgaaaaaccggctgctttgataccgtctaaaatactgaaaagtcctgtaccgatcaagcatgcgatgtacacttcgcgtctttctttaaagatcttatcgatgaaggaaagaacgataatgacaatggcaagcggatagatagctgataaaataggaacagaaaacgcgataatttgcgcgagtccgaaattcgcaatgatcaagctgaataacgtgacaatcgtaacgacaattttatatgataatgccggaataagttttgaaaaatattggccgcaagatgtgacaaggccgatgcttgttgttaaacatgcgactgtaatcgctgctccgagtacgatgttgcccaatgaaccgaataaataatgggaagacgcagataaaattttagctccttcaccaacaggaccaatggcatttgtgcttgttgcacctaaataagcaagggatacataaatgaaagtcaggcctaaagcggcaatcacacctgctttaatgcaggctgcagcaagagctttagactgtgtaacgcctttgctttttacagcatttacaacgacaacgccaaatacaattgaagcaagtgcgtccattgttttatagccttctaaaaatcctttaaaaaccggtgttcctttatatgcttctgtcacggcgcccaatccgcccatcggcgtgaagatggctttgagaacaatgattaaaataattgtgaatttgatgggagtcagaatttttccgactcgatccacaaccttagatgggtttaacgctaaatagtacgtaacgccgaaaaagataagtgtaaatattaataaagaaagtctttctggtacaccagtcaaaaacggaacagcgccaatttcatatgaaacagttcctgttctcgggatggcgaataatggtccgattgataaataaagcacgacagtaaagattgtgccgaaaacagggtgcgctttgtcagcaaggcctttagcgtccttaccggttaatgcgatggcgataatgccgagaagcggcaggcctacccctgtcagtaaaaatccgccgatggccttccagacgttgtgtccggctgcttgtccaagttccggcggataaatcatatttcctgctccaaagaataacgcaaatagcatgaaaccaataataatggtatctttgacaggcagtgagtgtttcatgaaaaaaatcctcctaataattatgttaaaatattctgtcaattaattgtcagataatatgacgaaacgaacaaatcttattatatggtaaaaaaattagaagtcaatactagtttttcgtaattttctattaaattttgttatggtaacataaatatcataccttgtaccgctttcataaaggagtaaaaaagatgatatatttagataatagttcaacgacgaagccttacgatgaagtcttgaacgtatatgaacagacgagcagccgatactttggcaatccttcatctttgcaccgatatggagccgaaacggaacagctgcttcaagcagccaaaaatcaaatcaaaaggtccttaggcctaaaaaaatatgatattgtatttacgtcaggcgccacagaagccaataatgcggctttaaaaggagcggctttgtcaaagataaaaacaggcaaacatatcattgccacttctattgaacatccatccgttacggaatcgttagaacagctgaaagagttgttcgggtttgatatcacttatctttctgtgaatgaagacggatttgtttctattgaagatctaaaagcagccatccgtcccgataccgtgcttgtcagcatgatgcatgtgaacaatgaagtcggttccgtgcagccgattgaagcggcaggagaagtgctgaaagagcattcgaacattttgtttcacgtcgattatgtgcagggcatctataaagtgcccttggcaattgaaaaggccggcattgatctatgttcaatttcggggcataaatttcacggcctaaaggggacaggcgcacttattgtaaaagaaggaacacgccttattccgctcataacgggaggctctcagcaaaaaggcatacgggccggaacagaacatactgctggtgcggtttcgcttgccaaggccattaatctggcctctgctgattttgacacacggcttgacacgatgactgccgtaaaggaattgtttatgaataggctgagtgaaattgagggcgtcgttatcaacacgcctcaaatgaatagcgcgccgcacattattaatttctctgtaccggggattaaagcggaagtgcttttacacatgcttgaggaacaggatatattcgtctccacaacatcggcttgctcggcaaaagaacataagcccagcaaggttctcttagagatgggcaaaggagagcagattgccggaagcagcatcagaatcagtttaaattacagccagacaagcgatgtggcagaaccgtttatgaacgcgcttcgtcctggcatcaaaaaattaagggaaatgatgaggtagaacatgaattacgatcatatattaattcgttttggggaaatttcgaccaaaggcaaaaacagaaaaagctttattgagcgcttaaaacaaaacatcagactcgttttgaaagactatccgaatttaaaatacttttccaacagggatcgtatgacgattacattaaatggagaggatcctgaggctctttttcctcatttaaagcaagtgtttgggattcaaagcttcagcctggcaattaagtgtgacagccgccttgatgatattaaggcaaccgcactaaaggctatcaaagatcagtataaaccaggtgatacgtttaaagtcgcgacaaagagagcgtataagcaatttgaattagatacaaaccagatgaacgctgaaatcggcggccatattttgcgaaatacagaaggattgacggtcgatgttcgcaacccagacatcccgctcagaatcgaaatcagggaagaagcaacatttttgacaattcgtgatgaaaaaggtgcaggcgggctgccagttggttcagcaggaaaagcgatgctgatgctttctggcggttttgacagccctgtggccggtttttatgcgatgaaacggggattgtcggtagaagctgttcatttcttcagcccgccatacacaagcgagcgcgcaaagcaaaaggtaatggatctggcgaaatgtctgtcccgttttgggggaagcatgacacttcatattgttccatttacaaaaacgcaagagctcatccaaaaacaaattcctgaaaattacacaatgacggcaacccgccgcctcatgcttcagatagccgacagaatcagagaaaagagaaacgggcttgccattattacgggagaaagcctcggtcaggtagcgagccaaacgcttgaaagcatgtatgcaattaatgcggtgacgtcaacaccgattttgcgtccgctaatcgccatggacaaaacagaaatcatcgaaaaatcacgggaaattggcacatatgagacaagtattcagccgtttgaagactgctgcacgatctttacaccgccaagcccgaaaacacgccctaaaaaagagaaaattgaacactttgaaagctttgttgatttcgagccgtatattcaagaagcggtagataacattgagacaatgaccctttatagcgaacaagaagctaacgataaattcgctgaactcttttaaatcaattttcagctcctgtatacaattaccaaagtttttctgaatgaagccatgtgttttgacacattctatactcacaaggaggtgagacacatggctaacaataactcaggtaacagcaacaaccttttagtaccaggagctgctcaagcgatcgaccaaatgaaattagaaatcgcttctgaattcggtgtaaaccttggagcagacacaacttctcgcgctaacggttctgttggaggagagatcacaaaacgtcttgtatcttttgctcaacaaaacatgggcggaggacaattctaatttacaatttcacataatggcttaggagtgggggtatccccactctttttcattttttacatataaaaaaggaccagcggcctataaaatctatgtttacagaggttgcttttaggcatatccttacggaaagagcctgtatttatgtataatgggtggagaaagtgaggagttgttcgtgttaaaacgtgaagatttaattgcccctgtgcaatataatttagtgaatgaaatggaaaagttcagtgctgctggacaaaaaaccgctcttctttgggaggacgagtcgggcaagcaagaatcttggtcgtatgaaaagctgatggaagaaacaaataaaatcggagcggccttagctgatcttggatttaaaaagggagacaagctgattgtaatggttccgcgggtgcttgaagcctatgctgtttatttggctatcctgaaatcaggaatggttgtcattccgtgctccgaaatgcttcgcgcgaaagatcttgaataccggattgaacatgcagaggtaaaaggcgctatcgtctactccgaatttattggcgctttccgggatgtcagtacggctgacaaactgattacactgtctattggtgaaaatgatgccggctggaaaaacctcttatcaattgaagcggacggaagccaatttaaaacagctgacacaacaagagatgatatggctttcttatcttatacatccgggacaacaggtcagccgaaaggtgttgtacatacacatggatgggcatttgctcatttaaaaacttctgccggcgcttggcttgacatttctgaaaaggatatcgtctgggcaactgctgcccctggctggcaaaagtgggtatggagtccgtttttagcggtgcttggcagcggagcaaccggttttgtgtaccacggcagattcaaagcagaaaaatatctagagcttttaaatcgctacaaaatcaatgttttctgctgcactccgacagaataccgcttaatggcgaaggttgaaggcttgaaacgctttgatctttctgccctgcacagcgctgtttccgcaggtgagccgctcaaccgtgaagtcattgatgttttccaaaagcactttggcattaaggtacgggacggatatggccaaacagaaagcacgcttttggttggtgttttgaaagatacgcctattaaaccgggaagcatgggaaaaccgacaccgggaaatcaggtggagatcataaatgaagacggtgaaatctgcaaacctggtgaggttggcgatatcgctgttcacctcagtacgcctgcgctctttaaagagtattttaaagatccggaaagaatgaaaacacaaattcgcggcgattatttcctaacgggagacagagcaagaaaagatgaggaaggttacttctggtttgaaagccgaaatgacgatattattatcagctccggctatacgatcgggcctttcgaggtggaagacgcgcttgttaagcacccagaagtaaaagaatgtgctgttgtcgcaagccctgatgaaatcagaggctccatcgtaaaggcatatgttgtcctgcaaaatcatgaaaaacgcagtgatgagcttgtcaaaatgctgcaaaaccatgtgaagacgattaccgctccatacaaatatcctagagaaattgaatttgtggaaagcctgccgaaaacggcttctgcaaaaatcagacgagtggaattaagaaaacgtgaagaacagctcaaagccaataaaaaggcgtaaagaaagagagtgaacgtgaatgaaggcgatatggcacggcggtttcatttatacgatgctcgaagaaggcgatcggactgaggcagtttatgttgaggatggtgttataaaaggcaccggcagctatgaacgtttgaaggaaaagtacgggtcgccggaaacagaagaaatcagcctgaacggagcagtgatgttccccggttttgttgacagccatctacatttgatcggccacggtgagaaacagcttcagctcgatctgtccgcactgacgtcgaaagattcaattttacaggctgcgaaggaaagagagcggcagcttcctaaaaacgattggctcattggagaaggctggaatgaaaatcagtttgagacacctgactacttgactaagcatgatcttgatcgcctgtttcctgacaggcccgtcttgctcaagcgtatatgccggcatgcaatagctgtcaattctgcggctcttcaagcagcgggaatttcaagaaatactcctgatcctgacggcggagtcatcgtaaaagatgcaaatggcgagccgaccggactcctgtttgataaggcgcaggatttgattctgaaggctgtcccgccagtctcccagcactatgttgatgaggcattaacggctgcaataaaggattgctggacaaaaggcctgacgggcggtcattcggaagacttgtcctattatggtgatgtttcggtgccgatgaaagcttatgagaaagctgccgctggcggaaagtatccgtttcgctgccatttgctcgttcatcatgaagctgtcgatcgatgggagcagctggagaagctgtccggcccgtatgtggagttcggtgctatgaaaatctttgcggacggggcgcttggcgggagaacggctttattgaaagaaccatatcaggatgatccatcaacaaatggtgttcaggttcacgatgacgaaacccttggccggctcattcgcaaagcgagagaaaaagggatggaggttgctgttcatgcaatcggcgatcttgcttttgaaaaagtgctgaacgcaatagaaaagcatccgcccaaaaacggccggcatgatcggcttattcatgctcaagtgcttgataacgaattaatcgagagagcagcacgcatgccgatcgcacttgaccttcagccgcacttcgttgcaagcgactttccgtgggtcattgaccgtctcggaaaagaccggatgaagactgcatttgcctggaaaaccctcatatctaaaggcattttatgcgcgggcggttcagacgccccgattgagcctgttgacccgcttctagggatccagtccgcggtcctccggaaaagcagtcatgagcaaaacgggccaagctataatgaaagtgaatgtttacctgtatatgaagcgataaagctttatacagaaggtagcgccggtatcatttataaagagaagtcacgcggaaaaattgcggaaggctatgacgcggattttacagttctcagtggtgatccgtttgccattgaccccgcacagcttcatcttttagagattaaaaaaaccgtgattaacggccagattgtatatgagaaatcataaaaggacaggcagcagcctgtccttttattttctataaaaaagtacgcttcactttttcccaaaatgaattgtcctttagtttgactgttttgattttcttattagacagtttgatttcgatcgttttcacatttctcgtgctgagtgcttcattgtccaagccgatgattgggtgttcgttgccgtcctgcaccacacgaagggtcagctttcggtcagagctgaggacaaatggcgagccgagtgtccggtaggtattattgttaagggatgcaagctctgatacctgcatgcatggaagcaatggatcaacaacagctcctgcaacagacttgttataggcggtgctccctgtaggcgttgagataatcattccgtcacctctaaacgtttcaaagtgcagatcgtcaatcagcacgtccatcacaaaggttttgatgatgcttgagcggatggatacctcgtttaagcagtgaaaaggactggcttgatccactgtcacttcaatcagcgggtattttctcacttcaatttgttcaaacgtcattgcatcgaccattttttctcgctcatcactatgaaagtcgcaatataaatgagctttcccctttttggtaatgccgacgtacaagcagtcgtcacgaaaattcgtctttctgactgcctgcaaaaatgtgccgtccccgccaatgctagcgataatattggcgtctgagtgctggttcacaacggtaaatccatgctcttccgctaattgtgttaacgagcgggcttgttcgttcgtttcctgatcctgtttgtgaaaaaaataaacattacggcgttgatcggtcatatcccatttcccctttgctgtcatatttaagtttttctgccatccagtatttgtgataaaatacctttggccataagtgtaccacgtttgccggcagcccgttaagccggagctttctcatgaagtgaaacatttttcatattgaatcgtataatgagagagtttaggaaaaaggaggagaaaaaatgaatgcaaaaagatggattgcattagtgattgctctggggattttcggcgtgtctattatcgtcagcatctctatgagtttctttgaaagcgtcaaaggcgctcaaacggatctcacatcactgacggatgaatcgcaggagaagacgctggaaaacggcagtccctcaagtaaaattgccgtattagaggtcagcggcaccattcaggataatggggactcaagcagtctgcttggtgcagacggatataaccacagaacgttcttaaaaaaccttgagcgcgcaaaagatgacaagacggtcaaaggtatcgttctgaaggtgaattctccgggtggcggagtgtatgaaagtgctgaaatacataagaaactggaagaaatcaagaaagaaacgaaaaaaccgatttacgtgtcaatgggttcgatggcagcatcaggaggctattacatctcaacagcggctgataagatttttgcgacaccggaaaccctgaccgggtcactcggcgtcattatggaaagcgtcaattattcaaagcttgccgacaagcttggcatttcttttgaaacgattaagagcggggcccataaggacattatgtctccttcccgtgagatgacgaaagaagaaaaaaacatcatgcaatcgatggttgataattcgtatgaaggctttgttgatgtcatttcaaaagggcgcggcatgccgaaagcagaggtaaagaaaattgcggacggccgcgtgtatgacggacggcaggcgaaaaaactgaacctcgttgatgagcttggtttttatgacgataccattacggccatgaaaaaggatcacaaggatttgaaaaacgcctctgtcatttcttatgaggaaagcttcggattaggctcactgttttccatgggcgcgaacaaaatgtttaaaagtgaaattgattttttgaatatgagagaaattctatcgcaatccggttcgccgagaatgatgtatctctatgcgaagtaggagggaacaataatggacgcgacatatgaagagttagagcgcaatgacatcaaaggcccgcaagaagcggagctgctgacacatgcctatgctggcttttgggttcgtttctgggctttcctgcttgattggctcgtgatatggggattaaaccatttgctcgtttctcccctctttaccgtattggatctgccgaaaacatccggcatgtttaccttctcggcctacagtgtgacaacgcttattgtgtatcttgcctatttcgcactcatgacaaaatacttcaggcagacgcttggtaaaatggtgttcggcctcaaagtggtttctgtgaagcaagatagcaagctgacatggagtacagtgatttttcgtgaagtggttggacggtatattgataagatttggattttatatatcgttgttgccttttcacctacaaaacaagggattcatgattacatcgcggataccaccgtggtgcatgaaaaattataccgcaaataaccgataacccggacttccgtccgggtttatttttttaggaattggcgataatgctcctagaggaagtgaagaatatggtgtatgtactgacagccattcttattctcatagggatcgtactgcttctcagaatgaaaatccatgtcgcgctggagtatcttcatgccgatgataatgacaaattgaccttgaagattacggcgctgtttggccttataaggatcaaaaaaacaatcccggcgattaaggtgaacaaagaagacggaacagtggatatcaaacaaaaaactgaatccaaaatgaaaaaaagcagcggaaagaaaaaaattacacaaaacgatgtgcagcaaagcattaataaaatcgaaatgcttttgcatcaggtcaccagactgcggaaaatcagcgcgtcttttctcgcgcatttacatatcacaaaactagaatgggttacagtaatcggaattcaggacgcggcagtgacaggtgtgttaaccggtgctgtatggggcgtgaagggcggtatcgcagcaatgctctacgaccacctggactttgtgaataaacctgtctatgaggtgatcccgtcgtttcaagtccctgtttccaagacccattttcagtgtatattcttttttcgctttggacatgctatgcttgcagctttcaaattcgtcaaatacggacgggagctatccgtattaaagaagaatccgtcggctagaatgacttcaaagaatgattcatcagtttaaggaggaagcgtatatggcagaccatcccatccaaggtttaatgaaaaccgcaatggaaaacttgaaggaaatgattgatgttaacaccatcatcggagatccagtggaaacgcctgatggaagtgtgattttaactgtttctaaagttggattcggattcgccgcaggcggaagcgagtttggcggaaagccggccgaaaagaaatcggaagacgatgagacaagagaacagaaacttcctttcggaggcggaagcgggggcggtgtgtccattacgccgatcgcgtttttaattgtcggatcgacaggcatcagaatgcttcatttagatgaaaatacccatttaatagagaaaattttagacgcagcccctcaaacactcgagcgcatccagcaaatgttcaagaaaaataacaaaaaccaaagccaaggccaaaatcaaaaccaaatgaacaatatgaattattaaaaaaaggttaactgcgctggccgcagttaacttttttttggcataaactttgcagtttgcaggaaactttactatgatagagacatacatacaaaagggaggaattataatggctgaaattacattcaaaggcggtccggttacacttgtcggacaagaagtgaaggtaggagatcaagctcctgatttcacagtgctgactaacagccttgaagaaaaatcgttagctgacatgaaaggaaaggtaacgattatttctgttatcccttcaattgatacaggtgtttgtgatgcacaaacacgccgttttaacgaagaagctgcaaagcttggagatgtcaacgtctacacaatcagtgcagaccttccattcgcgcaagcgcgctggtgcggcgctaacggaattgacaaagtggaaacactgtctgaccacagagatatgtcatttggcgaagcgttcggtgtgtatattaaagaacttcgtctgcttgcgcgttccgtatttgtccttgatgagaacggaaaagtcgtttacgctgaatatgtaagcgaagcaacaaaccacccgaactatgaaaagccaattgaggctgctaaggcattagtaaagtaagcagggaaaaaagctccaggctgccgccggagcttttttcatggcaaggaggaacacaatatgcaaaaagaccatgtaggtgcggtgtatgagctgttaaacgaagccgcgattatgataaagaatgaattgcagatttcatatatagaggcgctggccgaagcaggagaaatgtattttcttgaaaaaacggatcagctgaaactgcctgctgatcagaaaaccaaacaacttcaggctctgcttgaaaaagcggaattcggcacgtatgagcatgagtgggtacgcaaggcttttcagcttgccgtccttaaaggaatgaaagatatctcgcatccaaacagacaaatgacgccggatacgatcgggcttttcatcagctatttggtgaataaatttatggcggacaaaaaggaactgaccattcttgatccagccctgggaactgggaaccttctgtttaccgtgctgaaccagctgtctgaaaaaacggcaaacagctttggcattgaaattgatgatgtgctcttgaagatcgcctatgcccaagcgaaccttctgaaaaaagagcttgagcttttccaccaggacagccttgagccgttgtttatcgatccagttgacacggtcatttgtgatctgccagtcggctattatccgaatgacgaaggagcagaagcgtttgagctcaaagctgacgaaggccattccttcgctcatcatctgtttattgaacagagcgtcaagcataccaaaccgggcggctacttattttttatgattccgaatcatttgtttgagagctcccaaagcggcaagctgaaacagtttttcaaagataaggttcatatcaacgcactgttgcagctgccaaaatctatttttaaagacgaagctcatgccaaaagcatccttgtgcttcagaaacaaggagagaatacgaaagcgccggggcaaattctgcttgcgaatcttccgtctttctccaatcaaaaggcgatgcttgatatgatggctcaatttgatgaatggtttaaaaaagaaaagtaagtgttttaaaagcagcttagacagccgtatgaggtcgatgcctaagctgcttttatttatgcttttgaagaccggacttgacgaattgaatccagctttgaaacacaaaatacagagggaaaaaccgcaaattgtaagcgttcatcaatacaaaacctatagtgaatgtgtctgaaaataacgacttcttattgtaagcgttatcaatacgcaagttgacttgaaaagccgacatgacaatgtttaaatggaaaagtcagatatttttcggagaagatgttgatattcaccgggaaaaaagtacgaaaaacgaagttgttgatacagagtataaaggagcgtcaatcatgtccaaaattattgcaattaacgcaggaagctcgtctttgaaatttcagcttttcgaaatgccttcagaaaccgttttaacgaagggtttagttgaacgaatcggtatcgccgacagcgtattcacaatttctgtgaacggcgaaaaaaatacagaagtaactgatattccagatcatgcggtagctgttaaaatgctgctgaataagttaacggaattcggcattattaaagacttgaatgaaattgacggaattggccatcgtgtcgttcacggcggagaaaaattcagcgattctgttttattaacggatgaaaccattaaggaaatcgaagatatttctgaattggcaccgcttcacaatccggcaaatatcgttggaattaaagcgttcaaagaagtgcttccaaatgttcctgcggtagctgtatttgatacagcattccaccaaacaatgcctgagcagtcttacctttacagcttgccgtatgaatactatgaaaaattcggcatccgtaaatacggcttccacggcacttcacataaatatgtaactgagcgtgcggcagagcttctcggccgtccgttaaaagacttgcgcctgatttcctgccaccttggaaacggagcaagtattgccgctgttgaaggcggaaaatctattgacacatccatgggctttacgccgcttgccggtgtagcaatgggcacacgctctggaaacatcgaccctgccctgatcccatacatcatggagaaaacaggccaaacggctgacgaagtactgaatacattaaacaaaaaagcggactgctcggcatttccggtttctcaagcgatcttcgtgacatcgttgaagctacgaaagaaggaaatgagcgcgcggaaacggctcttgaagtattcgcaagcagaatccacaaatacatcggttcttacgctgcaagaatgagcggtgtagatgcgatcatctttactgccggtatcggtgaaaacagtgtggaagtcagagaacgcgttcttcgcggtttagaattcatgggcgtatactgggaccctgcgcttaataacgtgcgcggcgaggaagctttcatcagctatccgcattctccagtaaaagtcatgatcatcccgactgatgaagaagtcatgattgcgcgcgacgttgttcgtttagcaaaataaatcgcatgaaagcacattctcttgaatgtgcttttttgttgatgcatgatagtgacagacagaaaacataaaagaggtgggccaatgagcgttcaagagcataaacaagaagctcccgatatcgttcggtgcaaagtgattactgtcagtgacacgaggacagatgaaaccgataaaagcggcaagctgatgatctcatttttagaagaagccggtcatcatattgccgcatatgaaattgtaaaagacgaaaaggatgctttgcaacggtcagtgcttgcgggctgcatggatgaacagacagacgcggtactcttaaacggagggacaggcatagcagatcgggatgtcacaattgaagccataacgccgctgttttcgaaagaactgcccggctttggagaaatattcaggatgctgagttatacagaggatatcggctctgccgcaatcatgtcgagagcaactgccggcgtcattcagcataccgctgttttctcaacgccaggctcaagcggcgcagtaaagctggcaatgaataagctgattattcccgaacttgcgcatgtggtcagagaaatcagaaaagacaagtaaatgaataaatactatgaaacttcacctgaaatttaggtgaagtttttttataaaaggcttgaaaaaacgaaacgtacttgttaaagtgtatacatacaaaatgtatttttattaaatataatttatttttatacaaaatagaaacacggttgagaggggatttttatcatgtcagaacagaaaaaagtcgtattagcatactcaggaggtcttgatacttccgtcgcaataaaatggcttcaggagcaaggatataatgtaatcgcctgctgcctggatgtcggtgagggcaaagatttggcatttgttcagcagaaagcgcttgaagtcggcgcgacaaactcctacgtgatcgatgcaaaagaagaatttgcacaggattacgcgcttatctctttgcaggcccacacaatgtatgaaggaaaatacccgcttgtttcggcattatctcgaccgctgatcgcgaaaaaactggttgaaattgcggaaaaagaagatgcacaggcgattgcccacggatgcacagggaaaggaaatgaccaggttcgtttcgaagtctccattaaatcattaaaccctgacctagaagtcatcgcgccggttcgcgaatggcagtggtcacgtgaagaagaaattgaatatgcggctagccgcggcattccgattccgatcaatcttgacagcccgtattctatcgaccaaaacctctggggacgcgccaatgagtgcggcattttagaagatccatgggcggcgccgccagaaggtgcatacgatttaacagctccgctggaaaaaacgccggacacgccggaagtgattgaaattgcatttgaacagggcgtgcctgtctccattgacggtgtttcctactcgctttctgagctgatcttgaagctgaatgaaatggcgggcgcgcacggtgtcggacgtatcgaccacgtggaaaaccgcctcgtcggcattaaatcccgggaagtatacgaatgccctggtgcgatgacactgatcaaagcgcataaagaattagaagatttgacactggtgaaagaggtagcccactttaaaccgatcatcgagcaaaaaatgtcagaaatcatttacaacggcttatggttctcaccgttaaaagacgcgctgcacgctttcttaaaagaaacgcaaaagcatgtcacaggcattgtccgcgtgaagctgtttaaaggccatgcaattgtagaaggacgtaaatcggaatactctctatatgatgaaaaacttgcaacatatacaaaagacgatgcatttgatcaccatgcagcaatcggatttatcgagctttggggacttccgacaaaagtgaacagcatcgtgaaaaagaaggagcagattaaagcatgaagaagctttggggaggccgatttcaaaaaacaccggaaaaatgggtcgacgagttcggcgcgtccatatcatttgaccaaaatttagttgctgaagacattacagggtctctcgcacatgctgccatgctgaaaaaatgcggtattctgacagcagaagaagagttgaaaatccgagagggcctgaatacccttttgcaaaaagcagaggagggagcattggaattctcagtcgattatgaggatattcatttgaacattgagaaaatgctcattgacgaaatcggtcctcttggcggcaagctgcataccggcagaagccggaatgaccaggtggcgactgacatgcatttatacttgaagaatcatgtcggccacatcatcgagctgattgaggcattccaaagtgcgctgattgaaaaggcggaagcgaacgttgaaacgattctgccgggctacacacatttgcagcgcgcccagccgatttcattcgctcaccatctgcttgcgtatttctggatgcttgagcgcgacaaggagcgttttcaggattcaatgaagcggattaacaaatctccgctcggctgcggggcgctcgcgggaacaaccttcccaattgaccgtgattattcagcggaactgctcggctttgatgccatttatgaaaacagcttggacggcgtcagcgacagagacttcattttggagtttttaagcaacagcagtatgctgatgatgcacctatcccgtttctctgaagaaatcattttatggtgctcgcaggagtttaaattcatcgagcttgacgatacgtacgcaacaggaagcagcatgatgccgcaaaagaaaaaccctgatatggcggagctgatccgcggcaaaacaggacgcgtatacggcgatatgatggggctgtttacgatcatgaaaggacttccgctcgcttacaacaaagatctgcaggaagacaaagagggcatgtttgacacggtgaaaacggtggagggcagcctgcaaatcttcacaggcatgatccaaacaatgactgtaaacaaagacgtcatgaagcaagcaacaaaacaagacttttcaaacgcgacggaactggccgattatttagctaaaaaaggaatgccgttcagagaagcgcatgaagtggtcgggaaacttgtgtacacatgcatcgaaagagggatctatttaagcgatatgccgtttggcgagtttcagcaggcgagcacactatttgaagaagatatttacactgtgttagacccttactacgcagttgaaaaaagaatgagcgccgggggcaccggattcaaacaggtggaacaggcgcttgaaaaagcgaaagcttgcgtggcagcaggagtttgttaaaatttccttcataaaatcccgtcattatagccaacctacctctataatgatgggaggcagaatgatgaaaaaagaaccggaacgctatatttatgatgaacaagaaagccaggagacaacaaggctcatttcagaagcatatcaaagcggttatgtcgatatgcctgatcaggagtcttcatctcctgcagaataagctgtctgtacaggcagctttttttgtatgccaaagtgtaaaaagtgatattgcaagccttttatagtaaagtagaagaagaaacactttattgaaagcggcgacgttgctttgggaggtattcatgtgcgacatgctttaattactgccggttcgaagggtttaggccgcaaagtgactgaaacgttgcttgcaaaggggtattcagtaacagtcaattacagacaggatgaggaggcagtcagccgcctgaaggaagcctgtcccgattgtcttgaccggctgcaatttgtaaaaggtgatgtcaccaaaaaagaagatctgctgcgtattgcagaggctgccttaaaccgcttcggaaggatcgactttttgattaacaacgctggaccatacatatttgaacgtaaaaagttagccgattatactgatgatgaatggtatggcatgctggaaggaaatttaagcgccgtctttcatttattcaaagcggttattcctattatgagaaaacagcaatttggacgcattattacgtacggattccaaggtgcggctcacgcgcccggctggcttcaccgatcggcatttggcgctgcgaaagtgggcttggcttctttgacgaagacaattgccattgaagaagccgaattcggcataaccgccaacatggtttgcccaggagacattgtcggcgacatgaaagaagcatcgatagaggaagccagaatgcgaatcggcaaagaaaaaacgccgataggaagatccggtacaggcgaggatattgccaggattatcgctttcttgtgtgaggagaactcagaccttgtgacagggactgtcattgaagccaccggaggcctcaatgtcattaacaagaatcaaacaacataagtttttcagctttttaaaaagggaaaataaaaaaacaaaatcatgtgacgaggtgaaagaaatgaaagtgacatatcacggacattctgtaatcacagtggaaacgaaggaccatcatattatttttgatccgtttttaacagggaattcattaacggatataaagccggaggatgtaaaagcggatgtcatcttactaacgcacggccacaatgaccatgtcggtgatactgaacaaatcgccaagcaaaataacgcgctggttatagccccgaacgagctcgctgtgtacttaggctggaaaggcttgaatgttcatccaatgcatattggcggctcccgccagttcgattttggaaaagtgaagctcacacaggcctttcatggatcagccatcacagatgaagaaaacaaaacgatcacttacacaggcatgcctgccggtattttgctgactgtagaagataaaacgattttccacgcgggcgatacggcacttttctctgatatgaaactcattggcgaattgaatcatatcgaccttgctttccttccgattggcgataactttacaatggggcctgaagacgccaagcttgctgctgaatggctgcgcgcaaaacaggtcgtgccggtgcattacaatacattcccggtcatcgaacaagacccagaagcattcgctgacagcctgccgggcggagtcggcaaagtcatgtcggtcggtgagacgatcgagctttaaaccgtgaaaccatctcctgatgaatcaggaggtggtttttattttttcagttatcctgtaatggtcttatcagaggttccttccaattctttgctgcgctgctgaaaacgtttggttatccgggcgatcaagtccttcgtggcgcggtcaaaatgaacttctttttgatttgtcaacagccctatgggcggggtgatatccaggttcagaattggaatgactttagtgccgttgaacggtttagaatgtgcggtgctggtaaagattgaaattccgatgttttcacgtacgtaatattcatgtgacatgctgcttgtgagctccatttttttgtagcgattcccgagttctctatgtaaatgctgttcaatttgtaagcgaatggggcaattggcgggcgtaaatatgaagcgctcttctgctaaatcagacaaatggacagccttcttctcagcgagcggatgttgatcagatacaatcacatttaatgtgtcataaaaaaatggatggtagtaattttcaagaatcagctccggctcgccgcagactgcaaaatcaatcgtcccgtctaagagcttttgactgcaggtattggcgtcatcaaccttgatattaaccgttatctttgggtaatccattaagaaatcctttaaaatctcggggaatatcagactggcggttggctctgaaacccctatgttgataatgcctgcctcttcttcctttaagtcggagaggttgtgtttaagcgcctcgtattgcatcaaaagatctcctgttcgttcatgaaaaagcttccctgcttttgtcaactgcaggctttttcctctttcaaacagcagtacgcctaaatcctgctccaattgcttcatacgcatcgatatcgtcggctgcgagtagttgagtatttctgcagctttatagaagcttccaaattttacaatcgtatgaaacgttttgattgagcgtaactccaatgtgctccctcctgtttttcatcattaaaattactgaagtgaaggtttactttttttgattagtcaaagatcagagtatgctttatagtataaacaataaaagcttagtaaacaaataggaattatatattttgtgaagaggagtgacaaaaatgagtgatgatatttttcgactggcaactgttgaagatgcatcggagctgttgaaactggttaacagcgcatttcagcccattcggcagctggatattgattggccatccacgagagctgatatccaaatggtatcagaaaatattgaacatcattcagcgattgtgctggagcgggatgggaagctgatttcaacgattacaatcaggttcccgtgggagagtgagacgcctccttcaaaatatccatttgtgtggtggtttgcgacactgccggaatataaagggcaaggcgccggaagtaagctgcttacgtatgttgaagaaaaagtgcttcgagatatgctgaaggctcctgcgctgacactcggcacatcggcgcgcaagcatccttggcttgctgacatgtacagaaggagagggtatgaagtgtattttgagcaggaaaaagacggggacataggtgtgatgatgcacaaggttctgattccggaacgatttaacccaacgcttttaggtgcgcccagctgggcatgatgtgaggcagcctatgaataagcgtaaaggattggttttgctgctgtcagtgtttgcattacttggcgggggatgttcgcaaacaaataacaaaacagatcgtcaggctcaaacggtcatagtcggcactggaacagattttccgaatattgcgtttttaaatgaaaaaggtgaattgaccgggtatgacattgaagtgatgaaagccatcgataaggagttgcctcaatatacatttgaatttaaaacgatggatttctcaaatttgctgacgagtctcggaaataaaaaaattgatgtgattgcgcacaatatggccaaaaataaagaacgagaaaagcgttttttgtatcataaagtcccatataactactcgccgatgtacatcacggtgaaagaggataatcacaagattcatacattaaaagacttacacggaaaaacagtcatagttggcgccacgtcaaatgcggcagattatattacaaagtacaacaaaacgcacggcagcccaattcatttgaaatatgcgggacagggaagcaatgataccgccaatcaaattgaaaccgggcgcgcagatgcaacgatagctacaccgtttgccgtcgattttcagaataaaacgcacgccttccgccaaaagacagtcggtgacgtgttattagataccgaggtgtactttatgtttaataaaggcagccaaaccttggcggatgacacggatcaagcgattaaaaagctggagaaaaacggaacgctaaaaaaactaagccgaaaatggctcggggcagattattcaaaatcaagttttgaaaaataaatggggcgatgagatgaaaacgaaaacagcattcatggcaatattattttcgcttataacagttctgtcagcttgcggtgcaggcagtcaaacgacgggagccgggcaaaagaaggtacagacgatcacggtcggaactggaacccaatttccgaatatttgctttatcgatgaaaaaggcgatttaaccggttatgatgtcgaactgatcaaagagcttgataagcgcctgccacattataaattcacatttaaaacgatggaattttccaacctgcttgtcagcctcggacagcataaagtcgatatcgtggcacatcaaatggagaaaagcaaagagcgtgagaaaaaatttctgtttaacaaggttgcttacaaccattttcctttaaaaattactgtgcttcaaaataacgatacgatccgtggaattgaagacttaaaaggaaaacgggtgattacgagtgcaacctccaacggagcgcttgtactgaaaaaatggaatgaggataatggacggccgtttgagattgcctatgagggccaaggcgcaaatgagactgcgaatcagctgaaatcggggcgtgcggacgcaacgatctcaacgccttttgcagtagactttcaaaacaagacgagcactattaaagaaaaaaccgtcggtaatgtgctttcaaatgccaaagtgtattttatgtttaacaaaaatgaacaaacgttaagtgacgatattgataaagccttacaggaaatcattgatgacggaacgttgaaaaggctcagtttgaaatggcttggtgacgactattccaaagagcagtattaggtaaaaagagagggagcagtgatggaaaaagcgtttgatatgaacatgattggagattttgtgccgacgttaaccgcttatttaccggttacattatacattttaacactgtccttgcttttcggttttgtattaggactctttctggcactgccccgcatctataatattccaattgtaaatcaattggcaaaagtgtatatctcgtttttcaggggaacgcctatcatggtgcagcttttcatcgtgttttacgggatcccggcgcttacggggcttatcgggattgatacatcaaaaatggacccgttttatgctgctgtcgcaacctacgcgttaagcaatgcagcggcagccgcagaaatcattcgagcgggggtgggcagtgtagataaaggccaaacggaagcggcgtacagtattggcttaagcggtagtcaggccttcaggcgaatcgttctgccccaggcacttgtccaggcgtttccgaatatgggaaacatggtgatcagttctttaaaagatacgtctctagccttttcaataggtgttatggatatgtccggaaggggccaaacactgattacctcaagcaaccattctcttgaagtttacattgcgctatcgattgtttattatgctgtagcggttttattcgaatggttctttcgagtggcagaaaaacgaatcaagaagaatcaaacaaggattgttactgtttttgacatgaacatacattgatatatttcttcggatgaggggggagaagattgcaatttgactttccatttatcgtttccgccatgaaagaaatggtaaagaccattcctctgacattgatgatggctgttttgccgattgtgtttggatttctcgtggctcttggaaatataattgttagaatttttagaattaagggcttggtggcttgctcaaggttttatgtgtctttctttcgaagtacacctgcaattcttcacattatgttgatttatttagggataccgcctgttgcagatcaagtcagcagtttttttcatctcggctggtccgctaatgagataccggtctccatgtttgtcatcatggccttgtctttaactgccggagcttatctcacagaaatcatccggtcgggcattctggcgatggataccggacaggtcgaagcggcttattcaatcggcttgacatacagccaaacctttcggcgtgtaatattgccgcaggcgctgaaggtttccatcccaaacttcacaaatttgggtatcggctttttgcataccacctctatcgcggctatagtggctgtcccagagattacagggacggcgactatcgttgcttctgataattatgcatttttagaagcgtttatcggagcagcgattatctattgggtgctgactctaatcctagaatccgcaaatggagtattagagagaaaggcagccagatttcaaggaggcactttatgattgagattaaaaatatccataaacagtttggcatccaccatgtattaaaagggataaatctcacggtacgcaagggagaagttgtgacgattatcgggccgagcggatcagggaaaaccacctttttacggtgcctgaatttattagaacgtccagacgaagggatcatttctatacatgacaaagtgattaattgccgctttccgtccaaaaaagaggttcactggctcagaaaacagacggcaatggtatttcagcaataccacctgtttgctcacaaaacggtgattgaaaatgtcatggagggcttgacgattgcccggaaaatgagaaaacaagacgcgtatgccgtagcggaaaatgaactgagaaaggtcgggcttcaagataaattgaacgcttatccgagtcagttatcgggaggacaaaagcagagggtagggatagcaagggcgcttgccattcatcctgatgtgctgctgttcgatgagccgacggcagcgcttgacccggagctggtcggtgaagtgcttgaggtaatgctggaaatcgtgaaaaccggagccaccatgattgttgttacacatgaaatggagtttgcaagaagggtctctgatcaagttgtttttatggatgaaggagtcattgttgaacaaggaaccccggaggaagtcttccgccataccaaaaaagacagaacgaggcagtttctccgccgtgtttcgccggaatatttatttgaaccaaaagaacacataaaggagccggtgatatgatccgcttaagtattttagaccaaagcttgattggtgaaggggagacagcagctgatacattacagcatacagtgaaattggcacaaatggctgaagaatgtggatatcaccgattttgggtggccgaacatcacaacaatgatgagattgcagggtctgcacccgaggttcttttaggctatcttgctgcaagcacaagaaaaattcgtttagcatcaggcggagtgatgctgcagcattacagctcttataaagtagcggagcaattccatcttctatcagcgttagctcccggccgtatagatcttggagtgggcaaagcgcccggcgggtttcagctgtccacagacgcgctgcaggccgaatataaaaaaccggtgcgtcagtttgatgaaaaactggaggagcttactcatttcgttcgggatgattttcctgatacccaccgctatgccgcattgcgtcctaggccgcaggttgatcggaagccgggtatttttctattgggaggaagcacagagagtgccatttctgctgcaaaactgggaatctcttttgtctttgcttactttattaacggtgaagaggaagtgctgaaggaagcccgccgagcatttgacgcgcatctcccgccaggatctgaggctgaatttcatcttgcccccgctgtttttgcggcacatacaaaagaagaagcggaaaaacatattgtgtcgcgtgaatcgataaaagtggttttgaaagacgggcgtaaggtcaacgtcggttcccgcgaacaggctgaggcctatctggaaaacgtcacagagccctatgacatcatcgtgcaaaaaaccgggattattgccggaacaaaggaagaagtggcagaagaattaacacgtttatcaggcacatacaaaatcaatgattttgttatttttacaccgatcaaaaatgctgtagaaaaacagctgtcttatcagctgctgagcgatgcagttttagctgcaaaacgttaaggagggacagaagaatgagtgatgttgtgaacattgtggtttggagtaaaaaaggctgttcgtattgtgaggaagtcaagaattatttgaatgaaaaagggttcccgttccaaaatatcgatgtttcagagaaagaaaagcttcgggatattttacaggtgaaatatggggtgcgccatgtgcctgtggtcgaaatcgggcgcggcaatcagtatcaagggataactgaaatcggcattgaacaccttgatcttgcacttgctaatcatgcacagataaaggaggcaaaaagatgacacgtgcagattttattcagtttggagccatgattcacggtgtcgggggaacaactgacggctggcgtcatcccgatgttgatccctcggccagcacgaatattgaattttacatgaaaaaggcgcaaacagctgaaaaaggtttgtttagttttattttcattgcagacggcttatttatttctgaaaaatcgattcctcattttttaaaccgttttgaaccgatcaccattttatctgcgctggcatcggttaccaaaaatattggtttagtagggacgttctctacatcttttactgagccattcactatctccagacaattgatgtcgctggaccatatcagcgggggcagggccggctggaatctggttacttcgccgcaggaaggagcggcgcgcaaccatagtaagtctaatttgccagaacacactgaacgttacgagatcgcacaagagcatttggatgttgtgcgcgggctgtggaattcctgggagcatgacgcatttatacacaataagaaaacagggcagtttttcgatcaggcgaagcttcatcgcctgaatcataaaggaaagtattttcaagtagaggggcccttgaatatcgggcgctctaagcagggagagcctgtagtgtttcaagcgggttcatcagaaacaggccggcagtttgctgctaaaaatgcggatgcgatttttacccattccaattcattagaagagacaaaagcgttttatgcggatgtgaaaagccgagctgctgatgaagggcgtgatccttcaagtgtgcggatttttccagggatcagcccgattgtggcagatacggaagaagaggcggaaaagaagtatcgtgaatttgcagaattgataccgattgaaaatgctgttacttatttggcccgtttttttgatgattatgatctgagtgtttacccgttggatgagccatttcccgatattggcgatgtgggaaagaatgcgtttcaaagcacaacagaccggattaagagagaagcaaaagccagaaatctgacattgcgggaggtagcacaggaaatggcttttccacggactctattcatcggaacaccagagcgtgtcgcatccttaattgaaacttggttcaacgctgaggcggcggatgggtttatcgttgggtcggatataccgggaacacttgatgcttttgtagaaaaggtgattccgattcttcaagaaagagggctttatcgtcaagattatcgcggcgggacattgcgggaaaatctcggtcttggcattccgcagcatcaatccgttttacattcatcacatcattaggtttcgtctgatcgaatgcggaagctgagagaggaggctgacttttttgacgatcattgccggtacggttgtgaaaggaaaacaattaggcagaaagcttggattccccacggcaaatgtagatgcaaaaatacatgggctgcgtaatggagtttatggggttctggcgacagtcaatcatcaatttcatttaggggttatgaatatcggtgtgaaaccgacggtgggctctaaccttgaaaagacattggagatttttttgtttgactttcatagagacatttatggagaaaaaatcgaatgcagcattctctttaaaattagagaagaaagaaggtttgattctttggagtctttaacaaagcaaattaaaaaggatatttcgtgcgttgcaaaacgctttgagctgattgggattatggcaccaaacaaaaaagaaagccttctttcccatcaggagttaaatcttccggatctctgcttttacaagaaatgtaataacctatatggcgtcaaccgaggcgtatacaatgtcattgataactggttttttgagtacggaattacacaagtagcttacaggcgcatttatattttatcttttttaagctttttgaaagaagataatccgaaagtttccagcaagtatataagatttggggcgggcggtcttgctgataaattgaaccgatttatttcatcttatgttgaagagtctgaagaaaatatattgggatagggaaaggagcggaacatatgtctttggattattggagaaatatagaaggctcctatccatatcagactacaggaaatgacatcctgacgttgaaagaggagtctaatcccgtaaatctctcaacgctagaaaagcagctcatcggcattcgccggcacctgcaccaatatcctgaactgtcaaaagaagaatttgaaacaactgcttttataaaaaaatgccttaaagaaaaggggatacagattcgccctactgctctaaaaacgggtgtgttcgcagacatagcaggggagtcagaaggtccggcgattgctttgagggctgatattgacgccttgccaattgaagaaaaaacaggattgccttatgcgtctaaacataaagggatcatgcatgcgtgcggtcatgattttcatacggcagcgcttcttggtgcggcctttttattgaaggaaaatcaagacagtctgaaaggaaagattcgtttattatttcagccagcagaggaagcgggtgcaggcgctacaaaagtgatagaggacggccaactggatggcattgatgcggttattggccttcacaataaaccggatatcgcggttgggactgtagggttaaaaacaggcccgcttatggctgctgttgaccgatttaaagtagagatagaagggaaaggtgctcatgcagcattgccgcataatggttttgatccaattatcggcgcctctcagcttattgtcgccctgcaaacgattgtaagcagaaatgtaaacccgctgcaaagcgcgattttaaccgtagggaaaatcaacggcggcagcacttggaatgtcattccggatacagtggtcattgagggcactgttcgtacatttgattcagaggttcgtaatcaagtgaaacagcgtttttttgcagtcacagagcagatttctgccgctttctcgttaaaggcaaatgtgaagtggcattccggaccgccgccgctttgtaatgatgaggcaattacggggctggtgcgagacgctgcacataaagcgaaacttcaagtcattgatcccgccccatcaaccgcgggggaagattttgcttattatcttgagcatattccgggatcctttgcgttttttggaacagacggtgatcatgattggcaccaccctgcatttacaatagatgaaactgcaattatcaaagcctcttattttttatatgaaagcgccaagagattgttagattcgaatgaagagtcaaaaatatctgattgatatagatggggtgttctgatgaagaaattaatcgtttttgcatttattggtttattgtcgcagttaatagacggttcgttaggtatggcttatggggttacctcaacttctttgttattggcgtttggcatcacacctgctgtggcttcggcttctgtccatttagcggaagtcgtaacgactgccgcatcgggagtgtcgcatattaaatttggcaatgttgacaaacaaaccgtttatcagcttgtcattcccggctctataggcgcttttttaggcgcggcattcctcagccaattacctggagatgtggcgaaaccctatatttctttgtttttgctccttctgggcggatatgtattgatcaggtttttatttcaatataagccggctcttgagaagaagcatgtgccgttaaaccgaaaacaatccatcccattgggagtgatcgctggttttgcagatgccacaggcggaggcggctggggaccggtgaccactccgattttattatcccgcaaaggcttgagcccgaggaaagttgtcgggactgtagacacaagtgaatttgccatcgccgtatctgcaaccgccggttttcttatttcattaggatgggaggacgtcaattggttatgggtgttttcactaatggccggcggaattatcgctgcccctatcgcagcatggctggtgcagaagtttcatccgcaattgatgggtgtgcttgtaggaggatttattattctggtaaatgccagaacattaataaatgaatggatcgcaaacacagctgttcatccattgatctatacggccataggggcgatatggctatccgcagttttatttgttttatctaaaatagggaatcgaaatattgttaagacagcggttgatgtccatttaaaagaaaaataaaggtttttccgctttacgatgtaaaaggaatcacgtggtccttgcgtttgactggaacgaaatcaacgctgtaagaagccggtcgggcttcttttttattttccagcctcattgcgtataaatcctttgaaaccttataataaaaacaagaagactgtccttagaggtgaaaggcttggcaacgaagcatgaacaaattttaacgtatatcgattcactgcctgtcggtgaaaaaatttctgtccgaagaattgcaaaggaaatgaaagtaagcgaaggaaccgcgtacagagcgatcaaggaagcagagaataaagggtttgtcagcacgattgaacgtgtgggcacaatcagaattgaacaaaagaaaaaagagaacattgaaaagcttacctatgcagaggttgtaaatgttatagacggacaagtgctcggaggcagggcagggctccataagacattgaataaattcgtcatcggcgcgatggagcttgacgcgatgatgcgttacaccgcagcggggaatcttttgattgtcggaaacagaatcaatgcacacaggcaggcgcttgaagcgggcgcggccgtattggtgaccgggggctttaacacggatgacagcattgtgcagctggcagatgagcttgaactgccgattttatccacgagctatgacacctttacagttgccgcgatgattaaccgggcaatatatgaccagctgatcaaaaaagaaattgttttggtggaggacatcctaacacctgctgaccgcacggtatatctttcgcctaaggataaacttgaaaaatggtatgagaaaaattttgaaacggggcacggccgcttcccggttgtcgacgatcaaatgaaaatccatggcattctgacatcaaaagatattgctggccatgaccgaaatgcatctatagaaaaagtcatgaccaaaaatcccgtcacggttattgggaaaacatctgtcgcttcagctgcgcaaatgatggtatgggaagggatcgaagtgcttcccgtcactgacggccaccaaaaactcatcggcatgatcagccgccaagacgtattgaaagctcttcaaatgattcaaaagcagccgcaggtcggggagaagcttgatgatatcgtttcaagggggtttaaagatgagggtgatgataaagaagatcaaacggtttacgagtatgaagtcacgccgcaaatgacaaatcagcttggaaccatttcttatggcgtatttacgaccattttgacgcaagcggcaaaccgatttttgcgctcgaaaaaacgcggcgaactcgtcatagagagcatcaccatcttctttttgaagcctgtgcagatggaatcagtcatcgaagtcaaacctcgcatcttggaggccggcagaaagtttgggaaaatggaagtggaagtgcacagccaaggtcatatcgtgtctaaagcgatgctgatggttcagctgatggaaagaagctaagggacgttcaggcgccccttacgcgtgatctctttcagcttctttggcgtgaaggggattgtaatgcctgaaggctttataacctgcccaagcgcttcctgctcctatgacgataaagataccgccgattactaacgttaatactgaatggaataatatcatttggttaagcccgtagaacaggactagtgaccctaaggccatgcttgattttgctgaacatatttcttttgccaaagatggctttgcccgtacgccttttactttatagtacacataaaagcaggctgaaagcccaatcaaaaaaacaagaaccagcataaatgaaatcctccatcgtaaaagtttacaaccccattttatacaaaaacgggcttggttttgacgttatttttcttttccgtcggcagagaatgtgatttaatgaataaaaacaataaaggagtatcaaatgaaaacagaattgatcagaaccatatcattatatgacacgattatcttacatagacatgtgcgtcctgatccggatgcctacggatcacagtgtgggcttacggaaatcctgcgtgaaacatatcctgaaaaaaatatttttgcggtcggcacgcctgaaccgtccctctctttcttatattcccttgatgaggtggacaatgaaacatatgaaggcgcacttgtcattgtctgcgatacggcaaatcaggaaagaatcgacgatcagcgttatccttcaggcgccaaactaatgaaaatcgaccaccatccgaacgaagatccatacggtgaccttctctgggtcgatacaagcgccagctcagtaagtgaaatgatttacgagctgtatttagaaggaaaagagcacggctggaagctgaatacgaaagcggcagagctgatctacgccggcattgttggagataccggacgctttttatttccgaataccacggaaaaaacactaaaatatgcaggcgagctcattcagtatccattctcttcctcagagttatttaatcaattgtatgaaacaaaactgaatgtggtgaagcttaacggctttatctttcaaaatgtgtctttgtccgaaaacggggcggcttctgttttcatcaaaaaggatacgcttgaaaaattcggcacaacggcttctgaagcgtcgcagcttgtcgggacgcttggcaatatctcaggtattcgcgcctgggtgtttttcgtagaagaagacgatcaaatcagagtcagattccgttcgaaggggcctgtcattaacggacttgcccggaaatataacggcggagggcatccgttagcttcaggcgcctctatttacagctgggatgaagctgatcgtattttagctgatctggaaacattatgtaaagaacacgagtagaggggagaccctctctcttagtgttcatctgtgacggggatgaaccagcagccgaaatcagtaaggtcctcgtagacttggagattgtgtgattgaagttcttttttgatgagggaagcgagtgagtttgtttcggcatatgcagaaaaaccttgtctgagacgggctgcttgatcttttgctaactgacggtcactgtaaacctccatttcccttcctccttcctttcgccattaagcctcacatatagtttataaaaaagaatgggaaaaagcgacagaagtttggagaatttaaaaaaaatccataattatgtggcgaaagaaatttcaagttccactgtcagcctcgtataaataatcaattctctgacggttgcctcgtattttttttcattgatcatatagactttattttcaattgtccgcttcaagagatcctttgtttgatagacgctctctatgtcttttgtaatcacctctgaaatatcatcctttacatgctcctcgaatttcgttttatccggctgtgatattttatatttatccccattcagcaatttgacgctgacgctttgaatcagcagttttcttttattatcttcattcagtttatggaggtcttcctgatagatcgaaatttgattgttcaagtcttttacatgctctttttgcttttcgatgaggctgacctgctcctcttggaatgttccgtaagtaaacaggaaaaagaaccagctgattacggctccgcacatcattcccgcgaaaaaacgctgccatcccggttttttgtaatgctgggggaccctcatgaagaaagatgctcctgggtcagccatgatataataagccagccgctttgcgcgccccccatggccgaaataattaaaagaagctgtttaaagatatctctcgtattgccttcgagtatgccgcgttcaaagctgtataccgcatcaaaggtgcctccgatagctgcgacaagcgcccatatttttaaccggttggcaagctttgtaatggctgtaagcgggggttcgcctgccaagtatgctccgagccctccgatgagtgcgcccccgatcagcacccctaacgcaatgaagtagctattgataaaattcaccataaatcctgcttcctgatccatctttatcacctcaccttttatatcatattgagctttcaggacaagtatgatgatgagtcaaaaaagaacatttgtttcttttggaaaccggccttataatgaaggaagaaatggatcgtaatgagaaagaggtgatagcatgtcttttgttcacctgcaagtgcatagcgggtatagcctgctaaacagcgccgcggctgtggaagaactcgtcagtgaagctgacaggctcggatatgcgtctttggcgctgacagatgatcatgtcatgtacggagctattcaattttataaagcttgcaaggcgagagggatcaacccaataatcggtttgacggcttctgtttttacagatgacagcgagcttgaagcatacccgctcgtcctgctggcaaaatcgaatacaggctatcaaaacctgctgaaaatcagcagcgttctgcaatctaaatcaaaaggcggactgaagccgaaatggcttcacagttatcgagaagggattatcgcaataacgcccggcgaaaaaggatatattgaaacgcttcttgaaggagggctgttcgaacaggctgctcaagcctcgctggaatttcagtctatattcggaaagggagctttttatttctcctatcagccttttaaagggaatcaagtcttgtctgagcagattctaaagctgtcagaagaaacgggtatccctgttacggccacaggcgatgtgcattacataaggaaggaagataaggctgcctaccgttgtttgaaagcgattaaagcgggggaaaaactgacggatgcacccgctgaagatttgcctgatctcgatttgaaaccactcgaagaaatgcaaaacatttatcgagagcatcccgaggcactgcaagcttctgtagagatcgcggaacaatgccgggttgacgtcagtctcgggcagacccgtctaccgtcttttccgaccccagacggaacgtccgctgatgattatttaacggatatctgtatggagggactccgcagccgtttcggcaagcctgatgaacgataccttcgccgtcttcaatatgagcttgatgtcatcaagcggatgaagttcagcgattactttctgatcgtgtgggattttatgaagcacgcccatgaaaaagggattgttacaggaccgggaaggggttctgcggcgggttctcttgtggcatatgtgctgtatatcacagatgttgacccgattaagcatcaccttctgtttgaaagatttttaaatcccgaacgcgtcagcatgccggatattgatattgactttcccgatactagaagggatgaagtcattcaatatgttcagcagaaatacggtgcaatgcacgtcgcacagattatcacctttggaacacttgcggcaaaggcggcgctccgggacgtcggcagagtattcggcgtcagcccgaaggaggcagatcagcttgcaaaactcattccttcaagaccgggaatgacgctggatgaagcgagacagcagtcaccgcagctggataagcggcttcgggagtcaagcctgcttcagcaagtctattcaattgcccggaaaatagaagggctgccaaggcatgcatcaacccacgcagcgggcgttgtcctgagtgaagaaccgttaacagatgttgttccgcttcaagaagggcatgaagggatctatttaacgcaatacgcgatggaccatcttgaagacttgggccttttaaaaatggatttcttaggtttgaggaatctgacacttattgaatccatcacttcaatgattgaaaaagaagaaaatattaaaatagacctttcaagtatttcctacagcgatgacaaaacgttctccttgctgtcaaaaggggatacgacaggcattttccagcttgaatctgcagggatgagaagcgtcttgaaacggctgaaaccttcgggcctagaagatattgtggcggtcaatgcactgtaccggccgggtccgatggaaaatattccgttatttatcgaccgtaaacacggtcgggcgcctgttcactatcctcatgaagatttaaggagcattttggaagatacatatggcgtcattgtgtatcaggaacaaattatgatgattgcttcccgtatggcggggttttctttaggcgaagcggacctattgagaagggcggtcagcaaaaagaaaaagaaatcctggacagagagcgaagccattttgttgaagggtgcttaaaaaaggagtattctgtagacactgcaaatgaggtctacgatttaatcgtcaaattcgcaaactatggctttaacagaagccatgcggtggcatacagcatgatcgggtgccagcttgcgtatttgaaagctcattatccgttatattttatgtgcggattgctgacaagcgtcattggcaatgaggataaaatctctcaatatctttacgaagcaaaggggagcgggattcgtatccttcctccgtcagtgaataaaagcagttttccgtttacagttgaaaacggatctgtcagatacagcctccgcgcgataaaaagtgtaggcgtctcagcagtcaaagatatatataaagcaagaaaagagaaaccatttgaagatcttttcgatttctgctttcgcgtgccgtcaaaaagcgtaaatcgcaaaatgcttgaagcacttatcttttctggtgcgatggacgaattcggccaaaaccgggccacgctgctcgcatccattgatgttgctttggaacatgctgagctattcgccgcggacgatgaccaaatgggattgtttttagatgaatcgttttcaattaagccgaagtatgtggagacggaggagcttcctctggtggatttacttgcgtttgaaaaggaaacgcttggcatttatttttcaaatcatcccctctccgccttccgaaaacagctcactgcgcaaggagcagtctccattctgcaggctcagcgggcagtcaaaaggcagctttcactaggcgttctgctgtcgaagatcaaaacgattcggacgaaaacaggtcaaaacatggcgtttttaacgctcagtgatgaaaccggcgagatggaagccgtagtcttccctgaacaattcagacagctttctcccgttttaagagaaggcgctcttttgttcactgcggggaaatgtgaagttagacaagataagatccaattcatcatgtcccgggcagaattattagaagatatggatgcagaaaaagcgccatcggtttatataaaaatagaaagcagtcagcacagccaggagatcctggcaaagattaagcgcattttgctggagcataaaggggaaacaggcgtttatctctattatgaaaggcaaaaacagacgattaagctacctgagtcgttccatatcaatgcagatcaccaggtgttatatcgcttaaaagagctgttgggtcaaaaaaacgtcgttttaaaacagtggtaacgattcgctttttgttatacaattggagcaattatgtgatcctgtttaaatattcagatagatttactccgcagaatgcagcaatcaacgcagcagtatacgaatcaaaaaatatccataaggagtgtttaggagaatgtcattaagagaagaagcattacacctgcataaagtcaaccaggggaaactggagtctaaatcaaaagtagaggtcagaaatgcgaaagatttaagcctcgcgtattctccgggtgttgcagaaccgtgtaaggatattcatgaagacattaacaaagtatatgattatacaatgaaggggaacatggtagcagttgtaactgacggtacagctgtgcttggccttggaaacatcggccctgaagcggcgcttcctgttatggaagggaaagcagttcttttcaaaagctttgcgggcgtagatgcgttcccgattgctttaaacacaaacgatgttgataaaatcgttgaaactgtaaaattgctggaaccgacatttggcggcgtcaaccttgaagatattgcagcgccaaactgctttatcattgaagagcgcctcaaaaaagaaacaaacatcccggttttccatgatgatcagcacggtactgccattgtaaccgtagcaggtcttgtgaacgcgctgaaactgtctggaaaatccatgtcatccattaaagttgtcgcaaacggcgcgggtgcggctggcattgcgattatcaagcttcttcatcattatggcgttcgcgacattgtgatgtgcgattccaaaggggccatttatgaagggcgcccgaacggcatgaacgatgtcaaaaatgaagtggcgaagttcacgaaccaagatcgcaaagacggttctctgaaagatgttatcgttgatgctgacgtatttatcggtgtctctgtagcaggcgcgttaacaaaagaaatggttcaaagcatggcaaaagatccgattatctttgcaatggcaaatccaaatccggaaatcatgccggaagatgcgcgtgaagccggagcaagcgttgtcggaactggccgttctgacttcccgaaccaagtaaacaatgttcttgcattccctggtattttccgcggagcgcttgatgtgcgtgccactcatattaacgaggaaatgaaaatcgcagcggttgaagccattgcttcactggtttcagaagatgagcttagcgcagactatgtcatccctgcaccgtttgataaacgtgttgcgcctgctgttgcgaaggctgtggcaaaagctgcgatggaaacaggtgttgcaagaatcactgttgaccctgaggaagtcgcagaaaaaacaagaaaacttacgattattggtgaataattttaattcattccaaaaatggcagcgcgttggcggagaccggcgcgctgttctcaagttaaactgacggctgaaatttttttagggggttagccttaaaaaaatttcagccgggtttaacattatttttgaatgcgctgtcaaccttgtcgtttcaacaccttatctgatttcatacaagcctttccgagcacgtcatcgaataaaaagttgtcgaattgaggatgacagcgtttgacaaaaaaagtacaatagtttcggtaaagttattagcaagtctatctgtttgatgacatgcggtgaagagaacccttcacaaaagggaggtaatcatttgttaaaggatatattcacgaaaaagaaaaagtatgcttccgtaccgtctgatcaagcgaagcacgatgttccggaaggcattatgacaaaatgtcctaagtgtaaaaaaatcatgctcactaaagagttggataaaaatatgcgggtatgcatgaactgcgattatcatttcccaatgaacgcaaaacagcgtatcgaaagcttgatggatgaacaatcctttgaggaatttaatcagggaatgctctcggaaaatccgcttggtttcccgggatatctggaaaagcttgaaaaagatcgcgagaaaacatccttaaacgaggctgttgtgacaggcaagggcaccatcggcggacacccggctgttgtcgccgtcatggactcttcattcagaatgggcagcatgggttcagtcgtcggtgaaaaaatcacgcttgcgattgaaaaagcaaaagctgataaagttccgtttattatttttacggcttcaggcggtgctagaatgcaggaaggcgtattaagtttgatgcagatggcaaagacaagctctgcgttaaaactgttcagtgaagaacagggtcttattatttcagtaatgacgcatccgactaccgggggcgtatcagcaagctttgcatcccttggcgattacaatttcgctgagcctggcgcgctgatcggttttgccggaagacggattattgaacagacaataggagaaaaactgcctgaggacttccaaacggctgagtttttattaaaacatggacagcttgatgcggttattcatcgcgacgatatgaaaaaaacgttagaaaatctgctggatatgcatcaaacaggaggtgacattgagtggctccaagattagaatttgaaaaaccggtgattgaactgcaaaccaaaatcgccgaactaaaaaaattcacccaagattccgatatggatctaagtgcggaaatcgaacggctcgaagaccgtctcgctaagcttcaggatgatatttacaaaaatttgaagccgtgggaccgggttcaaatcgcgcgtctggcggaccgtccgacaactcttgattatatcgaacacctgtttaccgacttttttgaatgtcacggagacagagcgtacggggacgatgaagccattgtcggcgggattgcgaagttccacggcctccctgtaacggtaatcgggcatcagcgcggcaaagacacgaaggaaaacctagtccgcaattttgggatgccgcatccagaaggctacagaaaagcgcttcgtctgatgaaacaggctgacaaatttaacagaccaattatctgttttattgatacgaagggggcataccctggacgagcagctgaagaaagaggacaaagtgaagctattgccaaaaacctgtttgagatggccggccttcgagtgcctgttatctgcatcgtcattggtgaaggcggaagcggcggagcccttggtctgggtgtaggcaatcacttgcatatgctggaaaactctacttattctgttatttctccggaaggtgccgcggcacttttatggaaggactccagtcttgctaaaaaagcagcagaaacaatgaaaatcactgcgccggatttaaaagaattaggtattatagatcatatgattaaagaagtaaaaggcggagcgcaccatgatgtgaagctgcaggcaagctatatggacgaaacccttaaacaatcgttaaaaactttactgaagctgagcgaagaagaattagttcagcagcgttatgaaaaatataaagcaattggcaaagtctcggttgaagatcaatatatcggggtaaactaaataaacgtgaagcctttggctcacgtttattttttgtgacattccttaaattttatttaaaaacaatttatttaattgtataataggtaaggtttcatagggaggatggagatcccttttcattgtttttagggcaatgatcatgttatgtttaatcatatatgttgctgaggtgaatggagaatgaaacgaataggggtattaacgagcggcggggattccccgggaatgaacgcagcagttcgcgcagtagtcagaaaagcgatctatcatgacgttgaagtttacggtatttacaacggatacgcgggattgatcagcggaaagattgaaaagcttgaactcggatcagtaggcgatattatacatcgtggagggactaagctttatacggcgagatgtcctgaattcaaaacagttgaaggccgtgaaaaagggatagcaaacttgaagaagcttggtattgaaggccttgttgttatcggtggagacggttcctatatgggtgcgaaaaaattaacggaacacgggtttccatgtgtaggtgtaccgggtacaattgataatgacattccgggcactgattttacaatcggtttcgatacagctttaaatacagtaattgacgcaattgataagattcgcgatacagcgacttctcatgaacgtacatatgtaatcgaagtaatgggccgtcatgccggcgatatcgcattgtgggccggtcttgcagggggcgcagaatcgatcttaatccctgaggcagactatgacatgcacgaaatcattgcccgcttaaaacgcggccacgaacgcggcaagaagcacagtattattattgttgccgaaggtgtaggcagcggtgttgaattcgggaaacgcattgaagaagaaacaaatcttgaaactagggtatctgtattgggccatatccagcgcggaggttctccgagtgctgctgaccgtgtgttggcaagccgtctcggcgcatatgcagttgaactgctgcttgaaggaaaaggcggacgctgtgtaggtatacaaaacaataagcttgtagaccatgatattatagaaatacttgagacaaaacacacagttgagcaaaacatgtatcagctttcaaaagaactgtctatctaatgtacagctgaaggctgaagatttcagaaggaagtgaaccaaatgagaaaaactaaaattgtttgtaccatcggtccggcaagtgaaagtattgaaatgcttacgaaattaatggagtcaggaatgaacgtggctcgattaaacttttctcacggagattttgaggagcacggtgcaagaattaaaaatatccgcgaagcaagtaaaaaacttggcaagaacgttggaattctgcttgatacaaaaggtcctgaaatccgcacacatacaatggaaaacggcggtattgagcttgaaacaggcaaagagctcattatttcaatggacgaggttgtaggaacaacagataaaatttcagtgacatatgaaggtttagtccatgacgttgaacaaggttcaacgattctgttagatgacggccttatcggtcttgaggtacttgatgtagatgccgctaaacgcgaaatcaaaacaaaagtattaaacaacggaacactcaaaaataaaaaaggtgttaacgtaccgggcgtaagtgtcaatcttccggggattactgaaaaggatgcgcgagacatcgttttcggtattgagcaaggagtagacttcatcgcaccatctttcattcgacgttctacggatgtgctcgaaatccgtgagcttcttgaagagcacaacgctcaggatattcaaatcatccctaaaatcgaaaaccaagagggcgttgacaacatcgatgcgattctcgaagtgtctgacggcttaatggttgcacgcggagacttaggtgtggaaattccagctgaagaagtgccgcttgtgcaaaaagaactgatcaaaaaatgcaacgcgctgggcaaacctgttattacagcgacacaaatgcttgacagcatgcagcgcaacccgcgtccgactcgtgcggaagcaagtgacgttgcaaacgcgatcttcgacggaacagatgcgatcatgctttctggtgaaactgctgccggaagttacccggttgaagcagttcaaacaatgcataacatcgcgtcccgttctgaagaagcattaaattataaagaaattctctcaaaacgcagagaccaagtgggcatgacaattacagacgcaattggacaatctgtcgcacatacggcgattaacctgaatgctgctgcgatcgtaacgccgacagaaagcggccatacagcacgtatgattgcaaaataccgtccgcaggctccgattgttgcggttactgtaaatgactctatttccagaaagcttgccctcgtatctggcgtattcgcggaaagcggccaaaatgcgagctcaacagatgagatgcttgaggatgctgtccaaaaatcattgaacagcggaattgtaaaacacggcgatcttatcgttattacagctggcactgtcggtgagtccggcactacgaacttaatgaaggttcatactgtcggcgatatcatcgctaaaggccaaggcattggacgcaaatcagcttacggtccggttgtcgttgcacaaaatgcaaaagaagctgagcaaaaaatgactgacggtgcggtacttgttaccaaaagcactgaccgtgatatgattgcatcccttgaaaaagcgtctgctcttattacagaagaaggcggtttgactagccatgctgcggtagtcggattaagccttggcatcccggttatcgtgggtctggaaaatgcgacatctattttgacagatggccaggatattacagttgacgcttccagaggcgcagtctatcaaggccgtgcgagcgttctttaattacaggtgaaaatggaaggggaatcccttccttttctctttatcatgccttttgttgaacagaacgtgttacacgtgtggggggcttggatatgagatttttgtttttgctttttattgtgtttccggcaatagaaatcggtatattcctatttttaggaaatctgattggtattttgccgacagttctattcatgattctgactggcattatcggcgcagcagctgcaaaaaaacaaggaaccgaagtgtattataaggttcagcgtgatcttcaatatggcaaaatgccgggagaagcgattgctgacggtctgtgcattttcattggcggtctattgctgatgcttccgggctttttatcagatttggccggcgcctgtcttcttatcccgtttacccgcggctggtgtaagccgattctgttcaaatggctgagaggaatgtcgaagaataagcggatcatcatcaaataaaaaacggcagccatgaaaaaacggctgccgttttatttttgctgaacggtgatataggaccatatttcttttaatgcgcctgttgtgatgaaagcttggatgatgacgagtacagccggtcccgcaatcagtcctaaaaacccgaataatttaaagccggcaaacagggcgatgagtgttgccagcggatcgatcccgatagatttacttagtatcttgggctctgtcagctgccgctgaataagaacgacgaggtacaggataccaattccgattgcttggggcagctggcccgtaatcgataaatacaaaatccagggcacaaatacggagccggcacctaagtaagggagaagatctacaagcccgattaaaaaagcaattgttgcggcgtgttcaacctttaagagagaaaggccgataaatacaatcaccatcgtgatgaaaacgaggacggcttgtgctttgataaaaccagtcattgctttttttaattcgctgctgattgctttgctgttagctgtcacacgatccggcagaattaaaacaagcatggctttcagcttatgccaatcctttgtcataaaaaaggttgccagaagagaaaaaatcagaaccgccgccgtattgggaagaagagcgaaaaatctcgggatcatctctagaatgtgggacagcaggagcccggcatttttagcggcagaatcaccgagtgtctggatatgagtgacgatggaagcctgctggttcgtttccaattcttgaaacaaaagagttaactcgttatagagcggctgaatatgagtggtaaacaatttttcgcaatatgaaataaacgtgctgatatgcggaggcagcgtttttgctagataggctgttcccgttacgatttcggctaccagaatggtgagcacgccgaaggctgcgagcagaaaaaaagcaagaacgcccagaacatttatcgttcgggggaatcctgtcactttgtccaaataatcgacaacaggatgaatcactgaagatagaataagggcgatcaggaacggataagttaacggaaacgaataataggccgcagctatcgaccctgcggtcattgatatgacaaagagggttctgaaaaaaatagtgatataagattgattcacaaaaacggtcctcctctcgtcagcatgtcctattttttatatgtattcacgctgcggctgaatatgaatacattcatcttaaaggagggatggcatgtgtttacacaagcgaatttatttttaattttactcttggctatcgcacttatcgcaaaaaaccaatcattgctctttgctgtatccgtccttttgatcatcaaaatcgttgggcttgatcagaaattatttccgaccatccagtcaaaaggcattaactggggtgtgaccattattaccatcgccgttcttgtcccgattgccacgggagaaatcggatttaagcagcttggagaagcaatgcggtcttcctacgcatggatcgcccttggagcggggatcgcagtggcgctgattgcaaaaaacggcctgaccctgcttgaaaatgatccgcatattacaactgctctcgtgatcgggaccattcttgcagtcgcgctttttggaggagttgcggtggggccgctgatcggagcggggattgcttatttagccatgcagatcgtaaaactgttcacttcataaaaaaaagcggccttaaagccgcttttttttatgcaaaaacccgcaaataaaggcgttttttcggggaaatcacagaatggaaaaaaaaattataggtaaacatttaacaaatgtctgattattgtttataatgagaataggcttaaacttaaataagcttataagaatttgttatgttctttcataagcaaagggttttagttccagcagccagtaaaatgtaagcattttctttttgggggagagaaatacttgcatcgtgctttttaagtaagcctcatgtttttacaacactcttaaaggggaaatttattgaaaaggagatgttatatatgacagcgacacgcggtcttgaaggggttgtagcaacaacatcatctgttagttctattattgatgatacccttacatatgtggggtatgatatcgatgatttgacagagaatgcaagttttgaagaaatcatctacttgctttggcatctaaggctgccaaacaaaaaagagcttgaagagttaaagcagcagcttgcaaaggaagctgccgttccgcaagaaattattgagcacttcaaatcttattccctcgaaaatgttcatcccatggctgctcttcggacagcaatttcattactaggcctgcttgacagcgaggctgataccatgaacccggaagccaactacagaaaggcgatccgccttcaggcaaaggtgcctggcctggttgcagcgttttccagaattcgcaagggtcttgagcctgttgaaccgagagaagattacggtattgcggagaattttctttacacattaaacggtgaagagccttcaccaattgaagttgaagccttcaacaaagcattgattttacatgctgaccatgagctgaacgcgtcaacgttcacagcgagggtctgcgtcgcaacactttctgacatctattcaggcattactgcagcaatcggcgcgctgaaagggcctcttcacggcggagcgaatgaaggcgttatgaaaatgctgacagaaatcggtgaagtggaaaacgctgagccgtacatccgcgctaaacttgaaaagaaagaaaaaatcatgggattcggccaccgtgtgtataagcatggtgatccgcgcgcgaagcatctgaaagaaatgagcaagcgcctgaccaacctgacaggcgaaagcaaatggtatgagatgtcgattcgtatagaagacatcgtcacatcagagaaaaagcttccgcctaacgttgatttctattcggcttctgtatatcacagcctcggtattgaccatgatttgtttacaccgatttttgctgtaagcagaatgtccggctggctcgctcatattcttgagcagtatgacaacaaccgtctgatccgcccgcgggcagattacacaggccctgacaaacaaaaattcgttccgattgaagaaagagcctaaagaaccattggaggctggcttgcgtcaatgaggttagcctcttgttcagaacatcaaaattgggttacactttaaattgaatgttaggaaaaatcattttattttctatataagaaaaataaaatgttttctaaatatgaattacatactgggaggtttttattgtggcacaaggtgaaaaaattacagtctctaacggagtattaaacgtaccaaacaacccgattatcccatttatcgaaggagacggaaccggtcctgatatttggaacgcggcttcgaaggttttggaagcagcagtagaaaaagcatacaaaggcgaaaagaaaattacatggaaagaagtttacgccggagaaaaggcttataataaaacaggtgagtggctccctgctgaaacattagatgtgatccgcgaatatttcatcgcgattaaaggcccgttaacgacacctgtcggcggcggtatccgttctttgaacgtagcgctcagacaagagcttgacctattcgtctgcttaagacctgtaagatactttactggagtgccgtcaccggtaaaacgccctgaagatactgatatggtcatcttccgtgaaaatacagaagatatttacgcaggcatcgagtatgcaaaaggctctgaagaagtgcaaaagcttatcagcttccttcaaaatgagttaaacgtcaataaaatccgtttccctgagacatcaggtatcggcattaagcctgtttcagaagaaggaacaagccgcttggtcagagctgccattgattatgcgatcgagcatggccgcaaatctgtaacacttgttcacaaaggaaacatcatgaagttcacagaaggcgccttcaaaaactggggctatgaacttgctgaaaaagaatacggagataaagtcttcacatgggctcaatatgaccgcattgctgaagaacaaggaaaagacgctgccaacaaagcgcaaagcgaagcggaagcagcaggaaaaatcattatcaaagacagcattgctgacattttccttcagcagatcttaacgcgtccaaacgagtttgatgtcgttgcgacaatgaacttgaacggagattacatttctgatgctcttgctgcgcaagtcggcggaatcggcattgctcctggagcgaacatcaactacgaaacaggacatgcgattttcgaggcgacgcacggaacggctcctaaatatgcaggccttgataaagtaaacccatcttcagttattctttcaggcgttctgcttcttgagcatttaggatggaacgaagcggctgatttggttatcaaatctatggaaaaaacaatcgcttctaaagtcgtaacttacgattttgccagattaatggacggggcgactgaagtgaaatgttcagagttcggagaagaactgatcaaaaacatggactaagcaaggaaaaagcctaaaactagccataaaggagaagagagacatgggaaatactcgtaaaaaagtttctgttatcggagcaggttttaccggagctacaactgcatttttaatcgctcaaaaagagctggcagacgttgttcttgttgacattccgcaattggagaacccgacaaagggaaaagcgcttgatatgcttgaagcaagcccggttcaaggctttgacgcaaaaattacgggaacatccaattacgaggatacagccggctctgacattgttgtcattacagccggtatcgcaagaaaacctggtatgagcagagatgatctggtctctacaaacgaaaagattatgagaagcgttacgcaggaaatcgtgaaatattctcctgactctattattgtggtgctgacaaatcctgttgatgcaatgacatacgcggtgtacaaagaatcaggcttccctaaagagcgtgtaatcggccagtcaggtgtgcttgatacggcaagattcagaacatttgtggcagaggaattaaacctgtcagtgaaagatgtgactggtttcgtactcggcggacacggtgacgatatggttccgcttgtgcgttattcttatgctggcggtatcccgcttgaaactcttattccgaaagaacggattgacgcaattgtggagcgcactagaaaaggcggaggcgaaatcgtgaatcttcttggaaacggaagcgcgtattatgcgcctgcggcttctctgacagaaatggtcgaagcgatcttgaaagatcagcgccgcgtccttcctacaattgcttatcttgaaggggaatacggctatgaaggcatctaccttggtgttcctacaattgtaggcggcaacggtcttgagcaaatcattgaacttgaactgacagactatgaaagagcgcagctgaataaatcagttgaatctgtcaaaaatgtcatgaaagtattatcctaataaaaagagagaaaggcttgcttaatacagcctttctctttttactataaatgaaagcgctatcataaacgtctttatttcttttaaaaatgatgtaaaaggcgaattgtcggaatgtcctgctttcgctaaaataaaatcatgaaacatgttaagatgacataaaatagagaaataggatgtcggggaattataatactggaggcacagcatgaacaagaaaattttagttgtggatgatgaagaatctattgttactcttttacagtacaatttggaacggtcaggctatgatgtcattaccgcctcggatggggaagaagcactcaaaaaagcggaaacagagaaacctgatttgattgtgcttgatgtgatgcttccaaaattggacggaatcgaagtatgcaagcagctgagacagcaaaaactgatgtttcccattttaatgctgacagcgaaggatgaggaattcgacaaagtattagggctggagctcggtgctgatgattatatgaccaagccgttcagtccaagggaagtaaatgcgagagtcaaagcgattttaaggcgttcggaaatagctgcgccctctagtgagatgaagaacgatgaaatggaaggccagatcgtaatcggcgatctgaaaatcctgcctgatcattatgaagcgtactttaaagaaagtcagcttgaactgacaccgaaagaattcgaactgctgctctatttaggcagacataaaggcagagttctgacaagagacctgctgctgagcgcagtctggaattatgattttgccggagatacgagaattgttgatgtgcacatcagccatcttcgcgacaaaattgaaaacaataccaaaaaaccgatctacattaaaacgattaggggattggggtataaactggaggagccaaaaatgaatgaataaataccgtgtgcgccttttttctgtattcgttgtctgtatgattctggtgttttgtgtcctcgggctgtttttacagcagctttttgaaacatctgatcaaaggaaagcagaggaacacattgaaaaagaagcaaaatacttggcttcgcttcttgatgccggcaatctgaataatcaagcaaatgagaaaatcattaaagatgcaggcggcgcgcttgatgtgagcgcatccgttatcgatacagacggtaaggtgctgtatgggtcaaacggtagatcggctgattcccaaaaggtgcaggcgcttgtttctggccatgagggtattctgtcaacaacagataacaagctttattacggactttcacttagaagcgaaggtgaaaaaacaggatatgtgctgctttccgcctctgaaaaaagcgacggcttaaaaggcgaattgtgggggatgctgacggccagtctttgtaccgcatttatcgtcattgtttatttttattccagcatgacctcacgttataaaaggtcaattgagtcagcgacaaatgtagccacagaactctctaagggcaactacgatgcacggacgtacggcggctatattaggcgttctgataagctaggacatgcgatgaacagccttgccattgatctgatggaaatgacgcgaacgcaggaaatgcagcgggatcggctgctgacagtcattgaaaacattggctccgggctgattatgatcgacggaagaggctttattaatctcgtaaacaggtcttacgccaagcagtttcatatcaatccgaatcatatgctgcgccgtctttatcacgatgcatttgaacatgaagaagtgatccagcttgtcgaagacatttttatgacggagacaaagaaatgcaagctgttaagactgccgatcaaaatagaacggcgttattttgaagtggacggcgttccgattatggggccggacgatgaatggaaaggaattgtgctcgttttccatgacatgacggaaacgaagaaattagagcagatgaggaaggattttgtggccaatgtttctcatgagctgaaaacaccgattacgtccataaaagggtttacggagacgttattggacggggcgatggaagacaaagaggcgctttctgaatttctctctattattcttaaggaaagcgaaaggcttcagtctttggttcaggatttgctcgatctctcaaaaatcgagcagcaaaatttcacgctcagtatcgaaacgtttgagccggccaaaatgcttggtgagattgaaacgcttctgaagcataaggcggatgagaaaggcatctccttgcacctgaatgtcccgaaagaccctcaatatgtatctggtgacccgtacaggctgaaacaggtatttcttaatctcgtaaacaatgcattaacctacacgcctgaggggggctccgtggctatcaatgtaaagcccagagaaaaagacattcagattgaggttgccgattctggaatcggaattcagaaagaagaaattccgcgcatctttgaacgcttttaccgtgtagataaagacagaagcagaaattcgggcggaaccgggctgggcctagcgattgtcaagcatttaatagaggctcatgaagggaaaattgatgtcacaagcgagcttggacggggaactgtctttaccgtgacgctgaaacgggccgctgaaaagtccgcctaatgtttacaaaggtttaacaatatcttcatgcactgttaaacctatgctggtaggatgtagtagaaccccttcatccaaggagccaattttgacggcgggaacctatttgtgttcccgtccttttttgtgtcttctcttatagttcacgtattttcctttcaaattgaactttgttaaaataagaggagctaatgactatgtaagagatgaatggaagcctgaggcttcttaggaggaaattgaatgacggaacgaaaaaaattagtgcttgtagacggaaacagtctggcttaccgggcgttttttgcattgccgctgttaagcaatgataaaggtgttcatacgaatgctgtatacggctttgcgatgattttgatgaaaatgcttgaggatgaaaaaccgacgcacatgctggttgcgtttgatgccgggaaaacaacatttcgtcacggcacatttaaagaatataaaggcggcagacagaaaaccccgcctgagctttccgaacaaatgccgtttatccgcgagctgctggatgcctaccagatcagccgctatgaactggaacaatatgaagcggatgatattatcggcacactggccaaatcggctgaaaaagacggatttgaagttaaggttttctcaggagataaggatttaacccagctggcaacggacaaaacgacagttgccattacgagaaagggaattaccgatgttgaattttacacaccggagcatgtcaaagagaaatatgggcttacgcctgaacaaatcattgacatgaagggtctgatgggcgattcctcagataatattccgggtgtgcccggcgtcggagaaaagactgcgattaagcttttaaaacaatttgattccgttgaaaagctgctggagtccattgacgaggtgagcggaaagaaattgaaggaaaagcttgaggagtttaaggatcaggcattgatgagcaaggagcttgcgacaattatgacggatgctccgattgaggtatctgtttccggcctggaatatcaaggctttaatcgtgaacaggtcattgccatctttaaagatcttggcttcaacacgcttcttgaacggcttggagaagacagtgcagaagcagaacaggatcaatcgttggaagacattaatgtcaaaacagtcacagacgtgacaagcgatatattggtttctccatccgcatttgtcgttgaacagattggcgataattatcatgaagagccgatcctcggattttcgatcgtaaatgaaacgggagcttatttcattccgaaagacattgccgttgagtctgaggtgtttaaagaatgggtggaaaatgacgagcagaagaaatgggtcttcgacagcaagcgggccgttgtcgctttgcgctggcagggcattgagctgaaaggagccgagtttgatacgctccttgcggcttatatcatcaacccgggcaattcatatgacgacgttgcgagtgtggctaaggattacggcctgcatatcgtttcaagtgatgaatcagtttatggaaaaggagcaaaacgggcagtgccgtcagaagacgtactgtctgagcaccttggccgaaaagcgttagcgattcaaagccttcgggaaaagctcgttcaagagctggaaaacaacgaccagcttgaactgtttgaagagctggaaatgcctcttgcgcttattcttggcgaaatggaatcaactggcgtcaaggtcgatgttgaccgtttaaaacggatgggtgaagaactgggtgcgaagctgaaggaatatgaagaaaaaatccatgagattgcgggagagccgtttaacatcaattctccgaaacagctaggcgtcatcttatttgaaaagatcggccttcctgtcgtaaagaaaacgaaaacaggctattctacgtctgccgatgtgcttgaaaagctggctgacaagcatgatattgtcgactatattttacagtacagacaaattggcaagcttcaatcaacatatatcgaagggcttttaaaggtgacgagaccggattcgcataaagtgcacacgcgatttaaccaggccttaacgcaaactggccgtctcagctcgactgatccgaacctgcaaaacattccgatcaggcttgaggaagggcggaaaattcgccaagcttttgtgccgtctgaaaaagactggctcatttttgcagccgattattcacaaatcgagctgcgggtgcttgcccatatttcaaaggatgaaaatctgatcgaagcttttactaatgatatggatattcacacgaaaacggcaatggatgtgttccatgtcgctaaggatgaagtgacatctgcgatgagacgccaggcgaaagcggtcaactttggcattgtttacgggatcagcgattacggtctgtcacagaacctcggcattacccggaaggaagcgggagcatttatcgaccgctatctggaaagcttccaaggcgtaaaagcgtacatggaagattcagtacaggaagcgaaacaaaaaggatacgtaacaacgcttatgcatcgccgccgctacatccctgagctgacgagccggaactttaatatccgaagttttgcggagcggacggccatgaatacgccgattcaaggaagcgccgctgatattatcaaaaaagccatgattgacatggctgccaagctgaaagaaaaacagttgaaagcaaggcttctgcttcaagtacacgatgaattgatttttgaggcgccaaaggaagaaattgaaattcttgaaaagcttgttcctgaagtgatggagcatgcgcttgcattagatgtgccgttaaaggtggactttgcatcaggcccatcttggtacgatgcgaaataaacagagataggaagtgatggatgtgccggaattaccagaggttgagacggtccggcgcactctgaccgggcttgtaaagggaaaaacaatcaaatcggtagagatcagatggccgaatatcatcaaacggcctgccgaaccggaggaatttgcgcgaaaactagcaggagaaacgatacagtccatcggaagacggggaaagtttttactgtttcatttagatcattatgttatggtttctcaccttcgaatggaaggaaaatacggtcttcatcaagccgaggagcctgacgataaacacgtgcatgtcatattcacgatgacggatggaacccagctccggtacagggatgtgcggaaatttggaaccatgcacttatttaaaccgggagaagaagcgggcgagctcccgctttctcagttagggccggagccggatgcagaagaatttacaagtgcgtatttaaaagaccggcttgcgaaaacaaaccgcgctgtcaaaactgccctactggatcaaaaaacggtagttggactcgggaacatttatgtggatgaggctcttttcagagcgggtgtccatcccgagacaaaagcaaatcaattatcagataaaacaatcaaaacccttcacgctgaaatcaaaaacactctgcaggaggcgattgatgcgggcggaagcacagtccgttcatatatcaactcccaaggggaaatcggaatgttccagctgcagcattttgtgtacggaaaaaaagacgagccatgcaaaaattgcggaacgatgatttcgaaaattgtcgttggaggaagaggcacgcatttttgcgcaaagtgccagacaaaaaagtagcataatgcttcattgtccaagctgtcggtgcatatatcagtaactctggattaaggatgccattttcgaaacacggatttttcactttcccatatatatgattgtgatgaatcccgggcatttcacatctgatacaagagcaccaacagaaaggaagaaacggatatgcaaatggtttctatactgctgctggcgttggctgtcagcttggacagtttttcagtcggatttacgtacggattgagaaaaatgaaaataccgtttaaagcgattttggttatcgcctgctgttccggtgctgtcatgtttatatccatgctgatcggaagctttctcacgaagttttttcctgtatatgtgacggagaagcttggcggtttgatattggttggaatcggtgcgtgggttctgtatcaatttttcaaaccggcaaaagataaagaatacctattgcatgaaaaaacactgcttaatctagaggttcggtcattaggaattgtgattcatattttgagaaaacccatgagtgcggatatcgacaaatcgggtgtgatcaacggaattgaggcggtcttattgggatttgccttatcgattgatgcctttggagcaggtataggcgcagccattctcggtttttcgccgattgtgatgagcatcgccgtggcaatcatgagctcgctgtttgtatcaattggaatcaatgccggccattttctgtctaagtggaaatggatcgataaaatggcgtttttgccggggcttctattaatcacgattgggctctggaaattgtaaaaaggagtggatctcttgaccttagtcattggtttaacgggaggaatagctagcggcaaaagcacggtagccaatatgctgattgaaaaaggaataacagttatagatgcagatatcattgcaaaacaagcggtagaaaaagggatgccggcctaccggcaaatcattgacgaattcggtgaagacatactgctctcaaatggcgatatagatagaaaaaagcttggagcgctggtatttacaaatgaacaaaaacgtctcgctttaaatgcaattgttcatcccgcagtcaggcaggaaatgctcaatcgccgtgatgaagccgttgcaaatcgggaggcatttgttgtattggatatcccgctattgttcgaaagcaaattggaatcattggttgataaaattattgtggtcagtgtgacaaaagagcttcaactggaacgtctgatgaagcgcaatcagctgacagaagaagaagcagtcagccgtatccgctctcaaatgcccttagaggaaaaaacagcaagagcagatcaagtcattgataacagcggcacgcttgaagagaccaaaaggcagcttgatgaaatcatgaacagctgggcataatacaaaaaacaccgttcatattgaacggtgttttttggccattaaaaatcaaagttgtccggatcaggaccgacgcgcaagttttcattcagtgcatcgattcggttcatgtcatcctgcgttaattcaaagtcaaatacgcttgcattttctttaatgcggtgttccttcgttgatttaggaatcgttataatgccatgctgcagatcccagcgcaaaataatttgtgcgacagatttattatatgtttgagcgatgtcagccaatacagggtgatccagcagctgtccctgcattaaaggtgaccaagcctccatctggatgccctgattttggcagtatcttatcaactctttttgtgtgaggcgcgggtgaaattccacttggttaatcataggcttaatttcagctgccgtcatcagatcttcaagatggtgaatttggaagttgcttacgccaatcgctttgatacggccttctttatacagcgtttcaagcgctctccaagcttctttatactttccttctacaggccagtggatgaggtatagatccaaataatccagaccgagtttggacagacttgtttcaaacgcggcgagtgtttcttcgtagcctaaatccgcattccatactttcgatgtgataaacagatcctctcttgaaatgcctgcttcttcaatgccttcccgaatcccttctccgactccagcttcatttccatagattgctgcagtatcaatactgcggtacccgtgaacaatggcagttttaactgcgtttaccagttcagatccttcttccacttggaacacgccgaggccgaaccaaggcatttctaccccattatgaagtgttgcttttgcttgtaaatgtgttgtcatgtttatttcctcctttaaaattgtcaggcttcctgccgatctcgtttttccatcaagcggctccagcctgttaaaatgactgcaccgaccaccattaatccgcctatccaagcggtatgaatcaatccgattgaatcggtgatcacaccgccaaggtatgacccaagcgcgatccctgcattaaaggcagcgatattcatcgcggatgcgacgtcaactgcactcgggacaaaacgctcagccagcatgacgacatacacctgaaggccgggcacgttcataaaggccagcaatcccatacagagaatggtaatgagccctgctgcttgatacggggctgtaaatgtcagtacgaatagaacgattgcctgtacgataaacatatagaataaagcggcaatcggatttcggtttgacagctttccgccaatcatattgccgatagcaatagctattccgtatccgagcagaatcactgcaacagtcccggctttgaagcctgttacttcctgaagcaggggagacagatacgtgaacacaacgaatgttcctccgtatccaagcgctgtaatgacaaataaaagcaataaccggctgtttgtcacaagcttcaattgatcccgcatcgttgttttcgtcccttttcgtaatttggacggtacaagaatgccatttgtaatgaaagcaatgattccgacggcgataatgaccataaaggcgaaacgccagccgaactgctggccgataaatgtcccaaaaggaactccggttacagttgccacagtgaggccagtaaacataattgaaatcgcgctagcccttttatcctccgggacaatatccgctgcgattgtcgaaccgatcgacataaacacaccgtgcgaaaatgccgatatcacacgtgctgctagtaaaatcccgatgcttgaagcggttgctgccatcgtattaccggcaataaaaataaacatgatccaaagcaatagtgtcttacgtgacatgcttgaggtcaatgaagttaatataggtgccccaaatgtaacgccgagcgcataaagggaaacggtcaatcctgctgtcgtgacgggaatatccaggtcatcagcaatgagcggcaaaaggccgacactgataaattcagttgtccctattgcgaatgcacttacggccaaagccagtagtgcaggaatattgcttttattggctgaagtcatgatgttcctcctttgtaagatgtgttgtatgattgaaattctgccgagtaagctatataaataaaaaagagcagattcaaatcagccggcaaatgtgattatgaaacatatcgttaagaaataaaagtacgtactttgaagtgctatagtcactttttggtgcctgtgaggagaatggattgtatggagaagaaaaaatataacatttctgttgaagcgactcttgaagtgatcggtgggaaatggaaatgcgtcattttatgccatctgacgcacggaaaaaaacgcacaagtgaattaaaacgcctaatgcccaatatcacgcaaaaaatgctgactcagcagctgcgcgagctggaagcggacggtgtcattaaccgaatcgtatataatcaagttcctcccaaagtggaatacgagctcagcgaatacggccgcagcttagaagggattttagatatgctgtgtgcttggggagcgaatcatattaacagagtgtacggggatacattttctgtgctagaagaaagtgtgctcaatgataagttaaaacaggaatcataaagcatgagggcagtcagtgcggagcgctggctgctttttggttcttacgcctgatattctgtgcaagaaaacataagatgcatcataaattagcgttataatcgttgatttttatcaatatgtactggcgaatttgttttaatgtgttatactaattttagatagtaacaaattaggatggcataattgataaggggtgtccaacatgaaggtaaaagtagcgatcaacgggtttggaagaatcggaagaatggtttttagaaaagcgatgttagacgatcaaattcaagtagtggccattaacgccagctattccgcagaaacgctggctcatttaataaagtatgacacaattcacggcagatacgacaaagaggttgtggctggtgaagatagcctgatcgtaaatggaaagaaagtgcttttgttaaacagccgtgatccaaaacagctgccttggcgggaatatgatattgacatagtcgtcgaagcaacagggaagtttaatgctaaagataaagcgatgggccatatagaagcaggtgcaaaaaaagtgattttgaccgctccgggaaaaaatgaagacgttaccattgtgatgggcgtaaatgaggaccaattcgacgctgagcgccatgtcattatttcaaatgcgtcatgcacgacaaattgccttgcgcctgttgtaaaagtgctggatgaagagtttggcattgagagcggtctgatgactacagttcatgcgtatacgaatgaccaaaaaaatattgataacccgcacaaagatttgcgccgggcgcgggcttgcggtgaatccatcattccaacaacaacaggagcggcaaaggcgctttcgcttgtgctgccgcatctgaaaggaaaacttcacggcctcgccttgcgtgtccctgttccgaacgtctcattggttgatctcgttgttgatctgaaaacggatgttacggctgaagaagtaaacgaggcatttaaacgcgctgccaaaacgtcgatgtacggtgtacttgattactcagatgaaccgctcgtttcgactgattataatacgaatccgcattcagcggtcattgacgggcttacaacaatggtaatggaagacaggaaagtaaaggtgctggcgtggtatgacaacgaatggggctactcctgcagagttgttgatctaatccgccatgtagcggcacgaatgaaacatccgtctgctgtataaaataaggtcatggacacattttaaagaaaaaacccttaacagcatatttctgaaaaaacgcaccttgcaaattagacttaaacacagtatactatttttcgtgaacttcttgcttgagactgtttcggaattacttaaagggttaggacctctccggactaactttcccccgtggtaaatggccgacccagttgttggaatttcactttttaattcttgttaaggggggtccatgactatggaaacaatggggcgtcacgttatctccgagctatggggatgcgattttgataagctgaatgacatggattttattgaaaaaacgtttgtaaatgctgctctaaaatcaggtgctgaggtgcgcgaggttgcatttcacaaatttgcaccgcaaggcgtaagcggagttgtgattatttctgaatcacacttaacgattcacagttttcctgagcacggatatgcgagcattgatgtttatacttgtggagacttagatcctaatgtcgctgctgattacattgcagaggcattacatgctgatacaagagaaaacattgaaataccaagaggaatggggcctgtgcaaattaaacaggcgcaagcgaaagtactataaagtaaattgcgaacacaaagggagctgaagctagaaagccattatgcgctttttagcttatgctcctttattttataaagaa

SEQ ID NO: 49 - DNA, 146295 bp, Bacillus subtilis WAUSV36
ttttagcttatgctcctttttatttttataaagaaacgagagtgtcagctttttcttttttcattttttttgtaaaataagaaggagattttcacaaaccacctaatgctatagaaacaaatttaacaacggctctcccgacagatgctgtcacatctattttttaaaaggcggaggctgccgaaaatacattgcagggaacgatatagttgggagctgattttattgaaatgtccttcatgccagcataacggaacacgagtccttgattcacggcctgtggatgacggaaagtcgattcgccgaagacgcgagtgcgaatcctgccactaccggtttacgacctttgagaaagtggaggaaaccccgctcatcgttgtgaaaaaagaaggtgtgcgtgaggaattcagcagagaaaaaatgctgcgcggcctcataaaagcatgtgaaaaaaggcctgtttcactcaaaacgcttgaagacatgtgctttgatattgaaaaagaacttcgcaatcaaggctgctccgaggtgaagagtgagctcgtcggagaaatggtcatggaccggctggctaagattgacgaagtcgcatatgtgcggttcgcgtccgtctatcggcagtttaaagatataaacgtctttatcgatgaattaaaagacttaataaagaaagagcgttaaaagagctaagaggattcttctagctcttttctcatgtgcaaaattggcatttgatagatataagaaacggtgtaaaatgaaaggtagaaacaaattcggaaggtttgagaatgtatggctgactattggaaagatgtactgcctgtagacccgtatgtggttaaaagcagatcgatgctgcaggatattgacagacaaattattacacaactgtaccagcccttaatcggccctgttgcattctctctttatatgacattgtggggagagcttgaacaaaaccgtctgtggggcggagagtccacacatagacagctgatggggatgacacagtccaacttaaaaacgatccatcaggaacaggggaagctcgagggcatcggattgctgaaagtatatatgaaagaatccgagcggcaggagcgcctctttatatatgaactccttccgccgctcagaccaaatgaattttttgaagacggaatgctgaatgtttttctgtataatagggtcggaaaaacgaaatatcagcaattaaaacaattttttacgcacccggccatttcagaagatgcgaaggacattacgcgtccgtttaatcatgcgtttgaatcgctgcagccgagtgaatggaagctcacatccgatatggaggaaacggtaaggcttgccgaggggtccgagtatacttctgtcggacagtctccgtcctacaccataacggaggatgtgtttgattttgatttgtttttagcgggactttctgagacgatgataccgagaaaagcgatgacccagcaggtgcgggacacaatcaaaaagctttcttatctgtacggaattgaccctttgcaaatgcaaaatgttgtgatgagcgcaattgatgagcgtgacgtcattacgacggaggcattaagaaaagcggcgagcgactggtatcaaattgaaagaaacggacagctgcccgatttggtggaaaaaacacagccggtgcatctgcgtgaaggcgaacaaccggcagaagaggattctctggatgggaagctgattgcattgctggaggcgatttccccgaagaagcttctgcaggacattgctgacggaacagagccgtcaaaagctgatctgaagatcatagaagaaattatgttcgaacagaagctcgagccaggcgtcacaaatgtgttaatttattatgtcatgctgaaaaccgacatgaagctgtcgaaaaactatatccaaaaaatcgcttcgcattgggcacgcaaaaaggtgaaaacggtcagggaagcgatgaagctcgcaatagaagaaaaccgccagtatcttgaatgggctgagggaaaaacaaagtcttcgaaacgaaaccaaaaagtgattcgtgaagaaaagcttcctgattggatgacagaaaaggaaacagcgtccgattcagaatccggacagcagaagctgcatccgcaggatttggaagaacagaagaaaaagatgatggaagaaatgcaaaaactgaaaaaatactctgcctattaaagacagagatgcggggtgaaggaatagatggaaccaatcggccgttccctgcagggcgtaaccggcaggccggatttccaaaaacgtcttgaacaaatgaaggaaaaagtcatgaaagatcaagatgttcaagcatttttgaaggaaaacgaagaagtgattgaccaaaaaatgatcgaaaagagcttaaataagctttatgaatatatcgaacaaagcaagaattgctcctattgttcggaagatgaaaactgcaacaatttgttggagggctaccatccgaagcttgttgtcaatgggaggtctattgatatcgagtattacgaatgtccagtcaaacggaagctcgaccagcagaagaaacaacagtctcttatgaaaagcatgtatatccagcaggatcttcttggagcgacgttccagcaagttgatatcagtgacccaagcagactcgcgatgtttcagcatgttacagacttcctgaaaagctataatgagacgggaaaagggaaaggattatatttatacgggaaatttggggtaggaaaaacgtttatgctcgctgcaattgccaatgagctggcggaaaaagagtattcctccatgattgtttatgtgcctgaatttgtgagagagcttaagaattcgctgcaagaccagacattggaagagaagctcaatatggtaaagaccacacccgtattaatgcttgatgacatcggagcagaatcaatgacaagctgggtaagggatgaggtcatcggaacggtgcttcagcacagaatgtcccagcagctgccaacgttcttttcttctaatttctcacctgacgagctgaagcatcattttacgtattcgcagaggggagaaaaagaagaagtaaaagctgcaagattaatggagcggatattatatttggctgctccgatccgccttgacggagaaaaccgccgacatccataattgctgtggttcaaaggggaaggaactgagggtatgaaacgaaaaacggctgtcaaatggctggcagtgcttgcaggtgctggtttactctattggggaaataaaacgtatttgaatgtatcgccgaaagaaatcagggtatgggtattgtcgttcggagtctttgcacctctgatgtttatcgggatatccatcgtcaggccacttgttttatttccggtgtctgttatttcaatagctggcggacttgcgtttggcccgcttctcggcacgctttatacgttattcggttcgatgtgcgcttcagctgtttcgttttttgcggctggtttgttttcggcgaaaaagaacgggcattacgaaaggcttgaagccatacagaagcaaatggaggataacggatttttctatatctttcttttgagaatcctgccgatcaattttgatttcgtcagctatgcggcaggcctttccaatgtcaaagcgctgccgtattttgccgcaacggctgtgggaatcatccctgggacgattgcgcttaatgtgctgggtgcgagctttttggctggcaatctgcccgctttctttatggtgctcgctttgtatatcgtgtttatctcattgccgttcatcttcagaaagaaaatgcaaaacttgttccaagaatcaaattaagatttgccaatgacctttacgtctattttaaaaacatcccccatatacttgtaacagatgccgtaaggggggacaaacatgcttgaaataatctttgaagatgaccatgatgcagccgcttttttacatctcattcagcattcggacgatcggaacaatatcattgtccgtgaaggcatacgaaaaatcgggattgaaaaagcgaatccggcttttcctattcagcgttttatggagccgattctggtcaaattttttttggaatgcaaagaagacgagcatatgctgtcattgattgaggaaacgtattgtttcacggaccaggatgaacagcagcaaatccttcagctcgcacacagtattattgaaggtgaagcagacgatcttccgtttgagccgctgaagctttcacggaaacaatcaattttggatgaactccaaacgatctgtttagaggaaggagtattttacattcgctcctttcagaccttccgacttggatcatactataagcagctgagagatattacagaagcagcgattgatgaatataagatggaacaggaatatcaaaactttattcaaacactcagagactatgtggacgccaaacagccgcgaatcaaaaaagtgcatattgtccatgatggttcctttacattatgggagctgcgctatgtgccggaacgggaaaaaatgaaatacatagacagaagatttgtccgggatcatcctatgtatattgattctcatttgctcgcgccgctgatttccattgcgcctgatgaagtcgtgctttataccgaccagcccgagcacatgatggcaaggaccattcaaaacgtatttcaagagagagtggaaatgctcccgctgcatgcttttacagatgcagaaataccggtgaagcactcggaaggatgagggccggcagcctgtctatttaaggctgtcggtttaaaaaaaggaaacgcgatcgtgttgattttttggattgaacaatttataatacataggagattaagaaagacacacgtattgataaggacacgaaggaatgataccggctcaaagagagggaagccctggctgcaagcttcccagctaaggaccattcgctttaccgcctttgaacttcagctgtgaacctcttgaaaaggaacagtaatggctgacgggaactcccgttacagagcttagagccgcaggtgccgtgtattggctttgcggaaaaaagggtggaaccacgattccgtttattcaacctcgtccctttcatagggggcggggtttttatatgcaaaaaaaggagtgacaaagatgtcagatatggtaaaaatcacatttcctgatggagcagtcaaggagtttgcgaaaggaacaacaacagaagatatcgcggcatccatcagtccgggattaaagaaaaagtcattagccggaaaactgaacggaaaagaaatcgatttgagaacgccgatcaatgaagacggtacagtggaaatcattacagaaggctcagaagaaggtcttcaaattatgcgccacagtgcggctcacttgctggctcaagcgattaaacgcatctacaaggatgttaaattcggcgtcggtccggttatcgaaaacggtttttactacgatgtagaaatggacgaagcgattacaccggaggatctgccgaaaatcgagaaagaaatgaaaaaaatcgttaatgcgaaccttccgatcgttcgaaaagaagtcagccgtgaagaagcgaaagcccgttttgcggaaatcggcgacgacctgaagcttgaactattggatgcgattcctgaaggagaaaccgtttcgatctatgagcaaggcgaattctttgacctgtgccgcggcgtccatgttccttcaaccggaaaaatcaaagaatttaagctgttaagccttgcaggcgcatactggcgcggtgacagcaaaaaccaaatgcttcagcgcgtatatggtacagctttcttcaaaaaagctgatcttgaagagcatcttcgtatgctagaagaagcgaaagaacgcgaccacagaaagcttggcaaagaattaaagctgttcgcgaactctcaaaaagtcggacaaggcctgccgctttggctgccaaaaggcgcaacaatccgccgcgtcatcgagcgctacattgtcgataaagaaatcagcctcggctatgagcacgtatacacacctgtgctaggcagcaaagagctgtatgaaacatcaggacactgggatcattatcaggaaggcatgttccctccgatggaaatggacaatgaaacacttgtattgcgtccgatgaactgtccgcaccatatgatgatttacaaacaagacattcacagttaccgcgagcttccgattcgtattgcagagcttggaacgatgcaccgctatgaaatgtcaggtgcgctgtcaggacttcaacgggtacgcggaatgacgttaaatgatgcacacatctttgtgcgcccggatcaaattaaggatgagtttatccgtacagtccgtttaatccaggatgtttatgaagacttcggtttaagtgattacacattccgtctgtcttaccgcgatccggaagatacagagaaatattttgatgacgatgaaatgtggaacaaagcgcaatccatgctgaaagaggcaatggacgaaatcggccacgactattacgaagcagaaggtgaagcggcattctacggacctaaacttgatgttcaggtgaaaactgcgatcggaaaagaagaaacactgtctacggttcagcttgatttcttattgccggaacgtttcgacctgacatacatcggtgaggacggcaagcagcaccgtccggttgtcattcacagaggtgtcgtttcaacaatggaacgctttgttgctttcttaatcgaagaacacaaaggcgcgctgccgacatggcttgcaccggttcagttccaagtcatcccggtttctccggctgtgcatttagactacgcgaaaaaagtgcaggaacgcctgcaatgtgaaggcctgcgtgttgaagtcgacagccgcgatgaaaaaatcggctacaaaatccgtgaagcgcaaatgcaaaaaatcccgtacatgctggtggtcggtgaccaagaagcagaaaacggagcggtaaacgtgcgtaaatacggagaacagaactctgaaaccatttcacttgatgagtttgtgaaaaaggcagtagctgaagcgaaaaaataaaataaaaaagcatgatctcattgaagagatcatgctttttttatttctctaatataggaaacaaatcatgaaggctgctgatgatgtaatcaggctttacgtcagtttcgtttttcttatcagtccggttgatccaaacggttttgattccggctcttgaagcgcctaaaatatcagtattcaaattatcgccgaccatgatggcatcgtctttttcaatattcatcagcttaaggcagtgttcaaaaattgaaacatccggcttgcccttgccgaatgcgcccgagatgacgatttcattgaagtaaggagcgagctcaggcacgccggcaagcttctccttttgcagactaggatcgccatttgtcaaaagcaataattcatacttgccttttaattgatcgagtacagcaaaagtttcatcatatacaaacgggcgctttctgcgctctgccgcaaaaaactctcccaagtattcgccatatgcaggatcatcgatcccaagcgctttcagtccgttggtccatgcatttcttctgtactccggcacaatcttgttcagcttttgaaagccttcactgattggctctgagaaattggaccacagtccttcaaacgggttaatgccgatcatcactgtatatggatacgtctcatatgacatgtacaattctctcgccgcttcgcgaacagctgcttcgaattcctcaggggcaaggccatattttttctccgcctgtaagcaagtttctgcaaatgttgttctgacgcttttttcgtcccaaagtagtgtatcatctaaatcaaaaaatacggctttcatgatcttctcctctgcttcagattcaaatctttctgccaaaaggctcatgttttattttacaatagataaaagccttgtgaaatatgttttcagacgattttaaaaaaacagtcagccgcaaaacgaaaacatgctagaatgaaaacggaaagaacaggtgacatgaatgattcatttaatgattatgatgctggagagagtggggattattgttatattagggttcattctcgcccatacgaaacttttcagacaagctcttcagaatcaggacggctataaaggaaaagcgattttaatttctattttttctcttttcagcatcatcagcaattatacaggcatcgaaattcaaagaaatatgattgtaaacaatgactgggtgtttacgatagatccatcgggctctatcgcgaatacccgtattttgggcgtggaaatcgggggccttctcggaggtccttttgtaggggctgggatcggcatacttgcgggcctgcatcgtttttcactcggtggcagcacggccttaagctgtgccgtctcatctattttagcgggtgttcttgcaggcttgatcggcaggtattttacgaagcgatatcgaatgccgacaccgcgcatcgccgctcttgtgggaatcggcatggagtcactgcaaatgatcattattttgctgatggcaaagccgttcagtgacgcttgggagcttgtcagcatgatcggaattccgatgatactcatcaatggaacaggcagttttatttttctgtctattattcaagcgatcattcgcaaggaagaacaggcaagggctctcgaaacgcatcgagtgcttacgattgctgatcagacacttccatttttccgccaaggattaaatgaaaactcctgtaaaagtgtagcggctattatccataagctgacaggaacagatgcggtgtctctcactgacaaagaaaagatccttgcgcatgtcggtgcgggaatggatcaccacatcccatcgaaaagcttgatcaccggcctgtccaaaaaggtgattaaaacagggcatattatgaaggcgatttcgcaggaagagattgaatgcacgcatgctgaatgccctttgcacgctgcaattgtcctaccgctgacatcgaacggcaatacaatcggcaccttaaaaatgtactttaaaagcccggcaggcctgagtcaggtagaggaggaacttgccgaggggctggccatgctgttttcgacacagcttgagcttggggaagcagagctgcaaagcaaacttctcaaggatgctgaaattaaagcgcttcaagcacaggtgaatccgcattttttatttaatgcgatcaacacgatttctgcgttatgccgtacagatgttgaaaaaacccgtaagctcctattgcagctcagtgtttattttcgttcaaaccttcaaggagcgagacagctgctgattccgctctcaaaggagctgaaccatcttaacgcctatttgtcattagaacaggcgcgttttcccgggaaatataaaattgagcttaatatcgacagcagactggagcagattgaaatccctccgtttgttttgcaggtgcttgtcgagaacgcgcttcggcacgcgtttccgaaaaaacaagacatatgcaaggttacagtctgtgtcttatctgatgatgcatccgtctatatgaaggtggcggataacggacgcggaattccgccggacgtcttgccggaactggggaagaaaccgtttccgtctaaggagggaaccggtacagcgctttataacctaaatcagcggctgatcggtttattcggacagcaggctgcactgcatatcagcagtgaggttcataaagggacagaggtttcctttcaagtgccaatgcaacagatgaaagagggagaagaacatgctcagggtgttaatagttgatgatgagatgctggcaagggatgaactggcttacttgcttaagcggaccaatgatgaaatggaaatcaatgaagcggaaaatatcgaatccgcttttgaccaaatgatggatcaaaaacctgatttgctgtttttagacgttgatttatccggagaaaacggttttgatatcgcaaagcgattgaagaaaatgaagcatcctcctgctattgtgtttgcgacagcgtatgaccagtatgcgctcaaagcgtttgaggtggacgctcttgattatttaaccaagcctttcgatgaagaaagaattcagcaaacgctgaaaaaatataaaaaagtcaatcgggatattgtagaaacagagcaaaacagccatgccggccagcacaagctcgcgctatctgtgggggaatcgattgtgattgtggatacgaaggacattatctatgccggaacagaagatggtcatgtcaatgtaaaaaccttcgatcattcttatacggtcagcgatacactcgttgtgattgagaaaaagctgccggattctgattttatccgcgtccatcggagctttgtcgtgaatactgaatatattaaagaaattcagccatggtttaattcaacgtataatctgatcatgaaagacggatcgaaaataccggtcagccggacatatgcgaaggaattgaaaaagctgctccatatttgatgggcggctttttgcatttcagccatttgattctgcaactcagacccgctatacggcatgttatcttgtaagcgctttataacagggaattcttatttataatgagggtaccaaagagaaagaggtgaagaaaatgagtgctaaaaaagtgtacgggtttttaacacaagcatttatttttgccgtcattatgctggtttcaaatatgattgccgctattgtcccaatacctatcccggcatcggttgtagggttggtcttattatttctcctattatgtttgaaagtcattaaactggaacaagtggagacgctcggaacgtctttaacctctctgatcggatttttatttgttccatcaggtatatctgttatgaattcgcttggtgtgatgcagcaatacggcctgcaaattgttcttgtcattctgctcgcaacgattattttgctgggggctacgggattgttttctcagctgattctgtcgctgagcggaaaacgcaaaaccgaagcggacatgaaaacaaaaacagtgcaaagcccgcagaacaataacgaactcgttcaccattaagggaaacaggaggttcttcacatggaaagcacaatgagtccttattttgggattgtcgtatcacttgctgcattcggcatcggcacctttttatttaagaaaacgaaaggcttcttccttttcactcctttgtttgttgccatggtgctggggatcgcatttttaaaaatcggcggtttttcctacgcggattataataacgggggagagatcattaagttttttcttgaaccggcaacgatcgcatttgcaattcctttgtacaaacaaagagataagcttaaaaagtactggtggcaaatcatggcctccattattgccggctctatctgctctgtcacgattgtttatctgctcgctaaaggcattcatctcgattcggccgtaatgaaaagcatgcttccgcaggcggctacaacggcaattgcgcttcctttatcaaaaggcatcgggggcatcagcgacatcacagcctttgcggtcatctttaacgctgtcatcgtatatgcgctcggagcattgttcttgaaggtgtttaaagtgaaaaatccgatttctaaaggattggctcttggaacatccggacatgcacttggtgtagcggtcgggattgagatgggagaagttgaagctgcgatggcaagtattgctgttgtcgtagtaggagtggtaacggttctggtcatccctgtgttcgtgcagctgatcggaggataagccaaggctgaatgccttggctttttttattttatggtgcgtcttcgggatcgatatacccttgtttaatgccccattctacttgatcgtcatgccacttttttcgttcttcataaccataaccatcgtcatcaggaagctctgaagctggctgttgaatggttttatctgtctgactcgaggaagatggtggatcttgactattagatgagggtgcctcagtctgctgccgttgtgcctgcgattgccgctttttctcagcgttcgctttctgctctttttggattgctgcctgccgctgtctttcaagttcagcttgtctttccgcttcggctaatcgctgtctctctgcagcctgctgctctgctaatcgctgtctctccgctttttcctcctgctgtttctttcgtttcgcctaccgctctttttcaagctttttctcagcggcgatttgtctttgcttttcagcttcctcttttgccttccgctttcctaactcggtagcgagtggactctcgaacttcatgtccaatgaaacgggttttagtttttttagctctttctccagctccttttgaggaaatgctgccgttgtcttaacagtggtttcgacttttgattcggaagatgtgctgctattcgagcaaccggttaacatcaatgtgaaaaataaagcaagctgtatcagtttgttcatgtgtcaggctcccttctgctccttatatcggtcagagattaactttgttttacatttcttcctgtcggtggttttgttgtaaattgcgtaataagggggaattgttggttctttgtattctgggtggggatgaaagattttctttttctctcttgcgctcatagaaaacccatgttacaatgtaaaagttgttccggataagtcgtccttgactaaagatccggtattgtgtagaatagttattgaattgaatataaatcacaagcagaagcacccgcttctcacctgattgacacatgcatgtagttggcaggttgaccgtacatttttattgatacagatgttcgtagtgtgggtgttttataatgcccacactttttgtttgcctgcaaaatgcattcaaaatgagttgtgaatcaattcgaagaaactatggaggtggctcattattagcaaagatcaattggttaatgagggtatccgtgcacgtgaggtccgtttaatcggacaaaatggcgaccagcttggaatcaagtcccgtcaggaagcacttgaaatcgccggccgcgcaaatcttgaccttgtgttagttgcagcgaatgcaaaaccgcctgtctgccgaatcatggactacggtaagttccgatttgagcagcagaaaaaggaaaaagaagcacgcaagaatcaaaaaatcattaacttaaaagaagttcggttaagtccgacaatcgatgagcatgactttaacacgaaattgcgcaatgcgattaaattccttgaaaaaggcgataaagtgaaagcttctatccgctttaaaggacgcgcaatcactcataaagaaatcggtcagcgtgtattagaccgtttctccgaagcatgtgctgaggttgcgacagtcgaaacaaaaccaaaaatggacggccgcagcatgttcttaatgctcgcaccgaaaaacgaaaagcaataaggaggaaatcccatgccaaaaatgaaaactcaccgcggatctgctaaacgttttaaaaagacaggttctgggaagttaaaacgttctcacgcgtacacaagtcacttattcgccaacaaatctcaaaagcaaaagcgtaagcttcgcaagagtgctgttgtaagcgcaggagacttcaaacgtatcaaacaaatgcttgctaacatcaagtaatcggataaggaacaattaggagggaaattcaatgccaagagtaaaaggcggaactgttacacgtaagcgtcgtaaaaaggttcttaaattagcaaaaggttatttcggttcaaaacatacattatacaaagtagctaaccagcaggtcatgaaatctggaaactatgctttccgtgaccgtcgtcagaaaaaacgtgatttccgtaaactttggatcactcgtatcaacgcagctgctcgcatgaacggcctttcttacagccgtttaatgcacggtcttaagctttctggtatcgaagtaaaccgtaaaatgcttgctgatcttgctgtaaacgatcttactgcattcaatcagcttgctgatgctgctaaagctcaattaaacaagtaatcatatagagccgctctccagcagagcggctttttctatataaaggatgaggcaacatgattattgctgcttatttggtgttgattaatctgtgcggtttttgggtgatgggcattgacaaacgcaaagcgcagcagcacaagtggagaatttctgaagaccggctgtggctgatagccatcgtgtttggagcgctcggtgtctggcttggcatgcaaaccttcagacataaaacgaaacacgcttcttttaagtacggagtaccgcttcttctggtaatagaagcgattctcatcgctatttactacagcccgtttgatttataaaaagcagaaaagcgtttaacgctcttctgctttttttgcgagtttaatgggctggtcccagtcaatcttacaatttggatatcgttccagcactttttcttcaatgttctcaaaatcttttgcagagaaatgtttcagcttctcaggagattctgtccagacaaagatcgtgtgaataaacagcggatgatccttggaaggaatatgcttttctccctcaaaaagcacgcctttatacgtcagctgaaaattcttccgggtattgttttgttcatcaataatataaaaatgttcttttgattgggccagcttaagccttctcttaggattcgcgacatatttgaccacggcataaatacaataagcaaaaagtgcaagcaaaataatccttagaaccatgacaaacattgtgtgaaggcacctcccttatggtgatgatctgatgtaatacgaaaagcatagaaaaaggtttcactttttctaaaagaaagctgtaaaaacatatacccgattttcaagtgaaatagtcgtatggttagcgccatgttttgtataataagaatgcaggactgatgaaggagggtttggaacatggcaaaattagatgaaacattgaccatgctgaaagatttaacagatgcaaaaggcataccgggcaatgaaagagaagtaaggcaagtgatgaaatcatacatagaaccatttgctgatgaggtgacaacagatcgcctgggcagtttaattgccaaaaaaactggtgcagaaaacggcccgaaaattatgatcgccggacatttggatgaagtcggctttatggtgacacaaatcacagataaaggctttatccgttttcaaaccgttggcggctggtgggctcaggttatgcttgctcagcgcgtcaccattgtcacaaaaaaaggagaaatcacaggggttatcggatctaagccgcctcatattttgtctcctgaagcaagaaaaaaatcagtggaaataaaagacatgtttattgatattggagcttcaagccgggaagaagccttggagtggggtgtacttccgggagatatgatcgttccgcattttgaatttacggtcatgaacaatgaaaaattcctactcgcaaaggcctgggacaaccgcatcggctgtgcgattgctattgatgtgttaagaaacttacaaaacacagatcatccaaatatagtgtatggcgtcggaaccgtgcaggaggaagtcgggctgaggggagcgaaaacggctgcacacaccattcagcctgatattgcgtttggtgttgatgtagggatagcaggagacacgcctggcatttccgagaaggaagcgcagagcaaaatgggcaaaggcccgcagattatcgtttacgatgcatccatggtctctcacaaaggtttgcgcgatgcagttgtagccactgcggaggaagccggcattccgtaccaatttgatgccattgccggcggcggaactgattcgggtgccatccatttgacggcaaatggcgttcctgcgctgtccattaccattgcaacccgctacattcatacgcacgcggccatgctgcatcgtgatgattatgaaaacgcggtaaagttaattacagaagtcattaagaagttagaccgaaaaacggttgacgaaattacgtaccaataaagatacggaagaatccgcctattgaggtggattctatttttttgtctgtacaaattacagcatagtgactacaataaaggggataccgaaaatttcctgaacatgacgatatacgatacgcagtcgatttgacaggaagggaggataaataatctaatttgtaagcgctttctaaaataaaggaggttgaacaaaattgaaaaagaaaaaacatggaaacgcttcttacacttttcgagtgcagctctggctgcaggtttgatattcacttctgctgctcccgcagaggcagcgttttggggtgcatccaatgagctgcttcatgacccgactatgattaaagaggggagctcatggtatgcgctcggaacagggcttactgaagaacggggactgcgggttttgaagtcttcagacgctaaaaattggaccgtacaaaaatccattttcactacaccgctatcgtggtggtccaattatgtgccgaattatggccaaaaccagtgggcgccggacatccaatactataacggcaagtactggctatattattccgtttcttcttttggaagcaatacatctgccattggcctggcatcttcaacaagcatcagttcggggggctggaaggacgagggcttggtgatccgttcgacaagctcaaataattataacgccattgatccggagctgacattcgataaggatggcaacccgtggcttgcattcggctcgttttggagcggcattaagctgactaagctcgataagagtacaatgaagcctacaggctcgctctattcgattgcagctagaccgaataatggaggtgccttagaagctcctactcttacgtatcaaaatggatattactatttaatggtttcatttgataaatgctgtgacggggtaaacagtacgtacaaaattgcttacggaagatccaaaagcattacaggcccttatcttgataaaagcggaaaaagcatgcttgaaggcggaggcaccattttggattcgggcaatgaccaatggaaaggacctggaggccaggatattgtgaacggaaacattcttgttcgccatgcctatgatgccaatgacaacggcattccaaagcttctcatcaatgatttgaattggagctcgggctggccgtcctattgaattaaaaagccgggctctgcccccggctttttttaaaagaaaagattgacagtataatagtcaattactataataaaattgttcgtacaaatatttatttataggtttattttctatcattagtacgtatcttttgtatttgaaagcgttttattttatgagaaaggggcagtttacatgcttcagacaaaggattatgaattctggtttgtgacaggaagccagcacctatacggggaagagacgctggaactcgtagatcagcatgctaaaagcatttgtgaggggctcagcgggatttcttccagatataaaatcactcataagcccgtcgtcacttcaccggaaaccattagagagctgttaagagaagcggagtacagtgagacatgtgctggcatcattacatggatgcacacattttcccctgcaaaaatgtggatagaaggcctttcctcttatcaaaaaccgcttatgcatttgcatacccaatataatcgcgatatcccgtggggtacgattgacatggattttatgaacagcaaccaatccgcgcatggcgatcgagagtacggttacatcaactcgagaatggggcttagccgaaaagtcattgccggctattgggatgatgaagaagtgaaaaaagaaatgtcccagtggatggatacggcggctgcattaaatgaaagcagacatattaaggttgccagatttggagataacatgcgtcatgtcgcggtaacggacggagacaaggtgggagcgcatattcaatttggctggcaggttgacggatatggcatcggggatctcgttgaagtgatggatcgcattacggacgacgaggttgacacgctttatgccgagtatgacagactatatgtgatcagtgaggaaacaaaacgtgacgaagcaaaggtagcgtccattaaagaacaggcgaaaattgaacttggattaaccgcttttcttgagcaaggcggatacacagcgtttacgacatcgtttgaagtgctgcacggaatgaaacagctgccgggacttgccgttcagcgcctgatggagaaaggctatgggtttgccggtgaaggagattggaagacagcggcccttgtacggatgatgaaaatcatggctaaaggaaaaagaacttccttcatggaagattacacgtaccattttgaaccgggaaatgaaatgattctgggctctcacatgcttgaagtgtgtccgactgtcgctttggatcagccgaaaatcgaggttcattcgctttcgattggcggcaaagaggaccctgcgcgtttggtatttaacggcatcagcggttctgccattcaagctagcattgttgatattggcgggcgtttccgccttgtgctgaatgaagtcaacggccaggaaattgaaaaagacatgccgaatttaccggttgcccgtgttctctggaagccggagccgtcattgaaaacagcagcggaggcatggattttagccggcggtgcacaccatacctgcctgtcttatgaactgacagcggagcaaatgcttgattgggcggaaatggcgggaatcgaaagtgttctcatttcccgtgatacgacaattcataaactgaaacacgagttaaaatggaacgaggcgctttaccggcttcaaaagtagagggggatgtcacatggcttacacaataggggttgattttggaactttatcaggaagagcagtgctcgttcatgtccaaacaggggaggaacttgcggctgctgtaaaagaatacaggcatgctgtcattgataccgtccttccaaaaacgggtcaaaagctgccgcgtgactgggcgctgcagcaccctgctgattacctcgaagtcttggaaacaaccattccgtctttactcgaacagacgggcgttgacccgaaagacattatcgggattggaattgatttcacggcatgtacgatccttcctattgacagcagcgggcagccgttatgcatgctgcctgaatatgaagaggagccgcacagctatgtgaagctctggaagcatcatgcggcccaaaaacatgctgatcggctcaatcaaatcgcggaagaagaaggagaggcttttttacagcggtacggaggaaaaatttcatcagaatggatgattccaaaggtcatgcaaattgccgaggaagcgcctcacatttatgaagcggctgaccggatcatcgaggctgcggactggatcgtgtaccagctgtgcggctcgctcaagcgaagcaattgtaccgcagggtataaagcgatgtggagtgaaaaagcggggtatccgtcagatgatttctttgagaaattaaatccttcaatgaaaacgattacaaaggacaaattgtcaggttctattcattcagtaggagaaaaagccggcagtctgactgaaaaaatggcaaagctgacagggcttctcccgggaacggctgttgcggttgccaatgtggacgctcatgtttcggtaccggcggtcggcattacagagccagggaaaatgctgatgattatgggaacctcgacgtgccatgttctacttggtgaagaggtgcatatcgttccaggaatgtgcggcgttgtggacaacggaattctcccgggctatgcgggatatgaagccgggcagtcctgtgtcggcgatcattttgactggtttgtgaaaacatgtgtcccgccagcttatcaagaggaagcaaaggaaaaaaacattggcgttcatgagctgctgagtgagaaagcaaaccatcaagcgcctggtgaaagcggcttgcttgctttagattggtggaatggaaaccgttcaactcttgttgatgcagatttaacagggatgctgcttggcatgacactgctgacgaagcctgaagagatttatagagcgttagttgaagcgacagcttacggaacccggatgattatcgaaacattcaaagaaagcggtgttccgattgaggaactgttcgcagccggcggaatagctgagaaaaacccgtttgtcatgcagatttatgcggatgtgacaaacatggacattaaaatctctggttcaccgcaagccccagccttaggatctgccattttcggcgcgcttgcagcaggcaaagaaaaaggcggctacgatgatatcaaaaaggcagcggcgaacatgggaaaactgaaagatataacttatacgccaaatgccgaaaacgccgcggtttatgaaaaattgtacgctgaatataaagagctggttcattatttcggaaaagaaaaccatgtcatgaagcgtctgaaaacgatcaaaaatcttcaattttcatctgccgccaaaaagaattgataaagggtgatggagcatgcttgaaacattaaaaaaagaagtgctggctgccaacctgaagcttcaagagcatcagctggtaacctttacgtggggaaatgtcagcggcattgaccgtgaaaaagaaagaattgtcatcaaacctagcggagtcgaatacagcgacctgacagccgatgacttggttgttttgaaccttgatggagaggtcgtcgaaggctcgcttaaaccttcttcagatacacctacccatgtttatctatataaagcctttccgaatatcgggggaattgtccatacccattctcaatgggcgacaagctgggcgcaatcgggcagagacatccctccgttaggcacgacccatgctgattattttgacagtgcgattccatgtactcgagaaatgtacgatgaagaaatcattcatgactacgaactgaatacaggaaaagtcatagcggaaacctttcagcatcataattacgaacaggtgccgggtgtgctcgtgaataatcacggaccgttctgctggggcactgacgccttaaatgccattcataacgcagttgtattagaaacggttgccgaaatggcctatcactccattatgctgaacaaggatgtaaccccaatcaatacagtcctgcatgaaaagcatttttatcgaaaacacggagcaaatgcgtattatggccagtcatgatacgcctgtgtcaccggctggcattctgattgacttggacggtactgtattcagaggaaatgagttgatcgaaggagcaagagaagcgatcaaaacgcttaggagaatgggaaagaaaatcgtctttttaagcaaccgggggaatatctcccgtgccatgtgcagaaaaaaacttcttggcgcggggattgaaacggacgtaaacgacattgttctgtcatcaagcgtgacagcggcttttctgaaaaaacattatcgtttttcaaaggtatgggtgcttggggagcaaggcttggttgacgagctgaggctggccggtgtgcagaacgcgagcgaaccgaaggaagcggattggctcgtgatctcccttcatgaaacgctcacgtacgacgatttaaatcaagcctttcaagcggctgccggcggcgctcgtattatcgctacaaacaaagaccgctcttttccgaacgaagacggaaatgccattgatgtggccggaatgatcggggcaattgagacttctgcacaagcgaagactgaacttgttgtcggaaaaccgtcatggctgatggcggaggctgcctgtacagcaatggggctgtccgcacatgaatgcatgattataggagacagcattgaatctgacattgcgatggggaagctttatggcatgaaaagcgccttagtgctaactggttctgcgaaacagggtgaacagcgtttgtacacgccggattatgtgctggattctattaaggatgtaaccaaattggctgaggaggggattctgatatgaatcgtatcgcagctgacgttcagcgtgcttttgaaaacgccggagaaaagacgttgcctataaaagttgaagaaattgttctcggtaagcaagcagctgattcgcttttggattatgtaaaacgaaaaacaatcaacatattgtccttgtctgcgacgcgaatacacaccgcattgcaggaattgatttagaaaaccgactgaatcaagaaggatttcaggccgagtgcctgatcattccagaaaatgaagccggagatgtgacagctgatgaacgatcgctcattcatgtgctgatccatacgaaacaaccaacggatgtcatgatcgcagtcggttcgggcacgattcatgatatcgtccgctttgcggcgtttcaaagagatttgccgtttatttcttatccgactgctccatctgtagacggttttacatcagccggtgcgccgattattttatacggcacgaaaacaaccattcaaacgaaggccccatctgcgctgttcgctgatctggatctattaaaagcggcaccgcagtcaatggtggcggctggctttggtgacatgctcggtaaaatcacgtctttagcagattgggaaatatcccggcatcttgccggtgagccttattcgcctgcaggagctaagatcgttcaggaggcgcttgctgcctgcattgaacacacagaagacattgcgatgaaaacggaaactggcatacgggttttgatggagtctttacttgtatcggggcttgtcatgctggcattagatcattcccgaccggcatcaggcggcgagcatcatatttcacattggattgaaatggagttaatggagaaaaaacggcctcagattcttcatggggcaaaggtgggctgtgccgctgttttattaactgacacatacagaaagctcgctcaggatgacgggctgaacgaattttcaccaagccgccgggaagtcatccaatcggcttatcaaacactcccgagaggagaagtgctggctgattggctgagatcagccggaggccctgcgtattttgacgaaatcggtgtcgggcaggattccgtcaaaaatgccttcagacacgcgcacaccttaagagaccgatgcaccggattaagaatcatcaatgaaaacaaaacgctgatcaaccatggtctatatgaatagcccgcacctcgaatggaaggggtaacgcagatgaaaaaaatgactgtctgttttcttgtgctcatgatgttgctgacattagtcattgccgggtgttcagcagaaaaatcatccggcaaatcgggtgaaactgagctgaccttttggacatttaacgggcttcatgagcagttctatgtggaaatggtgaaggaatggaacaaaaaatatcctgaccgcaaaattaagctgaatacggtcgtttatccatatggacaaatgcacgataacttatctatctccctaatagcgggagaaggcgttcctgatattgcagatgtcgaattggcccgtttttcaaactttttgaagggctctgacataccgcttgccgacttgactccgctgattgaaaaggatcgcgataaattcgttgaggcgcggctgacattgtacagcaaaaacggaaagctttacggactcgatacacatgtagggacaacggtcatgttttataacatggatgtgatgaaaaaagccggcgtcaatcctgacgatattaaaacatgggatgattaccataaagccggacagaaagtgcgcaaagtgaccgggaagccgatgggaacggtggaaacaaatgattccgcaacgttcttatctatgatttcacagcaaaactcaggctattttgataaaaacggcaagctgatcctcaataatgacaccaacgtaaaaacacttcaatatttaaaagacatgatcaatgataaaacgatgattcctgcgccgggcggcgggcatcacagtgaagaatactacggctttatgaaccaaggaggagctgcttcagttctcatgccgatttggtatatgggaagatttatcgattatatgcctgatctgaaagggaagattgccatcagaccgctcccggcatggaaagaggggggcgaccgctcggcaggtttgggcggtacggcaactgttgtaccgaagcaatccaagcatgttgagttagcaaaagagtttttggcctttgcgaagggctctgaagaaggaaataaaaaactctggagcgtactcggctttgacccgcttcgctgggatgtttggagctccaaggaattgaaagagaaaaacaaatacacggattacttccaaaacggaacaggcattttttctgtgctgctcgatatcaaggatgaaatcaatccaatttatttacatgaggattttgccaaggcttcagaccttgtcaacagaagcgtattgttcgacgcgcttaaatctcagcaaaaaacgcctaaacaagccttggacagagcggcaggtgaactgaaacagaaatagaatcccattcaaaaagtgaaagcggggaggttctcatgaaacctgtgaaaacgggaacggttcatcccgttccttcagctgcgaaacaatcaggctggcgagatctgttttattcaaaaaaagcggcgccctatctgtttacagcgccattcgttttatcctttctcgtattttttctataccccatcattagtgtcttcatcatgagcttccaaagaattttgccgggagaggtgtcctttgtcggattgtctaattatacagcgctaaacaacccgacgttctataccgccctttggaatacgctggaatacaccttttggacgctgatcgtgctgattcctgttccattgcttctggccatattcctgaattcaaagctggtcaaatttagaaatatatttaaatcagcattatttatcccggcattgacctcaaccattgtcgcggggatcatttttcggctgatcttcggagaaatggaaacgtctctggccaattccatcctacttaaactcggcttttcacctcagaactggatgaacaatgaacataccggcatgtttttgatggtgctgcttgcttcatggagatggatgggaatcaacatcctttactttttagcaggtttgcaaaatgtgccgaaagagctgtacgaagccgctgatatagacggcgcgaatacaatgaaaaaatttctgcacatcacgctgccgtttctcaagcctgtaaccgtatatgtgctgaccatcagcatcatcggcggcttcaggatgtttgaggaaagctacgtcctttggcagaataattccccgggtaatattggtctgacgcttgtcggatatttgtatcagcagggacttgcctacaatgaaatgggatacggagcggccatcggcattgtgcttttgattgtgatccttgttgtcagcctgatttcattaaagctgtcaggctcgtttaagggggagggataaatgttgcggcacagtcctcagtttagcgtttatagaattgcgctgaccctgttttttatgatgctgagcctattgtatctttttccgattttctgtttgcttttaggatcattaaagccgtcatctgagcttttgcgtgtggggctgaatcttgatattgatccaaaagtgatgagttttgataactacacatttctgtttaatggcggcagcatttatttcaaatggttttttaacagtcttgtactcggactttttacgactgtgctcactctgtttttttcttcgatgatcgggtacgggcttgcggtttatgattttaagggcagaaatatcatctttgttcttgtgctgattattatgatggttccgctggaagtgatgatgcttcctctgtttaaacttactgtcggactgcacttgatcgattcatatacgggtgtcatattgccgtttatcgtttcacctgttgctgttttctttttcaggcaatatgctcttggccttccaagagatctgctggactctgcaaggatggacggctgtacggaattcggcatctttttcaggattatggcaccgctgatgaaaccggctttcggtgcgatgattatccttcagtccttaaacagctggaacaacttcttgtggccgctgattgtgcttcggtcgaaagaaatgtttacgcttccaatagggctgtccagcttgctgagcccttatggaaataattacgacatgcttatatccggctcagtatttgcgattttgccggtgattatcattttcttgtttttccaaaagtactttatctccggcctgacggtagggggagtcaaaggttaatgaaggaggaaacgtgtgatgaaaaaagcgcgaatgattgtagacaaagaatataaaatcggtgaagtagataaacggatttatggctcgtttatcgaacatatgggtcgtgcggtatatgaaggcatatacgagcctgatcaccctgaagcggatgaagatggatttagaaaagatgtccagtcgctgatcaaagaattacaggttcccatcatccgctatccgggcggaaactttttatccggatacaactgggaggacggtgtcggaccagtcgaaaaccgcccgagacggcttgacttggcatggcaaacgacagaaaccaatgaagtgggaacaaatgaatttttatcttgggcaaaaaaggtgaacactgaggtcaatatggccgtcaaccttggcacaagaggcatagatgccgcccgtaatctcgttgaatattgcaaccatccgaaaggctcttactggagtgatttaagaagatcgcatggctatgaacagccgtatggcatcaaaacatggtgcttaggaaacgaaatggatggaccatggcagatcggccacaaaacagctgatgaatacggacggcttgccgcagagacagcaaaggtcatgaagtgggttgacccatcaattgaactcgttgcctgcggcagctcaaacagcggtatgccgacctttatcgattgggaagcgaaggtgcttgagcatacgtatgagcatgtcgactatatctctcttcacacttactacggaaaccgggataacaatctgccaaactacttggcacgttctatggatttggatcattttatcaaatcagtcgctgcgacctgtgactatgtaaaagcaaaaacacgcagcaagaaaactatcaatctctctctggatgaatggaacgtctggtaccactcaaatgaggctgataaaaaagtcgagccgtggatcactgcgcgtccgattttagaggatatttacaattttgaagatgccttattagtcggctctctgctcattacgatgctgcagcacgcagaccgtgtgaaaattgcgtgtcttgcacagcttgttaatgtcatcgcgccgatcatgacggaaaaaggcggagaagcatggagacagccgattttctatccatacatgcatgcttctgtttacggaaggggcgagtcactgaaaccgcttatttcttctcctaagtacgattgttctgatttcactgatgtgccatatgttgatgctgctgttgtgtactctgaagaggaagaaacactcactatttttgcggtaaacaaggctgaggatcagatggagacggagatttcgctcagaggctttgaatcctaccaaatcgcagagcacatcgtacttgagcatcaggatatcaaagcaacaaaccagcataacagaaaaaatgtcgttccgcattccaacggatcatcgtctgtcagcgaaaacggcttaactgctcatttcacgccgctttcctggaatgtgatccgcctgaaaaaacagtcataagaatagcaaagccggagatttctctccggcttgtctttcaactgccacgagccggcccattccagccggctttttgtataggaaaaaatgaccgcttttcaccatgaaattatgatatatttatgaaaaacagaaaaggggatgggagaaaatgaatgcggttacaattgtgatagcatcaatgtgtattttggctattgcctatcgtttatacggaacatttatgatggtgaaggttctcaaagtgaatgatgacaagccaacacctgctcatgcgcttgaggatgggaaagactatgtgcctacaaataaatgggtttcgttcggccaccactttgccgcgatcgcagcggccgggccgctggtcggaccaattctggcggcgcagtttggctatttgccgggattattgtggctgttaatcggggcggtaattgggggagccgtccatgatattgtggtgttgtttgcatcgatgcgcaaaaacggaaaatcgctgtcggaagtggcgaaggatgagcttggccctgttgcaggattttgtacaggactgtccatgctgtttatcatcacgatcacaatggcgggcctgtcgatggttgtcttgcatgcgcttgaacgtaatccatggggaacatttgcggtggggattacgattccgattgcgatgggtgtgggcttattttataagaaaacgggaaatttaaagctcgcttcaacggtcggctttctctttttaatggcaggagtctttatcggtccatgggtacagactaccgcgctcggtgactttttaacgctagatacgaaaacgcttgcaatcgcgcttcctgtttatgcgttttttgcggctgcgcttcccgtttggctgcttctggctccgcgtgattatttaagcagctttatgaaaatcggtgtttttatcgctttgattgttggtgtgtttgtcgtcaatccgtccattccgttccctgcgtttacagaattcgtaaaaggcggagggccggtgctggcaggacctgtctggccgttcatctcaataaccatcgcctgcggggcgatctctgggttccatgcctttgtcggctcaggaacgacaccgaaaatgctgaataaatggagtgatatgaagccggttgcgtttggcgcaatgcttgttgagtgtcttgtcggtatcatggcgctgattgcagcgaccgctttacagcctgctgattactttgcgattaacagcacgcctgaggttttccgtacgcttggcatgaatgtcgtacatttgcctgaattgagcggggaaatcggtttggacttagaaggaagaacagggggagccgtcacgcttgcggtagggatgacttatatttttaccggaatgccgtttttcagccatttggcctcatactttttccaatttgtcattatgtttgaagcggtctttattttaacagcgattgacgccggcacacgtgtcgcccgttatttgatccaggacttcttcggggaggtgtataagccgctgaagaaaacagactggattccgggctctgtatttgccagcgcgcttgcctgtttgatgtgggggtacttgctgtattcaggagatatcggttccatttgggcgctcttcggcgtttctaatcagctgatggcttcagtggggctgattatcggagcgacgatcgtgctgaaaatcgccgataaacgccggtacattctgacttgccttatcccgcttgcctatttatatgtcactgtcaattatgcgggctattggatggtgcgcaatgtgtatctcaatcctgaagcagcaggatatagtgtattgaatggcgtattatctatcatcatgctggtgttaggcttcatcattatcgtggcggctgtgaaaaaatgggcgcagatgtggaaagatccgagcttaaggatggaagcatctataccgggctagaaggactattgaaaatgctgagaggggttggcaatgaatctatcaatgaaatatcttattctatacgtatcggacagcaagcgggctattcattttttaccgggatattttaggactgccgattcgtgctgaacacggcacgtatgtcgaatttgatacagggtctacgatattggcgcttaatacccgggaaagcgccagagacatcacggcgctggacattccggatacatctgcttcaaacacatttgaaatcgggtttgttactgaaaatgtagaagcggtcatcaaaaggatgagagaacaaggcgtatcgattatcggggagccgaaagtgaaaccatgggggcagacggtcgcctatatcgctgatccggatggacattatatcgaaatttgcagtccgatggaataacgcacaaaagcccaaaacaatgtctgttttgggctttctcatgatgttttgtgcccggctgcttctaatagcaaatcagccaggtgaacggctctgactttaccgcttagtccttcgcgttcaatgccgagcttcatctgcagcaggcagccaggatttgctgttacaatgaggatcgcttcggttgctttgacggcagccattttgctgtccagtattttcatagacatttcaacttcgacgatgttgtaaattcccgctgacccgcagcagctgtctgctttctccatttctttgaattccgcccctttgatgcttttaagaagctggcggggctcgagtgacgtatgcatcacatttcttagatgacatgaatcttggtaggtaacgacctgaggcgtctcgagtgctagatccatttgatggaaatcgagttcaaccaaaacagaagaaaaatccttcagcttttgaacaaaagcggcagcccgttccgaccactcagggtcatccttcagcaaatgatcatattcagtgagaaaggctccgcatcctcctgcgtttgtaatgactgcatccacgtctaatgcttcgaaagcagcgatattttgtttcgcgagctctttccctgtgtttttttcaccgctgtgtccatgaagcgccccgcagcaagcctgttcaggcggaatgacaatgtcgcagcctgccagctgtaaaagcttcaatgtggcgttattggtcggtaaaaacattgtatccattaagcagcccgaaaaaaaggcgacccgttttttcatggggccaatggaaggcaggaaacgcggccgatgtttcatgtctttgctttttggaacatcaggaagaacagcttccatcgtccgcaaatgctcaggcaggacccgaagcatgcctgattttcgcacagcggtttgcagtcctgaacgctgatacaaaccgataaggcttacagctgagcgcatgcggttttgatgcggaaacagctcgtgaaaagccgtctttcgcatgacacgttcaccaagagagtgttttttattttggtggataatatctctggcttcctcaagcagctgcccgtatttcacgccagacgggcatacaggctcacaggcgcggcagccgaggcaaagtgacagcgaccgttcgacatcttcatccggttcaatcataccgtcggctacggctttcattaaggcgatgcgcccacgcggagagtgtgtttcctgaaatcccgattcgatataggtcggacaggaaggaagacagaagccgcagcgcatacaatttaataactctccttcatccatacgctctttaaattcattttggatctgtttcatttctttttctgttgtcatctttccgccaccacacgttttctggcatctttcgcaaacattttgccgggatttaatatgttccgggggtcaaatgccgctttcaacgctttcatcgcatcaatgccttcttttttcagcttcatttccaagtaaggcgctttcatttccccgactccgtgctctccggttatcgtcccgccaagttcaatcgctttctcaaaaatctcggcaaaagcctgttcgacacgttccatttcatccttatttcttatgtctgtcgtgcatgtcgggtgaaggttcccgtctcccgcatgaccaaaggtgcagatggaaatatcatatttagcagcaatatcattaatcgctttaaccatattggcgatttctgagcgaggaacggtcgcatcctctaaaatcgtcgtcggtttgaggcgggctagggcagaaagtgcagaacgccgggcttcagtcagggcaaacgcttcctcctctgtttgtgcggtctgaacggatacggcgtcgccttttttgcagatcgcctcaatcttttccatatcccgttcaacagtttcaaatggcccgtcttgttcaattaacagaactgcttttgcgcttgtcggaagtccgattttggcataatcctcaatcaccaatagtgtaggctgatcgagaaattcaagcgtagcgggtataatttttgcggcaataatgtccgataccgtttgagcagcggcatcgatgttttcataaagggcaagcagcgtcttctttgtttccggctttggaacgagtttgacgattgcctctgtcacaatgccgagtgttccttctgagccgacaaaaagacgtgtgagatcgtatccggccacatcctttgcgagttttccgccggtgcggatgatgtcaccatttgcgagaacaacctccagtccaataacatagtcgcgggtgacaccgtattttaatccgcgtagcccgccggaattttcattgatgttgcccccgatagttgatattttcatagaactcgggtcaggcggataaaataaacctttgctttcaactgcccggatcatatccaacgtaatgacgcccggctgaactgtggcagttaaattttcttcatcaatttcaagaatctggttcatgtgcttaaagagaagcacaagtccgccttcagtcgggcacgtgccgccgcacaggtttgtccctgatcctcttggaacgatcggcactcgatgttcgctgcaaattgttaaaatgcgtgatatttcatcagtattcctcggagcaatcacggcatcaggcatagactgatactgaggcgtcgcatcatatgaatagacgagacggccggcattcgagtcatcaaagttttctggtccggagacctgaatcagctgctcctttacatccttggtgatcatttcacccatccccctgtcaaaaaacgctttcaatctattgtaaaagaaaaaaagcaaagccttccatggagaaacatacaaaaaatgaaactgaaactctctctattttgtatcttgatctaaaaaatagagtgcgacgtacatcgtgacgacgtcctcggtacggtcaaaacgtaatcccgtcagctgttcagccttagccagacgataacgcaatgtattgatgtgtatatgcatgtcttcagcggtttgtttcaaagacaaatcgtgatgaaagaaagtccgtatcgtattcataagttcctgatgctctagcgcctttcctaatactctttgcggaaattcgtttcgggttcccgggctgatctccgtcagacacatatcaagcttcagatcctcttcaaatatgggcgtttttcgcttaaggctgacagccagcgctttttccgcttgctcgtatgaatctgtcaggctggagcttgcgacagcccttccggcgccagctgctgtatattggctgcttgcggtattggcaaacgaacaaatgtgaaggattttccgcaaaagccgatccctttgttcatgctgcggcacttcatgattaatcaaaatccgttcatttccccacctgatgaacaaatccgcagggtacgaggatttccagctgcgtgccatttgttcaatatcatgaggtgaccactcatacccctgaataagaatcatttggcgccgggaagaaaggtcaacaccaagaagctgagctttctcaagaaaactgggagaccactcctttaattgcagccaatcgatcataaaggactccagcattctctcacgccactgggattgctctaagtgccgcgattccttaatgaacagttctgtcatttttcgaagcagttctccgaatggctgaatctctgcaggctcacctgtcagcccgaagacggcaatcacatcatggtcaaaaaatacagggaggtttatgcctgctttcactccttttaaccttgtttcatcttcttttgtaataatcacgctgcgtctttcttttgcgcagataagcgctccctcatgaaattgtccgacacgctcatcgtttgtgcctgccataataagaccgtccgtgtttacaataatgacttcacgttcgtacatttttttaacttcagcaataatttttttcgctaataacggctgtaaaaacatggcgttccccctcatcatgtttttattatataagaaaaaaaccgggcgctgtcacccggtttcatgtcttattcggcgggttttaatccgccttcaagcgttttcagcatttcgtttttctcactttcggatgcgtgctgccaaatgacttcgaataaaacgccgagccctggaagcattttttcttcaccgctttgaatcgcatctacgattgtatgctcaagctgctcctgattattgccggtgacattggcaatgacggcatgacgtaaattaagatccatgtaaaacgctcctttttctaaaatgtaatacgtatattctaaccctgcacctggtttattatgtgctgttcttgcgatataataacatcatgttaaaaaaaggagcgccacatagacagtgaaacaaatagaatcggcaaaaaaccaaaaagtgaaggattggaaaaagcttcacacaaaaaaagaacgaacaaaaacaaatacatttctgatagagggagaacacctcgttgaagaggcgttgaaaagcccgggcattgtgaaagaaatccttgtaaaggatgaaacgaggattccttcagatcttgagactggtatccagtgctatatgctgagtgaagatgcgttttcagctgtgactgaaaccgaaacgccgcagcagattgccgctgtgtgccatatgcctgaagaaaagctggcaacggcacgcaaggtgctgctgattgacgctgttcaagatccgggaaaccttggcacaatgattcgaacggctgatgcggccggtttggatgcggttgtactcggtgacggcacggcggacgcctttaacggaaaaacactgcgatctgctcaaggatctcacttccatattcctgttgtgagaagaaacctgccttcatatgtggacgaattgaaggcagagggcgtaaaagtatacggcacggcgctgcaaaacggagcgccttaccaggagattcctcagtctgaatcctttgcgctcattgtaggaaatgaaggtgcaggggtggatgctgcattgctggaaaaaacggatttgaacctgtacgtgccgctttacggacaggctgaatcactaaacgttgcggttgcggctgccatcctcgtgtatcacttgcgaggatagtgttgcgccaagcgttggatttctctataatagaacataatatttcaaaaaccgtgacagaggacctcaatttctgatcaactgctttccagggagaaaatgccgctgactgagagcatttttaacgcagccggaaattggcttcacctcttgagttgtcgccgggaccgcgtacactgcgcgtaaaggtgaaccggaatctgattccgttatgtcaatgaagctgacgacagcatcagtctgtctgaaataagggtggtaccgcggccacaactcgtcccttgtacaagggacgggtttttttattttccaaagacatatgccggtttgtttacataaaaggaggatgcaaaatggaagaaaagctaaaacagctggaacaagaagctttagaacaagtagaagcggcaagctcattgaaggttgtcaatgatattcgggtgcaatatctcggaaaaaaagggccgattacagaagtgctgcgcggaatgggcaagctttctgctgaggaacgtccaaaaatgggggcgctcgcgaacgaagtaagggagcgtattgccaatgcgattgctgacaaaaacgagaagcttgaagaagaggaaatgaaacagaagcttgcaggacagacaattgacgtcacgctgccggggaaccctgttgcagtcggcggccgccatccgctcactgttgtcattgaagaaattgaagatttatttatcggtatgggctacacagtcgaggaagggccagaggttgaaacggattactacaacttcgaatcgctcaatcttccgaaagaacacccagcgcgcgatatgcaggacagcttttacatcacagaggaaactttgatgagaacgcaaacttctcctgtccaaacacgtacgatggaaaagcatgaaggcaaaggtcccgttaaaatcatttgcccgggtaaagtatatcgccgtgataacgatgatgcgacgcactctcaccaatttatgcaaattgaagggcttgtcgttgacaaaaacatcagcatgagtgatttaaaaggaacgcttgaactcgttgcgaaaaaaatgttcgggcaagaccgcgaaatcagactccgtccaagcttctttccgtttactgagccttcagtagaagtggatgtgacatgctttaaatgcggtgggaacggctgctcagtctgtaaaggaacaggctggattgaaatcctcggcgccggcatggttcacccgaacgtgcttaaaatggctggctttgatccgaaggaatatcagggcttcgcattcggaatgggtgttgagcgcatcgcgatgctgaaatacggcattgatgatatccgccacttctatacaaacgatgtcagatttatttcgcagtttaaacaggcgtaagaggaggatgcaaggatgtttgtttcttataaatggttagaggattatgttgatttaaaaggcatggacccggctgttcttgctgaaaaaattacaagagccggtattgaggttgaaggaattgaatacaaaggagaaggcatcaaaggcgttgtcatcggccatgtgctggagcgcgagcagcacccgaatgctgataagctgaataagtgccttgtggatatcggagctgaagcccctgtacaaatcatttgcggtgcgccgaatgtggataagggacaaaaagtcgcagttgcaacagtcggagcggtgctgccgggcaatttcaaaatcaaaaaagctaagcttcgcggtgaagaatcaaacggcatgatctgttccttacaggagcttggtattgaaagcaaacttgtggcgaaggagtatgcagaaggcattttcgtattcccgaatgacgctgaaacaggaagcgatgtattagcggctttacagcttgacgatgcgattcttgagctgggtttaacgccaaaccgcgcggatgccatgaacatgcttggtgttgcttacgaggttgccgcgattttagatactgaggtaaagcttccgcaaacggattacccggctgcttcagaacaagcgtctgattacatttcagtcaaaattgaagatcaagaagcgaacccgctttacactgcaaaaatcattaaaaatgtcacgattgctccgtcaccgctttggatgcagacaaagctgatgaatgcaggcattcgtccgcacaacaacgtcgttgacatcacaaattttgtcctgttggaatacggacagccgcttcatgcgtttgattatgacagatttggctctaaggaagtggtagtaagaaaagcagctgagaatgaaatgatcgtcactcttgatgatcaagaacgtaagctgtccgccgatcaccttgtcattacaaacggaacgaaagcgcaggccgttgcgggtgtcatgggaggagcagagtcagaggttcaggaagatacgaaaacgattttgcttgaggctgcgtatttcaacgggcagacggttcgcaaggcttccaaagaccttggtttgagaagtgaatcaagcgtaaggtttgaaaaaggaattgatcctgcgcgcgtgcgtcttgcagcagaacgggctgcacagctgatccatctgtatgccggcggtgaggtgcttgctggaacagttgaggaagatcacttgacaatcgaagcaaataacattcacgtgtctgctgacagagtgagcagcgttctaggcatgacgatcagcaaggaagaactgatcagcatttataaacgtctcggttttacggtcggtgaagcgggtgaacttctcgttgtgactgtcccatcacgccgcggcgacattacaatagaagaggatttaatcgaagaagcggcaagactgtacggctacgataacattctgtctacgcttcctgagacagcgggaactacaggcggattaacgccatatcaggcaaaacgccgtaaagtcagacgcttccttgaaggcgcaggcttatcacaagccatcacttactcactgacaaacgagaagaaagcggcagcgtttgcgattgaaaaatcactgaacactgtgcttgcgcttcctatgagtgaagaaagaagcattctcagacacagtcttgttccgaatctgcttgattctgtttcttacaacctcgcgagacagactgactcagttgcactgtacgaagtcggttccgttttcctgacgaaggaagaggacacaaaacctgttgaaacagaacgcgtggcaggagctgttaccggattatggcgcaagcagctatggcagggtgagaagaaaccagttgatttctttgttgtcaaaggtattgtcgaagggctgttagacaaactcaacgtcctagacagcattgaatttgtacagtctgaacgcaaacagctgcatccgggcagaacagcgaacattttattgaatggttctctgatcggcttcatcggccaagtccatccttcattggaaaaagaactggatataaaggaaacatacgtatttgagctcgatcttcatgcgttgctcgcggcagaaacagcacctcttgtttacacggcgattccgaaatatccgtctgtgacacgtgatattgctcttgtaacagataaaaccgtcacaagcggacagctcgagagcgttattaaagaggccgggggcaagcttctgaaagaggtaaccgtatttgacgtatacgaaggagagcatatggaggaaggcaagaagtcagtcgctttctcactccagtatgtcaaccctgaacaaacactgactgaagaagaagtgacaaaggcgcacagcaaagtgctgaaagcgttagaagacacatatcaagctgttttaagaggctgataaaaaagcttgcagagaaatctgcaagcttttttctatgagcgttttttatcagcaaggcgctgcgctttttgcgtattggcgaaatggagttttgtaaaggttctgagtgcagatgccccttttttgaggattagcttggcggccgcttcatcgacgtgcggaccggcgccttttggaagcgtcattcctgccgcgcgtgatagtttatccatttccattaaaaacgaatatcttgcaatgattgaagcagcggcgacagccaggtgaatgccttcagcttttgtgctaaaataggtccgctccttcacaatgtctctgccctttaaatgattgaagtagacgcctggctcagcgaattggtcaatcaaaatggcttcaggctttactccatccaattttcttaataaatgtgtgatcgcctgattgtgcagcaaagctttcattttcccttggctcatgcctttttcctgcatgctgttatacttttcattttttaaaaccaggaggctatatggaatagttttgatcaggtttcgggcaatctcgatgatttgcggatcttttaaatctttagaatccttaacaccgagttccttcattaaaggaagcatggttttgtcgacgtacgcgcatacaaccgtcattgggccaaagtaatctccggttccgacttcgtcagaaccgataacagacattccggcgatatctgccggaggggcatagcggggatcagccggctttttggccgttttcttcttttcctgaggctctgctgttccccagcgcgcggattctgccgcagcgttttttccttgaaacaagaccttacctgattgatatgctgtaatggtacagccgggcggttttgcctgaaaaacggctccctgcggaacagaggctgtaagtgaaccgctgtacgtcattttcatttggtcaatagcagacaacgatacttttatcactgaatgggacacgtaataatctcctttttttacacttttcgctgtatataccagtgtatcataacagcgggaggctcgtctttccattcatttaataaacgtgttatgataagaactaggattctcgcggaatggaggagaaacgttgtctgacggcaaaaaaacaaaaacaaccgttgacatttacggccagcacttcacgattgtcggtgaagaaagcagagcccatatgaggtatgtcgccggaattgttgatgataaaatgagagaaatcaatgaaaaaaatccataccttgatataaataaacttgcagtgctgacagcggtaaatgtggtgcacgattatgtcaaattacaagagaaatgtgaaaaactggagcgtcagcttaaagaaaaggattgaacaactatgctagatatcatcatcttaatcttgctcctgatggggactttactggggttaaaacgcggttttatcctgcagtttatccgcttgacgagctttattttatcaattgcctttgcggctttattctataaaaacgtggcaccgcatttacattggattcccgcacccgatttttcagcgggacagccggctctttctttttttacggggaatttggaagcagcgtactataatgcgattgcgtttatcgttttatttatcattgctaaaatcttactgagaatcatcggctcgttcctgagtattgtagccggcattccggtgattaaacaaatcaaccagatgctgggagccgttctcggttttctagaagtctatttatttacatttgtgctgctgtatgtcgcatccgttctgccggtagacgcgttgcagcaaatgatggggcaatcgtctctcgcaaatgtgatcattaaccatacaccgtacttgtcagggcttttacaagagctgtggacacagtacggggcataaaaaaacttctcttgtccggagaagtttttttcaagtatgatggaaacatatgtgaacgtctgggggttatgatatgcataaaaaagatattatccggctgcttgaaaccattgcagtctatatggaactcaaaggggacaacccgtttaaagtatccgccttccgaaaagcggcggcagctctggaacaggacgaccgaagcttatcagaaatggacgatatgatgtcgctgtccggcattggaaaaggaacgtacagcgtcattaaagagtatatagatgaaggaaagtcaagcacgctcgaatcgcttcagaaagaagtgccggaaggactcgtgcctttattgaagctgccggggctcggcggcaaaaaaatcgcaaagctgtataaagagctcggcgtacacgatgcagaatctctgaaggaagcctgtgagcagcaaaaggtccagggtcttgcgggcttcggcaaaaaatcggaagaaaaaatattacaggcgctcggggaagccggaaaacagcctgaacggttcccgatcggctacgccctccggatcgcgcgggaaattgaggagcatctttctcaatttacgcatatcatcaaattttctcgtgccggaagtctccgcagagcgcgggaaacggtgaaggatctggattatatcattgctacagatcatccggctgaagtaagagagcagcttcttgagctgccaaacatcaaaagcgtgatcgcaagcggagatacgaaggtgtccgtcatcctttcctttgaatatgaaacaagcgtcgatttccgtcttgtgacggaagagcagtttccgacaacactccatcattttacgggatcaaaggatcacaatattaagatgcgccaaatcgccaaagaacgcggcgagcggatcagtgaatacggcgttgagacagttgaaaccggagagatcaaaacatttccgagtgaacgtgaattttatgcgcacttcggcctgccgctgattccgccggaaattcgtgaaagcggacaggaagtggaaacctacagcgacagcattgaactgatagagctcgggcaaatcaaaggtgatctccacatgcactcaacgtggagcgatggcgcattttcgatcagagagatggctgaagcctgcatcaaaaaaggctatcaatacatggcgatcaccgatcactcacaatatttaaaggtcgccaacgggcttactgcagaaagacttaagcagcaggcaaaagaaattgacgcgctgaatgcagagtttgaaaacttccgtattttgaaaggcgttgagatggatatcctgcctgacggtacgctcgattatgatgacgatgtgcttgcggaaatggatatcgttattgcatcgattcattccagttttaatcagccggaacacgtgattatgaaacggcttgagacggcactgacaaacaagcatgttgacattatcgcacacccgaccgggcgccttatcggcagacgggccggttacgaaatcgatattgatcagctgattgagcttgcgaggaaaacaaatacggcgcttgaactcaatgccaaccctgcgcgccttgatctgcgcacagagcatttaatgaaagcaaacgaacaaggggttacattggtgattaatactgatgcccataatattgagatgttagacgatatgaaaactggcgttactgccgcgcgcaaaggatggacggaaacgaaaaacgttctgaatgcccggtcgcttaaagacgtagaggcatttctgaagcgcaacgattaagtaaggaggctcacacaatcgtgcagcaaaaagtattatcagctcttgaatttcataaagtgaaagaacaggttattgggcatgccgcttcatcgctcggaaaagaaatgcttctcgagcttaagccttctgcttctatagacgaaatcaaaaaacagctggatgaagtagacgaagcttctgacattatccggctgagaggccaagcgccatttggcggccttgtagatatcagaggagcgttaagacgggcggaaatcggcagcgttctcagtccttctgaattcactgaaatctcaggcctgctttatgcagttaaacaaatgaaacattttatcacgcaaatggctgaagacggtgtcgacattccgctgatccatcagcatgctgaacagcttatcacgctgtccgatttagagcgggacattaattcctgcattgatgatcacggagaagtgcttgatcatgcatcggaaacattaagaggaatccgcacacagctcagaacactcgaatcaagagtcagagaccggttagagtcgatgctgcgttcctcttccgcatcgaaaatgctgtctgatacgattgttacgattcggaatgaccgctttgtgatcccggtcaaacaggagtacagatccagctatggaggaattgtgcacgacacctcatcctctggtgcgacactattcattgaaccgcaggcgattgtagatatgaacaattcccttcagcaggcgaaagtgaaagaaaagcaagaaattgaacggattttgcgtgtgctgacagagaaaacggcagagtatacagaggagctatttctagatttgcaagtgctgcagacgcttgactttatttttgcaaaagctagatatgcaaaagcggttaaagcgacaaaaccgattatgaacgacaccggctttatccgtttgaaaaaagcccgccatccattgcttccgcctgatcaggttgttgccaatgacatcgagcttggccgcgatttttcaaccattgtcatcacagggccaaacaccggggggaaaacagtcacccttaaaacgttaggcctgctaaccttaatggcgcagtcaggtcttcatatcccggcagatgaagggtcagaagcggcagtatttgagcacgtattcgctgatatcggtgatgaacagtcgattgagcaaagtttaagtacgttctcatcccatatggtgaatattgtcggcattttagaacaggtcaatgaaaacagccttgtgcttttcgatgaacttggtgcagggacagatccgcaggagggggcggccctcgccatgagcatcttggatgacgtgcatcgcaccaatgcacgagtgttagctacgacgcattatccggaattgaaggcgtacggctataacagagaaggcgtcatgaatgccagcgttgaatttgacatcgaaacgctgtcaccgacctataaacttttaattggtgtgccgggtcgaagcaatgctttcgaaatttcaaaacgcctcgggctcccggaccatatcatcgggcaggcgaagtcagaaatgacggccgagcataacgaagtcgatacgatgattgcgtcgctggaacaaagcaaaaaacgtgcggaagaagagctttctgagacagaatcaatcagaaaagaagcggaaaaactgcataaagagctgcagcagcaaatcatcgagcttaacagcaaaaaagacaaaatgcttgaagaggcagaacagcaggctgctgaaaaagtaaaagcggcaatgaaagaagccgaggacattattcatgaattgcgcaccataaaagaagaacacaaatccttcaaggatcacgagctgattaacgcgaagaaacggttagaaggcgctatgcctgcttttgaaaagtccaagaaaccggaaaagccgaaaacgcaaaaacgcgactttaagcctggcgacgaggtgaaagtcctcactttcgggcaaaaaggaacattgctcgaaaaaacaggcggcaatgaatggaacgttcaaatcggtattttaaagatgaaagtaaaagaaaaagatctggagtttatcaaatcagctccggagccaaaaaaagaaaaaatgattacagcggtcaaaggaaaggactatcacgtatcgcttgaacttgatcttcgcggcgaacgctatgaaaatgccctcagccgggttgaaaaatacttggatgatgcggtgttagccggatatccaagagtgtcaatcatccacggaaaaggaaccggcgctttaagaaaaggcgtacaggatcttctgaaaaaccaccgcagcgtcaaaagttcccgtttcggtgaagcaggtgagggaggatcaggcgttacggttgttgaactaaaataaaagggagtatggccatgagtgatttttgggaaaacgagcttgtggaaatcgcggcatattacagtgtcgcggttctctgcctcgtcctctttttgactgtgtttgagctggtgacggcttataaaaactgggaagagattcaaaaaggaaatcttgcggtggcaatggcgaccggcggaaaaattttgggaatcgcaaacgtatttcagcattccatctcccagcataattcgctgctgcaaatgatcggctggggcgtttacgggtttgttatgcttctgatcagctactttatttttgagtttttgactccgcggtttaaaattgatcaggaaatcgaaaatgataaccgggctgtcggctttatttcatttgtcatttctgtcgggctttcttttgtggtggcagccggaatataaggggacggagaatagatggaaaagcttgcgaaaatactgctcgccgcagcgggaatctttttgttaattggtcttatatatctgttcatattatgagaaaaagaaagatttacctttcttttctttttttgccgtccatctgctataatgataaggtggatctctaaaatcgaaaggggaggttttatgcagtctcaaaagccgtggcttgccgagtatcccaacgatatcccgcatgagcttccgttgccgaataaaaccctgcaatccatcctgacagactccgccgcacgattccctgataaaaccgcaatatcgttttatggaaaaaaactcacctttcatgacattctgacggatgctcttaaacttgcagcttttttgcagtgcaatggcctgcaaaaaggagacagagtggctgttatgctgcccaattgcccgcaaacagtgatttcttattatggcgtcttgtttgccggtggcatcgtggtgcagacgaatccgctttataccgagcatgagcttgaataccagcttagagatgctcaggtaagtgtaatcatcaccttagatttgcttttcccgaaggcaataaaaatgaaaacgttatcaatagtcgaccagattttgataaccagtgtaaaagactatttgccttttccgaaaaatattctttacccgctgacgcaaaaacaaaaagtgcatatcgactttgacaaaacagctaacattcacacgttcgcttcctgtatgaagcaggaaaaaactgaactcctgacaatcccgaagatcgatcctgagcatgatatcgctgtcctccagtataccggaggaacaaccggagctccaaaaggggtcatgctcacgcaccaaaatattttggcaaatactgaaatgtgcgccgcttggatgtatgacgtgaaagaaggcgctgaaaaagtgctgggcatcgttccattttttcatgtctacggactgacggcagtcatgaactattcgattaaactaggcttcgaaatgattcttcttcctaagtttgatccgctcgaaacacttaaaatcatcgacaaacacaaaccgacgctctttcctggcgcaccgacaatttacattggccttttgcatcaccctgaattgcagcattatgatctgtcatccattaaaagctgtcttagcggatcagccgcgctccccgtggaggtaaagcagaaatttgaaaaggtgactggtggaaagcttgtggaaggctatggtttgtctgaggcatccccagtgacgcacgccaactttatctggggaaaaaacaagccgggcagtatcggctgtccttggccgagtacggacgctgcgatctattctgaagagacgggtgagcttgccgctccgtatgagcatggagaaatcattgtaaaaggtccgcaagtcatgaaaggatactggaataaaccagaggaaaccgccgcagtgctgagagatggctggctgttcaccggggacatgggctatatggatgaagaaggctttttctatattgctgacaggaagaaggatatcatcattgccggcggttacaatatttacccgcgtgaggtagaagaagcgctttatgaacatgaagccatccaggaaattgttgtcgcaggcgttcccgattcctacaggggagaaacagtaaaagcatttgtcgtattaaagaaaggcgcaaaagccgatacagaagaactggacgcttttgcgagatcacgtctagctccctataaggtgcccaaagcctatgagttcagaaaggagctgccgaaaacggcggtgggaaaaattttaagaaggcgtttacttgaagaagaaaccgaaaatcatcatatcaaataaaaaaagagaacgcctatgaataaacttgacaaacctgaaaatccttcttatcatgaaattatgaatgaatagtcattcatttctataggaaggaacgatgaacattgaagcaaaaacggccaaagtatatgcagattattgatgcagcagtagaagtcattgcagaaaacggctaccaccagtcacaggtatccaaaattgccaaacaagccggggtagcggacggcaccatctatctctattttaaaaacaaagaagatattttaatttctcttttcaaagaaaaaatgggtcaatttattgagcggatggaagaggacattaaagaaaaagcaacagcgaaagagaaattggcgcttgtgatttcaaagcatttttcccttttagcgggtgaccataatctcgccattgtcacgcagcttgagctccgccaatccaacttggagctgcgccaaaaaatcaacgaaatattaaaaggctacttaaatattttggatggcattttgacggaaggtatacaatcaggcgaaataaaagaaggcctcgatgtccgcctcgcccggcagatgatttttggaacgattgacgaaactgtgacaacttgggtgatgaatgaccaaaagtacgatctcgttgcgctttcaaacagcgttttagaattattggtatccggaattcacaataagtaaaggagttctgtcctatgaatgcaatttcacttgcggttgatcaatttgtggcagtcttgacgattcacaatccgccggcaaacgcgctttcaagccggatattagaagagctgtcttcctgtcttgatcaatgtgagacagatgcaggcgtacgaagcattatcattcacggcgagggaagatttttctcagccggcgctgatattaaagaatttacatcgcttaaaggcaatgaggattcctcattgctcgctgagcgcggccagcagttaatggagagaatcgaaagttttccaaaaccgattatcgcagcgattcacggcgctgctctcggaggcgggctggagcttgcaatggcctgtcacatcagaatcgcggcagaagatgctaagctggggctcccggagcttaatctcggtatcattccaggttttgcggggacacagcgccttccgagatatgtcggtacagccaaagcactggagctcatcggatcaggagaaccgatatccggaaaagaagcgcttgatctcggacttgtctcaattggagcgaaagatgaggcagaagtgattgaaaaagcaaaagcacttgccgctaagtttgcagagaaaagcccgcaaacgctggcatctttgcttgaacttctttattccaacaaggtgtattcctatgaaggcagcttaaagcttgaagcaaagcgatttggggaagcatttgagtcagaggacgccaaggaaggcatccaggcatttctcgaaaaaagaaagcctcagttcaaaggcgaataaaaggggatatgatcatgaatctatttgtactgatgaaacggacgtttgacacagaagaaaaaatcgtcattgaaacaggaaagattcaggatgacggagcggaatggatcattaatccatatgatgagtacgcgatagaagaagccatccagctgaaggaaaagcatggcggcacgatcaccgctgtcacggtcggcggtgaagaagcggagaaagaattgcgtacggcgcttgccatgggttgtgaccaagctgttttaatcaacatagaagatgatcttgaagaacccgaccaatattccatttctcaagttttataccactatatgaaggatcaggagtttgatttgattctcggcggaaatgttgccattgacggaggatcaggacaagtggcgcctcggcttgccgagctactggacattccgtgtatcactacgatcaccaaactcgaaatcaacggcactgatgcagaagcagaaagggacgtcgaaggggatgttgaaaaaatcaaaacgacgctcccattgcttgtcacagctcagcagggcttaaacgagccgcgctatccatcgcttccgggaattatgaaggctaagaaaaagccgcttgaagagcttgaacttgatgatcttgatctggacgaagaggatgctgaaccaaagctgaaaaccattgaacgttttctgccgccgaaaaaagaagccgggaagcttctccaaggtgagcctgctgaacaggcaaaagagcttgtttcattgctccgcagcgaagctaaagtcatttaaaacttggacattcaaagaaacagggggatgttagaatgggaaaaaaagtgatcgtgcttggagaaatacgcgatggggaattgcgaaatgtcacctttgaagcaatagctgcaggaagaaccatttcaggagatggggaagtcatcggtgttctcatcggtgaaaatgtacaaagcattgcacaagagcttattcattacggagcagataaagttcttaccgctgaggacccgaagctgaaaacatacacggcagacgggtacagccaggtcatgagaggtgttatcgagcaagaaaatcctgattcagtcatcttcgggcatacggcaatgggcaaggatctttcaccgaagcttgctgcccggctgcaaacaggcttaatttctgatgctatagatgtaagcgttaccggaggaaatgttgtgttcacacggccgatttactcggggaaagcttttgaacgtgtcatttcaaccgatccgatgatctttgcaacaattcgccccaataacattcaagcttcagaaaaagacaccagcaggtcgggaagcatcgaaagcataaatgtctctcttactgaccttcgcaccgtgattcaagaggtcgtgaaaaaaacggcggacggtgttgatctctccgaagcgaaaattatcgttgcgggcggccgaggagtcaaaagcaaggagggatttcagcctctgcaggagcttgcagaggtgctaggggccgcagtcggggcttctcgcggggcatgtgacgctgattattgcgattacgctcttcaaatcgggcagacggggaaagtcgtcactccggatttgtacattgcatgcggcatttccggtgccatccagcatttggccggcatgtcaaacagcaaggtgatcgtcgccatcaataaagatcccgaagccgatatctttaaaatagcggattacggcatcgtcggtgatttatttgaagttgtcccgttattaactgaggaattcaaacagttgaatatacactcataaaggaaatcccggactttaaaagtccgggtttttatatttgtaaatacatacgtacaaatataaatgagatagaaaatgtcgttgacatgtacgaacatatataatatggttactttaaaagcgcttacattcatgctgactcctcaggcaaaagacagatcacatatttgactgtggtgcttttcatatccgtatgaaaggaatgatcagaggcatgtctgaacatcaagcagtgattcaaacagatatcgtaaaaggaaccattaacaaaaatatatacggtcattttgctgagcatttaggaagagggatttatgaggggatctgggttggaacggactcagacatccccaatatcaacgggatacgaaaggacgtgctggaggcgctcaaacagctgcacattcctgtcctcaggtggccgggcgggtgttttgcggacgaataccattgggcaaacggtgtcggtgaccgtaagacaatgctgaacactcactggggcggtacaattgaatcaaatgaattcggaacgcatgaatttatgatgctttgcgagctgcttgaatgcgagccatatatttgcggcaatgtcggaagcggaaccgttcaggaaatgtcggagtggattgagtatatgacatttgaagaaggcacgccgatgtcagactggagaaagcaaaatggaagagaagagccttggaagctgaaatatttcggcgtgggcaatgaaaactggggctgcggcggcaacatgcatcccgaatactacgcagatctgtaccggcgttttcagacttatgtccgcaattacagcgggaatgacatttataaaattgcaggcggcgcaaatgtggatgattttaattggacggacgtgcttatgaaaaaagccgctggcctgatggacgggttgagtcttcattattacacgattccgggggatttctggaagggcaaaggatcagccacagaattcacggaagatgagtggtttattacgatgaaaaaagccaaatacatcgatgaattgattcaaaaacacggcacgatcatggaccggtacgatccggagcagcgggtcgggctgattattgatgaatggggcacttggtttgatcccgagccaggcacgaatcccggtttcttatatcagcaaaacaccattcgtgatgcactggtggcggcttctcatttccacattttccatcagcattgccgccgggtgcaaatggccaacatcgcccaaacagtaaacgttctacaagcgatgattttgactgagggcgagcggatgcttttgacaccgacgtaccatgtattcaatatgtttaaggtgcaccaggacgcttctcttttagcaacagagacaatgtctgccgactatgaatggaagggtgaaacgcttccgcaaatcagcatttcagcgtcgaaacaagctgaaggtgatatcaatatcactatttgcaacatcgatcaccaaaacaaagcggaggcggaaatcgagctgagaggcctacacaaggcagcggaccattccggagtcattcttacggcagaaaaaatgaatgcgcataacacgtttgacgatcctcatcatgtcaaaccggaatccttcagacaatacacgctcagcaaaaacaaactgaaagtaaaactcccgccaatgtcagtcgtcttacttacgctgcgtgctgattcttaatcgcgcaagagcgccggagcttcatgccggcgctctttttcaggttttaaaacagctccggcagggcatggtaaagtacatgacagtgaagaggagatgtgatcttatgcttcgtaccattttaatgattattggggcaattgtagtgatcggggccattatcagatttgtgttttaaaaaaagagcatatcccattcaaccatataaaaatgagtaaaccggctgtgatcaggaaaaaataatttgtaagcattaaaatagcgtgaacgaatgggagatgctatactaaaaatcatcatttcacattggaggaattcaataatggctatcgtaaaagcaactgatcaatctttctcagctgaaacaagcgaaggcgtcgtactggcagacttctgggctccttggtgcggaccttgtaaaatgattgcacctgttcttgaagaattggatcaagaaatgggagacaaactgaaaatcgtaaaaatcgatgtagacgaaaaccaagaaactgccggaaaatacggcgttatgagcatcccgactcttcttgtgttaaaagacggcgaagtagttgaaacttcagtcggcttcaaaccaaaagaagcgcttcaagagcttgtaaacaaacatctttaattttccgctgcttacatgccagagcgattccgattgagggatcgctttttttattcgccaattgtgaaccatagagaaaaacaaacgttcgtgttaaactggaaataaaggattaaacataaggaagggtaacatatgaacaaacaactgaaagaaaaactcgctctccttcctgatcaaccgggttgttatctcatgaaggaccggcagcagactgtgatctacgtagggaaagcaaaagtgctgaaaaacagagtgcgctcctacttcaccggttctcacgacgcgaaaacccaaaggcttgtgacggaaatcgaggattttgaatatatcgtgacgtcctccaatcttgaagcgcttattttagaaatgaatctgatcaaaaagcatgatccgaaatacaacgtcatgctcaaagacgacaaaacctatcctttcataaaactcacccatgaacgccacccaaggctgattgtcacccgcaatgtcaaaaaagacaaagggcgctatttcgggccgtatccgaatgtacaggcagcaagggaaacaaaaaaactgctcgaccgtctgtatcctctcagaaaatgctccaagctcccggacagagtgtgcctttactatcatctgggccaatgcctcgctccgtgtgtaaaggatatttccgaagagacgaacagagagctggttgaaagcattacacgtttcttaaggggcggctataatgaggtcaaaaaagagcttgaagagaaaatgcatgaagctgctgagaatcttgagtttgaacgagcaaaagagcttcgtgaccaaatggcccatattgaatcaacgatggaaaaacaaaaaatgacgatgaacgatctagtcgaccgtgatgtgttcgcgtacgcgtacgataagggctggatgtgcgtgcaggtctttttcatccgccaaggaaagctcattgaacgcgatgtcagcatgttcccgctttatcaggaagcagatgaagagttcctcacgttcatcgggcagttctattcaaaaaacaaccacttccttccgaaggagattttagttccggacagcgtagatcaatctatgatcgagcagctgctggaaacaaacgttcaccagccgaaaaaaggcccgaaaaaagaactgctcatgcttgcccataaaaatgcgaaaatcgcattgaaagaaaaattctctttaatcgaacgggacgaggagcgttcaatcggggcagtgcagaaactaggtgaggcattaaatatttatacgccgcacagaattgaagcgtttgataactcaaatatacaggggacaaacccggtttccgcgatgattgtgtttatcgatggcaaaccatacaaaaaggaataccgcaaatataaaatcaaaactgttacagggccggatgattacggttctatgagagaggttgtcagaagacgctatacgagagtgcttcgtgagaatctgccgctgcccgatctgatcatcattgacggaggaaaagggcagatcaacgcagcaagggatgtcattgaaaatgaactcggcttggatatcccgatcgccggtttagcgaaagatgaaaaacacagaacctcaaatttactgatcggtgatccgctggaggtggtgtatctggaacgaaacagccaggaattttacctcctgcagcgcattcaggacgaggtgcaccgttttgcaatcagttttcacaggcaaatccgcggaaaaagcgcgtttcaatccgttttggacgacatcccgggtatcggagagaaaagaaagaaaatgctgttaaagcatttcggttccgttaaaaaaatgaaggaagcaagccttgaggacatcaaaaaagccggtgttcccacagcggcggctcagctcctttacgacaaattgcaaaaataatgttgtccttttaaataagatctgataaaatgtgaactaatttcatagttagatcgtgttatatggtgaagatagaggtgcgaacttcaagagtatgcctttggagaaagatggattctgtgaaaaaggctgaaaggggagcgtcgccgaagcaaataaaaccccatcggtattatttgctggccgtgcattgaataaatgtaaggctgtcaagaaatcattttcttggagggctatctcgttgttcataatcatttatgatgattaattgataagcaatgagagtattcctctcattgctttttttattgtggacaaagcgctctttctcctcacccgcacgaaccaaaatgtaaagggtggtaatacatgggtcttattgtacaaaaattcggaggcacttccgtcggctcagtcgaaaaaattcaaaatgcggcaaaccgcgcaattgcagaaaaacagaaaggccatcaagtcgttgtcgtcgtttcagcaatgggaaaatccactgacgaattggtcagccttgcaaaagctatttctgaccagccgagcaaacgcgaaatggatatgctgctggcgacaggcgagcaggtcacgatttcactcctttcaatggcattgcaggaaaaaggctatgacgctgtgtcttatactggctggcaggcgggaatccgtacggaggccattcacggaaacgccagaattacagatatcgacacttcggttttagcagaccagcttgaaaaaggaaaaattgtcattgttgcaggattccaaggcatgacagaggattgtgaaattacgacattgggccggggcggttcagatacaacagcagttgctttggctgccgctttaaaagctgataaatgtgacatatacacagacgtgccaggcgtgtttacaaccgatccgcgctatgtgaaatcagcgagaaaacttgagggcatctcatacgatgaaatgcttgaacttgccaatttaggcgccggtgttcttcatccgagagcagttgagttcgcgaaaaattaccaagtgccgttagaagtgcgttcaagtacagaaaccgaagcgggaacattaattgaggaggaatcatccatggaacagaatttaattgtcagaggcattgcatttgaagatcaaatcacaagagtaaccatttacgggctgactagcggcctgacaactttgtctactatttttacaacacttgccaaaagaaacataaacgtggatatcattatccaaacgcaggccgaggacaagactggaatttccttctctgtcaaaacagaagatgcagaccaaaccgttgcggtgcttgaagagtataaagacgcgctggaatttgagaaaatcgagacagaaagcaaattggctaaagtatctattgttggatccggcatggtctcaaatcccggtgtagcggctgaaatgtttgctgtactggcgcaaaaaaacattttaatcaaaatggtcagcacatctgaaatcaaagtgtcaacagtcgtaagcgaaaatgacatggtgaaagcagtcgagtcgcttcacgatgcatttgagctttcaaaacacccttcagctgtgtaatgacaatcaaaaaggcgggactatgcagtcaccgcctttttgattacactgggtctttcatatcccatttcacagtcagaaccactttatcggctctctttttcacttgttcatatgattcggcaatctgatcattcatcaattgaatttgttcagcgataaaaccagcctccagctgaaagcaaggttctttctgatgtttaagccggttggaaatgatcggcccttcaagttcaaattcaagctcctgttttttagcgcttacgttggtgagggttccccagcccgcttcttcaaagaaggccggaaattcctcccatgattcaagaggaaacttacgggcgagatgttttcctgcccaatacatcatggaagagtaatcttggccaagcatatctgggagaacgatctctcgtattagttcgtaggcataggcgttcatttcaatttcttttaggttgtcaatagatgcttcaaatttagacttcatatctgtctcccctctctcctgcgtatattatagctcaaacaggggggaggattacagaatgatcctgtaattcttatgaaaaattaagtaagaaatatatattgataaaataaaatttttcaatcaactaaccaattcggaaaattataatttatgtacgcgttttcttgacgcccttttgagggaggagtaaaatgaaattgtcaataaatcttaataaagtgcttacaattgaaagaagtgggggaagagatttagcacatttcgcacttatcaaacagggggtaaagtaatgtctgggaacagagagttttattttcgaagattgcattccttgcttggcgtcataccggtcggcatctttcttattcagcatttagtcgtcaaccagtttgccgcaaggggcgctgaagcattcaatagcgctgctcattttatggatagtctgcctttcaggtatgccttggaaatttttattatcttcttaccattaatttatcatgcagtttatggtgtgtacatagcgtttactgcgaaaaataacgcaggtcaatacagctacatgagaaactggctattcgtcctgcagcgtgtaaccggtatcatcaccctcattttcgtcagctggcacgtgtgggaaacccgcattgccgcacaaatgggcgctgaggtcaatttcgacatgatggcgaatattttgagctctccggctatgcttggtttttacattgtcggtgttttatcaacaattttccacttctcgaacggtttatggtctttcgctgttacatggggcatcacggtaacgcctcgttctcaaagaatttcgacatacgttacgctgattatttttgttgcactgtcatacgtaggcttaaaagcgattttcgcatttgtttaagagtactagattactagagggagaggggctatcatgagtcaatcaagcattatcgtagtcggcgggggtcttgccggcctcatggcgacaattaaagcagcggaatcaggaatggcggttaagttgttttccatcgttcctgtcaaacgttctcattcggtttgtgcgcaaggcggcataaacggagcggtcaatacaaaaggggaaggtgactctccgtgggaacattttgatgacacggtatacgggggagactttcttgccaaccagccgccggtcaaggcgatgtgtgaagcggcgccttcaatcatccacttattagaccggatgggcgtcatgtttaaccggacgcctgaaggcctgcttgatttccgccgattcgggggtacacagcaccacagaactgcttatgctggtgcgacgacgggacagcagctgctttacgcactggacgagcaagtgcgcagatacgaagttgcgggtctggtcacaaaatacgaaggctgggaattccttggcgctgttttagatgatgacagaacctgccgtggaattgttgcacaaaacctgacaaacatgcaaattgaatccttccgttcagacgctgtcattatggcgacgggcggaccgggaatcatctttggaaaatcaacgaactccatgattaatacaggatctgctgcatcaatcgtttatcagcagggagcgtattatgcaaacggagaattcattcaaatccacccgacagccataccgggcgatgacaaattaagactgatgagtgaatcagcgcgtggtgaaggcgggcgcgtgtggacatataaagacggcaaaccatggtatttcctggaggaaaaatatccggcatacggaaacctggtgccgcgtgatattgcgacacgcgaaatatttgatgtgtgtgtgaaccagaagctcggcattaacggtgaaaacatggtatatctcgatctgtctcataaagatccgaaagagcttgatattaagcttggcggcatcattgagatttatgagaaattcatgggagacgacccgcgtaagctcccaatgaaaatcttcccggcggtccattattctatgggcggtttatgggtagattacgatcaaatgacaaacatccctggactgtttgcggctggggaatgtgattattctatgcacggcggcaaccgcttgggagcgaactccctgctgtctgcgatttacggaggcatggtggccggtccgaatgcggtgaaatatgtaaacggcttagaatcttcagcggaagacatgtcttcatctttattcgacgctcacgttaagaaagaagaagaaaaatgggctgatattatgagtatggacggaaccgaaaatgcctatgttcttcacaaagagctcggtgagtggatgacggcgaacgtaacggttgtccgccataatgacaagcttttgaaaacggatgacaaaattcaggagttaatggagcgcttcaaaaagatcaacatcaatgacacgacaaaatggagcaaccagggagcgatgttcacacgccagttctcgaacatgcttcagcttgcgagggtgattacccttggcgcatacaaccgtaatgaaagccggggcgcccattataaaccggattatcctgaacgtaatgatgacgaatggctcaaaacaacaatggctaaacatgtaagcccgtatgaagcgccggaatttgagtatcaggatgtcgatgtatcactgataacgcctcggaaacgggattactcgaagaagaaggtggcgaaataatcatgagtgaacaaaaaaccatacgatttattatcacacgtcaagatacagccgacagcacgccttacgatgaagaatttgagattccataccgcccgaatctgaacgtcatttccgctctgatggaaatccgccggaatccggttaatgtcaaaggtgagaagacaacccctgtcacatgggatatgaactgtcttgaggaagtatgcggcgcatgttcaatggtcataaacggaaaaccccgccagtcttgcacggcgcttatcgaccagcttgaacagccgatccgtttaaaaccaatgaaaacattcccagttgttcgtgatttgcaggttgatcgcagcagaatgtttgattcattgaaaaaagtaaaagcgtggataccgattgacggtacgtacgatttaggaccggggccgagaatgccggaaaaacgccgtcaatgggcatatgaattatcaaaatgcatgacatgcggcgtctgcctcgaagcttgcccgaatgtgaacagcaaatcgaagttcatggggcctgcaccgatgtcgcaagtccgcctgtttaacgcgcatccgacaggcgccatgaataaatctgaacgattagaagcattaatggatgaaggcggccttgcagattgcggcaactcgcaaaactgtgttcaatcctgtccgaaggggattccgcttaccacttcgattgcagccttgaatagagatacaaacttacaagcgttccgcaatttcttcggaagcgacagagtataagaagaaaaaacctcttccgcatgggagaggtttttttaaacaataaggagatgaaaaaagatgaagcttcccgcttatattgatatgccgtttcaagaatggaaaacatccttttcttttgttaatgaggtatccgtaagattttccgagacagacatgtttgggcatatgaataatgtaaccccttttatatattttgaggaggcgcggatttcttattttaaaaagctgaatatgatgagtgaaaacaaacagaccatgacagtcgtggcaagccagcaatgcgattatttgcgccaagtcatgccttatgaagaattgcgcatctatgtgaaaataagcgcagtcggcagttcatctcttaccttgcactatctcggagagaacctcgaaggcgaaccctgcttcaccggggcagtcgtgatggttcaagtctcaaaggaaagcggcaaggctgtcagctggacggatgaggagaaagaaacgcttcttcatacacgataaactaattatcttgtaaacgtcacctcctgcgcccttcttacatatgatatctcgactatatcaaaacccattcgtttctgattcgctctcaccttagcaaggagggttacaatacttgaaggagaaagaatttcaatcgaagccgctgctaacgaaaagagaaagagaagtgttcgaattgctcgttcaagataagacaacaaaggagattgcaagcgagctatttatcagtgagaaaaccgttcgaaaccatatttcaaatgccatgcagaaattgggtgtgaaagggcgttcgcaagccgttgttgagcttcttagaatgggtgagctagagctttaatccttgccggtattccttcttttggaaggagccggttattgctgtttgtttggaacattcgaaaccatatttggaatgctgtgcaaaacgtaggcaagtcataaattaaattttatttcttgatgttgtttgactaaagtcctctatttctctcctgcgagtcttgcattttcttcaaaaaagaaggaaaatagacacggaacgcttttgtgcgtaagagatccttgagtgagggatggacaaatgacatcaaaacctttggagcatgttgcggatattgaaaagtcactccgccacattgccgcgatcattaagcaaaaaggacgagaaatccttaaccaatatgcgattacgccgccgcaatttgtcggcttgcaatggctttatgaattaggagatatgacaatcggtgaattatcgggcaaaatgtatctggcatgcagcacgacaacggacttaatcgaccgcatgcaaaaaaatgagcttgttgagcgggtcaaggacccggcggacagacgtgttgtcaggatacatctgctgcctgaaggagaacggattatccaagaggtcattacaaaaagacaggaatatctgcgtgatatgttcgaatcgtttacagatgaagaaatagccatcttcgaaaaatctttgatgaaactgcagcatgaaatgaagagaaaatgaggcgattttgttggaacaaccaataggagtcattgattccggggttggcggtttaaccgttgcgaaggaaatcatgagacagctacctaaagaaaatattatctacgtcggggatacgaaacggtgtccttacgggccgcgccctgaagaagaggtgcttcaatatacgtgggagctgacgaattatttactcgaaaaccaccacatcaaaatgctcgtgatcgcctgtaatacagcaacagcgatcgctttggatgacatccagcgcagcgtcggtataccggtggtcggagtcatccagcctggtgcgagagcagcgataaaagtgacggataatcagcatatcggtgtcatcggcacagagaatacgattaagagcaatgcatacgaagaagcgcttttggcattaaaccctgatttgaaggttgaaaaccttgcctgcccgctgcttgtgccttttgtggaaagcgggaagtttctcgacaaaacagcagacgagattgttaaaacctcgctgtatccgttaaaagacacatcaattgattcgctgattttaggctgcacccattaccctattttaaaagaagccattcaaagatatatgggagagcacgtaaacattatttcgtccggcgatgaaacagcccgggaagtcagcacaattctctcttataaagggctgctgaaccagtctccgattgccccggatcatcagttcctgacaacaggggcgcgtgatcagtttgcaaaaatcgcagacgattggtttggccatgaagtcgggcatgtggaatgtatctcactgcaagaaccgattaaaagatagttttccccgcaacggtatgttgcgggtttttttctgttttgccggaattcttcggtctatttcctaaagaggctcgtatacataatagtacaaacatccttaggagggaaaagtatgctgaaaaaaggacctgcagtcattggtgccacttgtctcacctctgccttgcttttatccggatgcggtttgtttcaatctgataaggcagccgaggaaattgatccgcctcaagacgttacattcgtgaacgatgaagcgggtgccaattcaaatacaacagcagccaaaaaaacagaaagtgaaaaaagcgataccgcaaaagcggatcaagcctcatctactgttatgagggagctttatctcattgataaaaacgggtatgttgttgcgcaaacgctgcctcttcctaaaagtgagagcacggctaagcaggcgcttgaatacctcgtacagggcgggcctgtgtctgaaattcttccgaatggcttcagagctgtattgccggctgacaccaccgttaacgttgacatcaaaaaagatggaacggcgatagctgatttctctaatgagttcaaaaattataagaaagaagacgaacagaaaatcgttcaatctgtgacgtggacgctgacgcaatttagttcgatagataaagtgaagctgagaataaacgggcatgaactgaaggagatgcctgtaggagggacgccgatctcagatgatttaagccgcaaagacggcattaatttggaaacagccggtgtaaatgatctcactgctacccatccgctgacagtctactatttggcggaaaatgaagacagtgaatactacgtgccggtgaccaaacgaatcgacaattcggaaaaagacgacatcacagcagccattaatgaattggctaaagggccgagcaaggtgagcgggctgttaacagacttcagtgaagatgtaaagctggtcagcaaaccgaaaatcaaagacgggcgcgtgacgttggatttcaatcaatctatattcggcagcgccgatgagaagacgaaaatgatttcttcagaagtgctgaacagcattgtgctgacgttaacggagcagccggatgtaaaaagcgtctctgttaaagtgaacggaaaatcagagctggtaaatgaaaaaggcgaaaagctcacagaaccggtctccagaccatctcaagtgaatacgggtagtttttaaattgggatttttgatatactaggaagaaagaggttagcgttccggctgcctctttctttattcaattccgggacaaaaatggtttatgtacatacaatcggaggtaaaacatgagacatgacggaagacaacacgatgagctgcgtccaatcacattcgatttggattttatcagccatccggaaggttctgttctaataacagcgggaaatacaaaggtaatctgcaacgcgtctgttgaggaccgcgtaccgccgtttttgcggggcggagggaaaggctggattacagcagagtacagcatgctgccgcgggcaacaaaccaaagaacaatcagagaatcttctaaggggaaaatttccggcagaacaatggagatccaacgcctgatcggccgcgcgcttcgagctgttgtagatctggaaaagctcggtgaacggacgatttggattgactgtgatgtcattcaagctgatggaggaactagaacagcttccattacaggcgcatttcttgctatggcgattgcgattggcaagctgatcaaagcaggaacaatcaagacaaatccgatcactgattttcttgctgcaatctctgttggaattgataaggaacagggaattttgttagatttaaattatgaagaagattcctctgctgaagttgacatgaatgtcatcatgacaggcagcggccgttttgtggaattgcagggaaccggggaagaggcaactttttctagagaggatctgaacggtcttctgggtcttgcggaaaaaggaatccaagagctgattgacaagcaaaaagaagtgctgggtgattctctgccagaactgaaataaagacagaaaggcttgatcatcatgaaagaagcaattattgcaacacataatccgggaaaagtgaaggaattcaaagaaattcttgagccaagaggctatgatgtcaaatctttagctgaaattggattcacagaggaaattgaagaaacaggccatacatttgaagaaaatgccattatgaaagcggaagctgttgccaaagcagtgaacaaaatggtgattgcggatgactccggactatccatcgataatcttggcggcagacccggggtttattcagcccgctatgcaggggaacagaaagacgaccaggcaaatatcgaaaaagtgctcagcgagctgaaaggtatcgaaaaagaacagcgcaccgcccgtttccgctgcgcactggccgtgagtattcccggagaggaaacaaaaacagtcgaaggccatgttgaagggtatattgctgaagaaccgagaggagaatatggctttggctatgacccaatttttatcgtgaaagataaagataagacgatggctgaactgacaagtgatgaaaaaaataaaatcagccatagggctgacgcgcttaaaaagctgtctaagcttttggaggcataaggaggaagcttgtacatgaacgtgctgattatcagtgacagccatgggcttgaagaagaactccaaaccattgcgaaacggcatgaggcagaagttgatctcatgattcattgcggggactctgagcttgagacgaggcatcctgcattggagccttatgcggttgtaaaaggcaattgcgattttgccggcgattttaaggacgagcttcttctgactgccggctcaagaaaaatactagtcacacacggccaccttcacggtataaaacagaccttgttaaacgtatactatcgtgcagaggagctcggggcggatgttatctgcttcgggcattcgcacatcgcgggaagcgaagtgctgcgcggaaaactgatgattaacccaggcagcatccggcttccgagggtgcgcaggacagaaagctatgctatactgacattagaaaatgatgctgcgacagtccgtttttacgaccaagcaggcaatgaaattgaggatctgcaaaatcgagtcacactatgaaaatgtcatgaggaagaaaattttcttcctcatgaaaaaaattctaaaaaaccgttgacttattattgcatcccatatataataaatcttgtcgctgatagttaaagcgaaaaacaaaaaacaaaacgtgtcccagtagctcagctggatagagcaacggccttctaagccgtcggtcgggagttcgaatctctcctgggacgtaccaaaagaaaaacctcaaatccatttaggatttgaggttttttgttgtcggtctatgattttcatttgttatttaacggatcatcatccaagccgtcaacttttccttctttattcagacgaggttcttcttttttcacagtttcagaaatatgttcattttcttcaacagtgcgtttgccgacaaccacttcatcagtgacaaccggttttttagtcacttccagcttttcctcaacgattggaactctgatctcttccgaatcgttgacgggagcagcgtccgttttattttcatccactggacggcgttcgacataaatttcatcatgtctcaccggaatgtccatatctcttttttctgttttcacttcttttcctatttctacttcgccggtttgaacgtcttccttatcgaccttcagctgttcttcccggagcggcatcgttttttcttctttcgttgtataatccaattcatttgtgcttgaaaagccgcctgaaagggcattgccgttatcaataggagcaattacatctgcatctgtatcgacggctaccagaagttttccgtcatccaaatcttcttgatacttgtctatttcatcagttttaatatccaagtcggataatgctttgctgtgtgtagcagtatcatccattgtgaaataatctttcagtttatcgaaaaaagattcagattcgtcctgatgtgcatcgatagcttgattgacttctgttcctgtacgtgactccaaataatctgtatctcgccggcttgtcacaacagaaatgtcatcagaatcatagccttttgtaagtaagccttcaatcgctgcgatggtttcctgcggagtttcatatacaccaactatgcttttcatatcaatctcctcctttatgaatttgcatgatatcgttcatgtcgtttgtaattcccgctgttctttgaattaaacaaaattgaaaacattggcgtgtatcataaaggtgaaaaatgtgtgaatataaaaaaagatagataagacagaccttcccctgcacttatctatccttataaagccgtctcacaatttcttcgtcataaacacactgtttggatcttcaccgtagtctgcaaacggttcacaatactggaaaccgaagctttcatacaattttcttgccggctcaaatgaagccattgaacccgtttctaagcttaaccgctcatagcctcgcttctcggcttcttcaatgatgtgctggagaacttgtttggcaacgccttttcttaaatgtgatgcagatgttcgcattgatttgatttctccatgccgggtgtccagttcttttagcgctccgcagccagctagttcatcaccttcccatgcgctccaaaatgttatttcaggccctcttagtttttctagacctaaggcatgaatgctttctggcggggacataagcgtcatgctatgtaaatgctcattcaccagtgaaaccacctgacgtccagttaaatcgtctatttttatatgcaattttattcctcctcgaaaacttacggattgtgcagaatatcgttcaattcatcttaatcatattccatcctgtttccaaatataaagacagaaaatgtgactgtacttgtgaagtcgttttaaaacaataaaaggaccgcaatagatgttcggcccttgtggtattctttaatatctaaagcctccgtgtacgcctggcgccccgctgaatccgccggcatgtatcgctggagcacttaagctgccgccatggccgctaaagcctgcacctgaaaattgctgtccgtaaaatcctgaagcgtatgggaatgaggagtacattccagagggagtggttaacgggctgtatgcctgactgaacggctgtccgtatccgtagcctccaaatggctgctggctttgctggtaaaagggagggacagcaggatagtactgctgcggaaagttggggaagcttggaaagcccgcaggaaatccttgcatgtctgcaaatgatttattcatcgtatcaccttttctttgcaagatatcattaatgtatgccgagggaacaagagaagtgcctatccgaaattgaaatggattgcaagatgatctgtcagactcaatccatatacgaaccatatcgtgttataaaatcttccatgtttatataaaattaaataattctggtgtattcttgatagattaataaaaaaattataaaaacttttaacatttgcaattccttttgtaccaataatgaaagcgtatacaatatagattgattaatcaaaattgtctaataattttaaaaaatgctgttgacactgcgtccaaagcggcgtaatatgagttcaacaaaagataaatgcaagcttcacaagcgaaaatcatcgcagtatgattctaaaaaaatgaaaaacaaacgaccttcttgaacagctggaaagccgttccgaaggctgaatatgaaaagcgcagatgaggataagtagccttgataaagttttccacagagaaccgggttagctgagaaccggcgaagctttacaaggtgaactcgcctcagagtgccagtctgaaatgacagtaggacttggccgggtgaacttgattcactcgttactaaagcggatagaaatatccatgagacggccgattaacaggccgtaaacaagggtggtaccgcggaaagaaaagccttttcgccccttttagctatcgcagttactgcgcggctgattgtgggcggaagggctttttttattgaataatcagctatctagctaatgaaaagatgatctttaaaggatgaaaatccaaaaggaggaactaaaatggggactaatgtacaggtggattcagcatctgccgaatgtacacagacgatgagcggagcattaatgctgattgaatcattaaaaaaagagaaagtagaaatgatcttcggttatccgggcggggctgtgcttccgatttacgataagctatacaattcagggttggtacatatccttccccgtcacgaacaaggagcaattcatgcagcggagggatacgcaagggtctccggaaaaccgggtgtcgtcattgccacgtcagggccgggagcgacaaaccttgttacaggccttgctgatgccatgattgattcattgccgttagtcgtctttacagggcaggtagcaacctctgtaatcgggagcgatgcatttcaggaagcagacattttagggattacgatgccagtaacaaaacacagctaccaggttcgccagccggaagatctgccgcgcatcattaaagaagcgttccatattgcaacaactggaagacccggacctgtattgattgatattccgaaagatgtagcaacaattgaaggagaattcagctacgatcatgagatgaatctcccgggataccagccgacaacagagccgaattatttgcagatccgcaagcttgtggaagccgtgagcagtgcgaaaaaaccggtgatcctggcgggtgcgggcgtactgcacggaaaagcgtcagaagaattaaaaaattatgctgaacagcagcaaatccctgtggcacacacccttttggggctcggaggcttcccggctgaccatccgcttttcctagggatggcgggaatgcacggtacttatacagccaatatggcccttcatgaatgtgatctattaatcagtatcggcgcccgttttgatgaccgtgtcacaggaaacctgaaacactttgccagaaacgcaaagatagcccacatcgatattgatccagctgaaatcggaaaaatcatgaaaacacagattcctgtagtcggagacagcaaaattgtcctgcaggagctgatcaaacaagacggcaaacaaagcgattcaagcgaatggaaaaaacagctcgcagaatggaaagaagagtatccgctctggtatgtagataatgaagaagaaggttttaaacctcagaaattgattgaatatattcatcaatttacaaaaggagaggccattgtcgcaacggatgtaggccagcatcaaatgtggtcagcgcaattttatccgttccaaaaagcagataaatgggtcacgtcaggcggacttggaacgatgggattcggtcttccggcggcgatcggcgcacagctggccgaaaaagatgctactgttgtcgcggttgtcggagacggcggattccaaatgacgcttcaagaactcgatgttattcgcgaattaaatcttccggtcaaggtagtgattttaaataacgcttgtctcggaatggtcagacagtggcaggaaattttctatgaagaacgttattcagaatctaaattcgcttctcagcctgacttcgtcaaattgtccgaagcatacggcattaatggcatcagaatttcatcagaagcggaagcaaaggaaaagctggaagaggcattaacatcaagagaacctgttgtcattgacgtgcgggttgccagcgaagaaaaagtattcccgatggtggctccggggaaagggctgcatgaaatggtgggggtgaaaccttgaaaagaattatcacattgactgtggtgaaccgctccggggtgttaaaccggatcaccggtctattcacaaaaaggcattacaacattgaaagcattacagttggacacacagaaacagccggcgtttccagaatcaccttcgtcgttcatgttgaaggtgaaaatgatgttgaacagttaacgaaacagctcaacaaacagattgatgtgctgaaagtcacagacatcacaaatcaatcgattgtccagagggagctggccttaatcaaggttgtctccgcaccttcaacaagaacagagattaatggaatcatagaaccgtttagagcctctgtcgttgatgtcagcagagacagcatcgttgttcaggtgacaggtgaatctaacaaaattgaagcgcttattgagttattaaaaccttatggcattaaagaaatcgcgagaacaggtacaacggcttttgcgaggggaacccagcaaaaggcgtcatccaataaaacaatatctattgtataaaacataacaagggagagattgaaatggtaaaagtatattataacggtgatatcaaagagaacgtattggctggaaaaacagtagcggttatcgggtacggttcgcaaggccacgcacatgccctgaaccttaaagaaagcggagtagacgtgatcgtcggtgttagacaaggaaaatctttcactcaagcccaagaagacggacataaagtattttcagtaaaagaagcggcagcccaagccgaaatcatcatggttctgcttccggatgagcagcagcaaaaagtatacgaagctgaaatcaaagatgaattgacagcaggaaaatcattagtattcgctcatggatttaacgtgcatttccatcaaattgttcctccggcggatgtagatgtattcttagtggcccctaaaggcccgggacacttggtaagaagaacatatgagcaaggagctggcgtacctgcattgttcgcaatctatcaagatgtgactggagaagcaagagacaaagccctcgcttatgctaaaggaatcggcggcgcaagagcgggcgtattagaaacgacatttaaagaagaaacagaaacagatttgttcggtgagcaagcagttctttgcggcggattaagcgcgcttgtcaaagccggatttgaaaccttaactgaagcaggttatcagcctgaacttgcatacttcgagtgtcttcatgagctgaaattaatcgtagaccttatgtacgaagaaggacttgcaggaatgagatattcaatctctgacacagcacagtggggagatttcgtatcaggccctcgcgttgtggacgctaaagtaaaagaatctatgaaagaagtattaaaagatatccaaaacggtacattcgcaaaagagtggatcgtcgaaaaccaagtaaaccgtcctcgtttcaacgctatcaatgcaagcgagaacgaacatcaaatcgaagtagtgggaagaaagcttcgtgaaatgatgccgtttgtgaaacaaggcaagaagaaggaagcggtggtctccgttgcgcaaaattaattttttcgatacgacgcttcgtgatggtgaacagtcccctggagtgaacttgaatacacaggagaaacttgccatagctaagcagctcgaaagactcggggcagacatcattgaagcgggatttcccgcttcgtcccgaggtgactttttagctgttcaggaaatcgcaagaaccattaaaaattgttcagtaactggtctggcccgttgtgtaaaaggtgatattgatgctgcttgggaagcgttaaaggatggcgctcaaccaagaattcatgtatttatcgcgacatcggacattcatttgaagcacaagctgaaaatgacacgtgaacaagtcattgaaagagcagttggaatggtgaaatacgcaaaagaacgttttccgattgtgcaatggtcagctgaagatgcctgccgcactgaactgccgtttctagcagaaatcgtcgagaaagtgattgacgcaggcgccagtgttatcaatcttccggacactgtcggctacctggccccggcggaatacggaaatatctttaaatatatgaaagaaaacgttccgaacattcacaaagcaaagctttcagcccactgtcatgatgatttgggaatggcagtcgcaaactctcttgctgcgattgaaaatggcgctgatcaaatcgaatgcgctgtgaacgggatcggtgaaagagccggaaacgcggcattagaggaaattgccgtagccctccataccagaaaagatttctaccaagtcgaaacaggtattacgctgaacgagattaagagaacaagtgatttagtaagcaaactgacaggcatggctgtcccgcgcaacaaagcggttgttggagataatgcatttgctcatgaatcaggcatccatcaggacggctttttaaaggaaaaatcgacttatgaaattatttcaccggagcttgtcggcgtaaccgcagatgcgcttgtcctaggtaaacattccggacgccacgcatttaaagaccggctgactgctttaggattccaatttgacagtgaagagattaataaattctttacgatgttcaaagagttgactgagaagaaaaaagaaatcactgatgaggatcttgtttctcttattttagaagaaaaagtaacagatcgcaagattgggtatgaatttctttctctgcaagtacattacggaacaagtcaggtccctacggctactctatctttgaaaaatcaagaaaacgcacagcttattcaggaagctgcaactggagctggaagcgtggaagcaatctacaatacgcttgagcgctgcatcgataaggatgtggagctcttagactaccgcattcagtctaatagaaaaggcgaagatgcatttgcccaggtgtatgtaagagttttggtgaacggaaaagaatcagcagggcggggcatagcgcaagacgtattagaagcatcagcgaaagcctatttgaacgcagtaaaccgtcaattggttttccagtcgaatatgagcggattgaaaaaccacacagctgtcggatcataaaagaaaggagaacggttaacttgaagaaacgtattgctctattgcccggagacgggatcggccctgaagtattagaatcagcgacagacgtactgaaaagtgttgccgaacgctttaaccatgaatttgaatttgaatatggcctgattggaggggcggctattgatgaacatcataaccccctcccggaggaaaccgttgctgcttgtaaaaatgcagacgcgatattgcttggtgctgtcggcggaccgaaatgggatcaaaatccttcggaactgagaccggaaaaagggctgctcagcatcagaaaacagcttgatttgtttgcgaatttgcggcctgtgaaggtatttgaaagcctttctgacgcttcgcctttgaaaaaagaatatatagataatgttgatttcgttatcgttcgtgagctcacaggcggcttgtatttcggccagccgagcaaacgttatgtaaacactgaaggtgagcaggaagcagtagatacactgttttataagcgaacggaaattgaacgagtgatcagagagggcttcaaaatggcggcagccagaaaaggcaaagtgacctctgtagataaagcgaatgttcttgaatcaagccggctgtggcgtgaagtggctgaggacgttgcacaagaatttcctgatgtgaagcttgagcacatgcttgtggataacgcggccatgcagctaatttatgcaccgaatcaatttgatgtcgtggtgactgaaaatatgttcggtgatattttaagcgatgaagcgtccatgcttacaggctcgctcggaatgctcccgtcagccagcctatcaagctctggccttcatctgtttgaacctgttcatggctccgcgcctgatattgccggtaaagggatggcaaatccgttcgcagccatattgtcagcggcaatgcttttgagaacatctttcgggcttgaagaggaagcgaaagctgtagaagatgcggtaaacaaagtcttggcttctggaaaaagaacaagagacttggcacggagtgaagagttcagcagcactcaggccattacagaggaagttaaggcagcaatcatgagtgaaaatacaatttctaatgtgtgacagcttacgttaagcggtcttagctctaggtagagggaggaaataaaagatgatgcctcgaacaatcatcgaaaagatttgggatcagcatattgtaaaacatggtgagggaaagccggatcttctctatattgatttgcacctcattcatgaggtgacgtctcctcaggcatttgaaggcttgagacaaaagggaagaaaggtcagaagaccccaaaacacatttgcgacaatggaccacaacatcccgactgtcaatcgttttgagataaaggatgaagttgcgaaacgccaggtaacggcgcttgaaagaaactgtgaggaatttggcgtgcgccttgccgatcttcacagtgtggatcaagggattgtccatgtcgtcggacctgaactaggcttaacgcttccagggaaaacgattgtgtgcggtgacagtcatacatcaacacatggcgctttcggcgctcttgcatttggaatcgggacgagtgaagttgaacatgtcctttccacacagacactttggcagcagcgtccaaaaacacttgaagtgcgcgtagatggaacgcttcaaaaaggggtaacggcaaaggatgtcatccttgctgtcatcggcaaatacggtgtgaaattcggcacaggctacgtcattgaatacactggggaagtattcagaaatatgacgatggatgaacgaatgactgtttgtaacatgtcaattgaagcaggagcaagagcaggtttgattgcacctgacgaggtgacgtttgaatattgcaaaaatcgcaagtacacgccaaaaggcgaagaatttgacaaggccgtagaggaatggaaggcgctgcgcacagacccgggcgctgtttacgataaatctatcgtccttgacggcaacaaaatttcccctatggtgacatggggcattaacccgggaatggttcttcctgtcgattctgaagttcctgcgccggaaagcttttctgcagaagacgataaaaaagaagcgattcgtgcttatgaatatatgggattgactcctcaccaaaaaattgaagacattaaagtggagcacgtatttatcggttcctgcacaaattcccgcatgactgaccttcgacaggctgctgacatgatcaaagggaagaaggtagctgacagcgtaagggccatcgtcgtgcccggatcccaaagcgtgaagcttcaggctgaaaaagaagggcttgaccagattttcttggaagctggatttgaatggagagagtcaggctgcagcatgtgtttgagtatgaataatgatgttgttcctgagggagagcgctgtgcatcaacctctaaccgcaacttcgagggcagacaaggaaaaggtgcaagaacacatctcgtcagcccggcaatggctgcgatggctgccattcacggacacttcgttgatgtcagaaagttttatcaggaaaaaacagttgtgtaaggagtgcgcgagatggaacctttgaaatcacatacggggaaagcagccgtattaaatcggatcaatgtggatacagaccagattattcctaagcaatttttgaagaggattgaaagaacaggctacggacgttttgcattctttgactggagatatgatgcgaatggtgaaccgaaccctgaatttgaattaaaccagcctgtttatcaaggagcttccattttaatagcaggagaaaacttcggctgcgggtcatcgcgtgaacacgctccgtgggcacttgatgattatgggtttaaaattatcattgcgccgtcattcgctgatattttccatcagaactgctttaaaaacggcatgcttccgatccgcatgccatatgacaattggaaacagcttgtcggccagtatgaaaaccagtcattgcaaatgactgttgaccttgaaaatcagctgattcatgacagtgaaggcaatcaaatttcatttgaagttgatccgcattggaaagagatgctgatcaacggatatgatgaaatttcattaacgctgctgctggaagatgaaatcaagcaatttgaatcacaaagaagctcttggcttcaagcctgaaaaagcggccggtatttgtccggcggctttttttgcctggtgaaacctttcatttcttgtttttgttcacaggtgttgatacacttgaacaaaataaatgcctgaaaggaatataggtatgacgcatgacaagaaaaacgcaaaaattattccttttcctcatctgaaagaccgccttgtggaaaaagggatgtcatcactcaaggaaaaaaagtatcaagaagcgcttgaactgttttcagaagcgatgaaatatgatgatactgaatccgatcttcacttagggatggccatctgctttttagagctgggcgagctggaagaggcagaaagcgtgtgcgagaagatgctcaaagaaggttatggccattattttacggttttgcaggtgtacatgaccatcttaattcagctcaaaaagtacgaagaagtcaaaagcaccattgaagccgttttggaagaaaatcagctgccggcagaaagtgccgagcaattttataagctgctggatttcagccggaaaatgaccgatccggatcgtgaggacgaggcttgggccgaagaatatgaggatacaattgacaccgagaaagtgctggcaagccctgaggagcaaatgaatctcattcattccttaaaagaccgtaacgtagcaaagtatacaggattgctcaaaacaatcctccaagacccctcagcccatccgattatcaaaacgatgattgtcatgctgttggctgagcatgagtacagtaaacctgtacacattagtaaatttggcgagtcgttgacaattgaaccgtcagagattgttccgcctgatgccgcgccgattcttcaccgtgttctcagggtgctagatgagacacttggaaatgaaaatccaaccttatatgcagcagtagaagaattgtggagaagacatttgtacgttttatatccgttccagccgaaattgctgtcggctgacctttgggcggctgcccttcataaagtcggttacgagatgcacgggattgaaattgaaagcgaagaacttcatatgatgtatgaatttacagacagagaactcgatgaagcttgcacaatgttaaaagatattgaagaaatttcttatttgtaaatcgcgccatatagttgaaagcgctatgtgttatgttataatatagtggttgtatttgtgtataacgggttataagaaatacggttggacaggctttgcagttcattattaacatctatacataatgattctgatctttggcagctttgtttttgttggacgaagccgaatgattgctttagaatggaagaccgacacaacctgaatagatttttggagggaaacacatgtctgtaaaatgggaaaaacaagaaggcaacgaaggcgttttaacggttgaagttgatgctgaaacgtttaaaacagcacttgatgatgcatttaaaaaagtagtaaaacaagtttcaattcctggattccgtaaaggtaaaattcctcgcggattattcgaacagcgctttggcgtagaagctctttaccaagatgctttggatattcttcttcctgtagaataccctaaagcggttgaagaagctggaatcgagcctgtagaccgtcctgaaatcgatgttgaaaaaatcgaaaaaggcgaaagcttaatcttcactgcgaaagtaacagtaaaacctgaagtgaagcttggcgaatacaaaggcctgggcattgaaaaagacgacacaactgtaactgacgaagatgttcaaaacgaactaaaagcccttcaagagcgtcaagctgagcttgttgtaaaagaagaaggcgccgttgaagaaggaaacacagttgttcttgatttcgaaggattcgttgacggcgaagctttcgaaggcggaaaagctgaaaactactctctagaagtaggttctggttcattcatccctggcttcgaagatcaattagttggccttgaagcaggtgctgagaaggatgttgaagtgacattccctgaggagtaccacgctgaagatcttgcaggcaaaccagctgtgtttaaagtgaaaattcacgaaatcaaagcgaaagagcttcctgagcttgacgatgaattcgcaaaagatatcgatgaagaagtggaaacacttgctgaattaactgaaaaaacaaagaaacgtttagaagaagcaaaagaaaacgaagctgacgctaaattgcgtgaagagcttgttctgaaagcttctgaaaatgctgaaatcgatgtgcctcaagcaatggtcgacactgagcttgaccgcatgctgaaagaattcgaacagcgtctgcaaatgcaaggcatgaaccttgagctttacactcaattctcaggccaagatgaagctgcgcttaaagagcaaatgaaagaagatgctgaaaaacgcgtaaaatctaacctgactcttgaggcgattgcgaaagcggaaaaccttgaagtatcagatgaggaagttgatgctgagcttacaaaaatggctgaagcatacaacatgcctgttgaaaatattaaacaagccatcggttctactgacgcgatgaaagaagatttaaaagttcgcaaagcaattgattttcttgtagaaaaccgttaatatggtgcataataatagtactaataaaacagggcgcgaatcattcgtgccttgttttgtacaattatgagttatctctttttcttggggcaatatagttaatgcagggctgttttttgtcatacatatagaatgtgcaagtcagaaacacattgttaccgtctttttggaaagtatggtaaaatgcaatacatactcgttcgtttcaagaatcattttcttttgctctgccggtaaaagaaaaagtgagacaagattaaggggtgaaagaatgtttaaatttaacgaggaaaaaggacaattaaaatgctcgttctgtggaaaaacacaagatcaggttcgtaagcttgtagctggacctggtgtatatatatgtgacgaatgtatcgaactctgcactgaaattgtagaggaagaactcggaacagaagaagaagtagaatttaaagacgtaccaaagcctcaggaaattcgcgaaattttgaatgaatatgtcatcggccaagatcaagcgaagaaatcacttgctgttgctgtgtataaccactataagcgcattaactccaacagcaaagttgatgatgttgagctttcaaaaagtaatatttcattaatcggccctacgggaagcggtaaaacccttctggcgcaaacattggctcgcattttaaatgtgccgtttgcgattgcggacgctacatctttgactgaagctggatacgtgggtgaagatgtagagaatattctcttgaagctcatccaagctgctgattatgatgtggaaaaagccgaaaaaggcattatctatattgatgaaatcgataaagtggctagaaaatctgaaaacccgtctatcacacgtgatgtgtcaggtgagggtgtacagcaggcattgcttaaaattcttgagggtacagtggcaagcgtaccgcctcaaggtggacgtaagcatcctcatcaagaattcattcaaattgacacaacaaatattttgttcatttgcggcggagctttcgatggtatcgaacaaatcatcaaacgccgtttaggccaaaaagtgattggattcggtgccgacaataaagctgctgatcttgagaaagaagatcttctttcaaaagtgcttccagaagatttgctccgtttcgggttaattcctgaatttatcggacgtcttccggttattgcaagccttgaaaagcttgacgaagaagcattggttgcgatcttaacaaaaccgaaaaacgctcttgttaagcaattcaagaaaatgcttgagcttgacaacgttgagcttgagtttgaagaagaagcgctttctgaaattgctaaaaaagcaattgaacgcaagactggagcacgcggactccgttctatcattgaaggcatcatgcttgatgtgatgtttgagctgccttctcgtgatgacattgaaaaatgtgtaatcaccggggcaactgtgacacacggagagcctcctcgcctcttattaaaagacggcactgaggtaagccaagataaaacatctgcataaagataagcacaaacctcctgagtggtaacactcaggaggtttttttgcatgcaactcttccggaaaaacgtttattcccgtcttctatgggagatactagcaatcagaggaatgaattggatacataaattgtttttcaggagggaccaccatgagttggacagggatcgcgttatttattcagctgttttttgggatcatcatcggtttgtatttttggaatttgcttaaaaatcaaaggacacaaaaggtcacgatagataaagaatcaaagaaggaaatggagcagcttcggaaaatgcgcgctatcagcttgtccgagccattatctgagaaggtccgccccaaaagctttaaagatatcgtcggacaggaagacggcattaaagcattaaaggcggctttatgcgggccaaatcctcagcatgtgattgtctatgggccaccgggagttgggaaaacggctgctgcgcggcttgtgttggaagaagcaaaaaaacataaacaatcaccgtttaaagagcaggctgtctttgtggaactcgatgcgacaacagcccgttttgatgaaagaggaattgccgatccgctcatcggctctgtccatgacccgatataccaaggggccggagcgatgggacaggctgggattccgcagccgaagcagggagctgtcacccatgcccatggcggtgtgctgtttattgatgaaataggggagctgcatcctattcaaatgaataaaatgctgaaggtgcttgaggacagaaaagtctttttagacagtgcgtattacagtgaggaaaatacacaaattccgaatcatattcatgatatttttcaaaatgggctgccggctgattttcgcttgattggcgcgaccacgagaatgccaaacgaaattccgccagctatccggtcccgctgtttggaggtttttttccgcgagcttgaaaaggacgagctgaaaacggttgccaaaacagcagcggataaaattgaaaaaaatatctccgaagaaggactggatcttttgaccagctacacgcggaacgggcgggaagccgtcaatatgattcaaatcgcagcggggatggctgtaacggagaatcgaaaggacattacgattgaggatattgaatgggtcattcactccagtcagcttactccaaagcacgagcaaaaaatcggtgttgaaccacaggttggcattgtaaatgggcttgcagtctatgggcctaacagcggatcgcttctggaaatcgaagtaagtgtaaccgcggctcaagataaaggatcaattaacatcacaggaatagctgaagaagaaagcatcggcagccaatcaaaatcgatcaggcgaaaaagcatggcgaagggttcggttgaaaatgtattaaccgtgctccggacaatgggaatgaagccttctgattatgatattcacatcaatttcccaggagggattccgattgatgggccgtcagcaggcattgcgatggcggcggggattttctcggcgatacacaaaattcctattgacaataccgttgcgatgacgggcgaaatcagcctgaacggtcttgtgaaacccatcggaggcgtcattccgaaaataaaagcggccaagcagtccggtgcgaaaaaggtgattatcccatatgaaaatcagcaggccatcttaaagcagattgacgggatcgagattattgcagtgaagacgttccaagaagtgcttgatgaaattttggtgaatccgccaacggaacaaaaaccgtttcatatcgaaatcaataaagaatccgtttaaaccctattttgataatagggtttttttcatgaaggacatcttttcctttttcatatcagaaagaaagggtatactacgaggagactgttttatagaaaatggaaccatgccgtttattgtacaaggatgaaaaagttgtattataatggttcatactaaagtcacggaggtgtcagtcacatggcagaagaattaaaacgcagcatcccgctcctccctttaagaggtttattagtgtacccgacgatggttttgcatttagatgtaggacgtgacaagtcggttcaggctcttgaacaggcaatgatgcatgatcatatgatatttttagccactcagcaggatatttcgatagacgaacctggtgaagacgagattttcactgtcggcacctatacaaaaattaagcaaatgctgaagcttccgaacggtacgattcgtgtgttggtggagggcctcaagcgcgcccatatcgtcaaatacaatgaacacgaggattacacgtcggttgacattcaacttattcatgaagatgattcaaaagatacagaagacgaagcattgatgcggactttgctagaccactttgatcagtacataaaaatttctaaaaaaatctcggccgaaacgtacgctgcggttactgatatcgaagagccggggagaatggcagacatcgttgcttctcatctgccccttaaactaaaggataagcaggatattttagaaacggctgatgtcaaagacaggctgaacaaggtcattgattttattaataatgaaaaagaagtgctggagattgagaaaaaaatcggccagcgcgtcaaacgttcgatggagcgtacgcagaaggaatactacttgcgtgaacaaatgaaggcgatccaaaaagagcttggcgataaagaaggcaaaactggcgaagttcagacgctgacggaaaaaatcgaagaagcaggcatgcctgatcatgtgaaagaaacagcgcttaaagaattgaacagatatgaaaaaattccgtcaagttctgcggaaagctctgtgatccgcaactatatcgactggctggttgctcttccgtggacggatgaaacagatgataagcttgatttgaaagaagcaggacgtctcttggacgaagagcaccacgggcttgaaaaagtaaaagaacgtattttagaatatttggctgtccagaagctgacaaaatccctgaaaggcccgattctctgtttggcaggacctccaggtgtcggaaaaacgtctttagccaaatcaattgcaaaaagcttgggacgcaaattcgtcagaatctcactcggaggagttcgggatgaatcagagatacgcggacacagacggacctatgtcggagcaatgcctggacgtattattcaagggatgaaaaaagcgggcaagctgaatccggtcttcttattagacgaaattgacaaaatgtcatctgattttagaggagacccatcatccgctatgcttgaagtgcttgatccagagcaaaacagcagcttcagtgatcactatattgaagaaacctttgatttatccaaagtgctgtttatcgcaacggcgaacaatttggccacaatcccgggcccgctcagagacagaatggaaattattaatatcgcaggctacacagaaatagaaaaacttgaaattgtaaaggatcacttgcttccaaagcaaatcaaagaacacgggctgaagaaaagcaatcttcagctgcgtgatcaggcgattcttgatattattcgttactatacgagagaagcgggtgtaagaagccttgaacgccagcttgccgcaatttgccgtaaagctgcaaaagccattgttgctgaagagcgaaaacgaattacggttactgagaagaaccttcaagattttatcggaaaacgcattttcagatatggacaagctgaaacagaggatcaagttggtgtagtgacagggcttgcgtatacaaccgttggcggagatacgctttcgattgaagtatcgctttcaccgggaaaagggaaattaatcctgacaggaaagctcggagatgttatgagagagtctgctcaggctgcattcagctatgtgcgatccaaaacagaagaacttggcattgaacctgactttcatgagaagtatgatattcatatacatgtaccagagggtgcggtgccaaaagatggtccgtcagccggtattacgatggcaacagcgcttgtttctgctttaacgggacgggcggtttcgcgtgaagtcggcatgactggggaaatcacgcttcgcgggcgcgtgctgccgatcggcggcttaaaggaaaaagcgcttggcgcacatagagcgggattaacgaccattattgcgcctaaagataatgaaaaagatatagaggatattccggaaagcgtcagggaggggctgacatttatattggcgtcccacttagacgaggttttggaacatgccttagtaggagagaagaaatgaaagtcacaaagtcagaaatcgtgatcagtgcagtaaaaccggaacagtaccctgaaggggggcttccggaaatcgcattggccggaagatcgaacgtaggaaaatcgtcttttatcaattcattaatcaatcgcaaaaatcttgcgagaacgtcatcaaagccgggaaaaacacaaacgcttaatttctacattatcaatgatgagctgcattttgtggatgtgccgggctacggttttgccaaagtgtcaaagtctgagcgtgaagcatggggcagaatgattgaaacctatatcacgacacgcgaggaattaaaagctgtggtgcagatcgttgatttgcggcatgcgccatctaatgatgatgtacagatgtatgaatttttaaagtattacggcattcctgttattgttatcgctacaaaggcggataagatcccgaaaggtaaatgggacaaacacgcgaaggttgtccgacaaacattaaatattgatccggaagacgagctgatcctcttttcttcagaaacgaaaaagggaaaagacgaagcttggggagcgatcaaaaaaatgataaaccggtagaggatcctctaccggttttatttatcgtatagatttttttcgttttatcaataataacaataaactgattccaataaagacaaacggccaatactccttcagaagcgctgttggaatatgcgcagactcaagccatgccataatttgtttgaaaaagtacaaaaacagggaaaaacaaatcatcgacacagcttcatatacatattcttttttttgaacggttgaaacgagaagtgagaagccgatcataaagaggagcatttcaaaatcatccggccaccatacccatttcggcttggcaaaaaagtgtaaaccgatcccgaagagaagcaaaccgataaaaaaatggggtgtgacggcttctttttttccttgatatacaaaggctgcgcctaacagcatgaggagaacaggccattgatcctgccctgaaaacagttcggcttggccgctttctagccatgcatatacagaagcggcaagcagcagacaagggaataaaattgatttttgtttcatgcatatcaccttcttgttttttagagctgatgtgtagtaaatttctgctgtttttggtattgtcaataggaatgcttcttttccctgaagctttttctaatatagcataagaattttaaaatctgttcacattttgtgaaagaaactatgttataattattataaataatgagttctatgttagaatgattataaattaagattgggtgttgggggtgtaattagagcgatgcatatacttgttgtgggagtagattataaatccgcccctattgagatacgtgaaaaagtaagttttcagccgaatgagctggcagaagcaatggtgcagctgaaagaagagaaaagcattcttgaaaacatcattgtctcaacctgcaaccgcactgaaatttatgcggtagtcgaccagcttcataccggccgttattatataaaaaagtttttagctgattggtttcaattaagcaaagaagagctgtcaccgttcttaacgttttatgagagcgatgccgctgttgagcatttattccgtgtagcctgcggacttgattctatggtgattggcgaaacgcagattctcggacaggtacgcgacagctttaaaacagctcagcaagaaaaaacgatcgggactatttttaatgagctgtttaagcaggcagttacagtgggcaaacggactcacgccgaaacagacattggctcaaatgcggtgtcagtaagctatgctgcagttgaacttgccaaaaaaatcttcggaaatctttcaagcaagcacatattgattctcggtgcgggaaaaatgggcgagcttgctgcggaaaacctgcacggacagggaatcggcaaggtcactgtcattaaccgaacatacttgaaagcgaaggagcttgcagaccgtttttcaggtgaagcgagaagcttgaatcagcttgaaagcgcgcttgcggaggctgatattttaatcagttcaaccggtgcaagtgaatttgtcgtgtccaaagagatgatggaaaacgcgaataagcttcgcaagggacgtccgctgtttatggtcgacattgccgtgcctagagatcttgatccggcgctgaatgatcttgaaggtgtttttctttatgatatcgacgatctggaaggcattgtagaagcgaacatgaaagagcggagagaaacagctgaaaaagttgaactgttaattgaagaaaccattgtggaatttaaacaatggatgaatacacttggtgttgtgcctgttatttctgcattgcgcgaaaaggcgcttgccatccagtcagaaacgatggacagcattgagcgtaagctgcctcacttaagcacaagagagaaaaaactgttgaacaaacacaccaaaagtattattaaccaaatgcttcgtgatccgattttaaaggtgaaagagcttgcggcagatgctgattctgaagaaaagctcgcgttgtttatgcagatttttgatattgaagaagctgcgggccgtcaaatgatgaaaaccgttgaaagcagccagaaggtccactcttttaagaaggctgaatcaaaagcgggctttagcccacttgtaagtgagtgaaagctgaatgattgatactgcaatggcaagacttaatgaggggacaatcgtcatttacgcgttaagtgtactcttttattttatagattttcttcaacacaaccggaaggctggaaaaatggccttctggttgctttctattgtctggactctgcaaaccgtgtatttggcctattttatgtgggtgacggggcggtttccggtattaaatgtgacagaggcactttatttttatgcctgggtgcttgtcacgctgtcacttgtactgacaaagcttttacgtgttgactttatcgtgttttttacaaatgttataggattttctatgatcgccattcacacattttcaccgacagagcagcagtcagctgctttttccgggcagcttgtatccgagcttttggtgattcatattacaatggcgattctttcatacggcgctttttccctttctttcgttttttctgtgctatatatgtttcaatatcatctgctgaaaaagaaaaagtggggaaaatggctgttgagaatagaagatttatctaagcttgattatatggcgtatgttttaaatgtcattggggttccgatgctgctgctgagtttgattctcggcgtcatttgggcgtatgtctcactagaaacgctgtattggtttgacgccaaagtgcttggttcgtttgtcgtcctgctgctgtacagctattatctttatatcaggctgattaaggagctgcaaggaaaggtcgctgcactgtggaatacggcttgttttctggtgctgatgatcaattatttcctgcttggaagcctgtcgcaattccattggttcagttaaacgatgtcccaagcagattcgggaggaaagaaatgatgagaacgattaaagtaggttccagacggagcaaactcgctatgactcaaacaaaatgggttattcaaaaactgaaggaaatcaatccttcgtttgcttttgaaattaaagagatcgtgacaaagggcgaccggattgtcgatgttacactctcaaaagtgggtggaaaagggctttttgtcaaagaaattgaacaggcgcttttaaacgaagagattgatatggcagtgcacagcatgaaggacatgcctgctgttttgcctgaaggccttgtgatcggctgtattcctgaacgggaggacccgcgtgatgcccttatttcaaagaatcgcgtaaagctttcagaaatgaagaaaggtgctgtcattggcacaagcagtttaagaagaagcgcgcagcttttgattgagcgccctgaccttacaattaaatggattagaggtaatatagatacaagacttcaaaagctggaaacagaggattatgacgcaattattttagcggctgccggcctttccagaatgggttggaagcaagatgtcgtaaccgaattccttgagcctgagcgctgtttgcctgctgtggggcagggagccctggcgattgagtgccgagaatcggatgaagagctgttggcgttgttttctcagtttacagatgaatatacaaaacggactgtcttagcggaacgtgcttttttaaacgcgatggagggcggctgccaggttccgatcgcgggctactccgtgttaaatggacaggatgaaattgaaatgacaggtcttgtcgcttcacctgacggcaaaatcatttttaaagaaaccgtcaccggaaacgatccggaggaagtaggaaagcgctgtgccgctcttatggctgacaaaggagcaaaagatttaattgatcgtgtaaaacgggagcttgacgaggatggaaaatgattttccgttgaaaggaaaaacagtgcttgtcacccggaataaggcacaggcagcatcatttcagcaaaaagtggaggcgcttggcggtaaagcggttttaacctctttgattacgtttcgccgcgctttgccgaatgatgttgcggaacaggtaagagaggatcttgccgcgccaggctggcttgtttttacaagtgtgaacggggcagacttcttttttcttatctgaaggaaaatcagcttattctccctgcgcataaaaaaattgcagccgtcggtgaaaaaaccgcgcgccgtttaaaaatgcataacgtatcggttgatgtgatgccacaggagtatattgctgaacaattggctgacgctcttaagcagcatgctgaaccgggggagaccattaccgtgatgaaagggaatttgtcacgtgatgtgataaaacaagagcttgtcccgctcggttttgaagtaaaggaatgggttctctacgaaacgattccggatgaagaaggcattgaggcattgaaagacgctgcgggtcaatattcctttgactatgtaacatttacgagttcatcaaccgtacatacgtttatgcatgtcttgggagaagaattaaaaaagtggaaggcgaatgggacggcctgtatcagcattgggcctttaacaaatgatgcccttctgacgtacggcatcacatcgcatacgcctgatacatttacaatagatggcatgcttgagttaatgtgcagcatgtcaagagaggaagagagaatatgagtcaatcatttaatagacaccgccgcctgcggacatcaaaagcaatgagagaaatggtaaaggaaacacgtttgcatccatcagattttatatatccgatttttgtcgttgaagggctggaaggcaaaaaagctgttccgtcaatgcctgatgttcaccatgtatcattagatttattgaaggatgaagtagcggagctggtcaaactgggcattcaatctgttatcgtgttcggcatcccggaagaaaaagatgattgcggaacacaagcgtaccatgatcacggaattgtccaaaaagccatcacagaaattaaagaacacttccctgaaatggttgttgtcgctgacacgtgcctgtgcgaatatacagaccacggccattgcggacttgtcaaagacggagtcattctcaatgatgaatcgctggagcttttggcgcagacagctgtcagccaagcgaaagcaggtgcggatatcattgcgccatcaaacatgatggacggatttgttacagtgatcagagaagcacttgataaagaaggattcgtcaatattcccatcatgtcttacgctgttaaatattcaagtgagttttacggtccgttccgtgatgcagcaaacagcacaccgcaattcggagaccgcaaaacatatcagatggaccctgccaaccgtatggaggcactccgcgaagcacaatcagatgttgaggaaggcgcggactttttgattgtcaaaccttcgctttcttatatggatatcatgcgtgacgtaaaaaatgagtttactttgccgctcgtcgcttataatgtaagcggagagtattcaatggtgaaggctgcagcgcagaacggctggatcaaagaaaaagaaattgtgttggaaattttgacaagcatgaagcgcgcgggtgccgacctgattattacgtatcatgcgaaagacgcagcgaaatggcttgcggagtaattttattcagttgacaggagttgaggcagatgagaagctatgaaaaatcaaaaacggcttttaaagaagcgcaaaaactcatgccgggcggtgtgaacagtcccgttcgcgcatttaaatcggtagacatggacccgatttttatggagcgcggaaaaggctcgaaaatctttgatattgacgggaatgaatatattgactacgtcttgtcatgggggcctttaattttagggcatacaaatgaccgcgtcgtagaaagcctcaaaaaagtggctgaatacgggacaagctttggtgctccgactgaagtagaaaatgaactggctaagctcgtcattgatcgtgtgccatctgtagaaattgtacgaatggtaagctccggaacagaggctacaatgagtgccctccgtttggcaaggggctatacgggccgcaacaagattttaaaatttgagggctgctaccacggacacggcgattctctcttgattaaagctggttcaggtgttgccactctcggtctgcctgacagcccgggggtgcctgaaggcattgcgaaaaacaccatcaccgttccgtacaatgatttagaaagtgtaaagcttgctttccagcaattcggtgaagacattgcgggagtcattgtagagccagttgccggaaatatgggtgttgttccgccgcaagaaggtttccttcagggtctgcgtgatatcactgagcagtacggctccctgctgatttttgatgaagtgatgactggcttccgggtcgattataactgcgctcaaggctacttcggcgtaacgcctgatctgacttgtttaggaaaagtaatcgggggcggacttcctgtcggcgcttatggcggaaaggcagaaatcatggagcagatcgctccaagcggtccgatctatcaagctggtacattgtcaggcaacccgcttgcgatgacggctggcttagagacattgaaacagctgacacctgaatcctacaagaatttcatcaaaaaaggcgacagactggaagaaggaatttcaaaaaccgccggggctcatggcattccgcatacctttaaccgtgcaggttcgatgatcggtttcttctttacaaacgaaccagtcatcaattatgaaacagcgaaatcatctgatttgaagctgttcgcaagctattataaagggatggcaaatgaaggggtattccttccgccatcacaattcgaaggtcttttcctctcaacggcccatactgatgaagatattgaaaacacaatccaggcagctgagaaagtatttgctgagatcagccgcagataagagtgaaaaccggtatcaaggactccttgtgccggttttttcgtgctctcccactcatattttctccagttcatacatacacctttagtgacatctaattttaaggattagatgaaaggaggatatgaacttgccgcaaaatcatcgattgcaattttctgtagaagaatcgatctgtttccaaaaaggacaggaagtttctgaactgctttctatttcattagatcctgatattagggttcaggaagtaaatgattatgtatcaatcataggatcgcttgaacttacaggtgagtacaacatagatcaaaacaaacataccgaagagatttatacagataagcggtttgttgaacaagtcagaaagagagaggatggaagtgcggaactgactcactgttttcctgtggatattaccattccgaaaaataaagtgagccatttacaggatgtcttcgtctttattgacgcatttgactatcaattgacggattcgcgcattttaacaattcaagctgatttagcgatcgaagggcttttggacgatacgcaagacaaagagccggagatacctttatatgaagctcctgcggcattcagggaggaagagctttcagagccgccggcacatagtgtagtagaagaaccgggtgcatcatcggcagaggaagcagttcttcagcatgaaccgccagccgaaccgccagaactttttatctcgaaagcggggctccgtgaagaactggagacagaaaaagcagaatctgagccgcctgaatcggttgcttcagaaccagaggccagagaagatgtgaaagaggaagaagagtcagaagagcttgctgtgccggaaacggaggttcgtgctgaatcggaaacagaagaatctgagccagaacctgatccttcagaaatagagattcaagagatcgttaaagcaaaaaaagaaacggcagagccggcagctgcaatagcggatgttcgtgaagaagcagactctccagcggagactgagcttcgtgaacacgttggagcagaagaatcgcctgctttggaagctgagcttcattcagagactgtgattgcaaaggaaaaagaggaaacaacagtgtctcctaatcatgaatatgcgctgcgccaagaggctcaaaatgaagaagcagctcaatcggatcaggctgatcctgcgctttgccaagaagaggcggaaccggatgaagctttggagagtgtatcagaggccgctctctccatagaagatagcagagaaacagcttcagctgtatatatggagaatgacaatgccgatttacatttccatttcaatcaaaaaacaagctcggaggaggcatctcaagaagaattgcctgaaccggcataccgtaccttcctgcctgaacaagaagaggaggattctttttattcagcgcctaagctgctggaggaggaagaacaagaggaagagagcttcgaaattgaagtgagaaaaacaccatcagctgaagagcctaaggaagaaacaccttttcaatccttccagctgcctgaatcttctgagactgaaaggaaggaaacggatgctgttcctagggttgctcctgctgctgaaacgaaggaacctcaaacaaaggaaagtgataattctctttatttaacaaaactctttacaaaagaagcggatgagttttcgagaatgaaaatttgtattgtgcagcaggaagatacgatcgagcgtttatgcgaacggtatgaaattacatcccagcagctgatcaggatgaattctttagccttggatgatgaattaaaagcaggacagattctctatattcctcaatataaaaatagccatgcgtaaaccgtaagtgatcggaaaatgtggtgaatgaaatggaagatacccaatcggttcttcaggaatacggactgactgctcaatttattgagcctgtcagtcctcttgtttggaaagtgtatacagactacggcatatttgccctgaaaaaattgaaagaaggtcgcggcaagcattttacagatcatatggtggcgattgaggaaaaaggctttcgttcattcgttcccgtttacagaacaaatagcggtgagtttttctcagcaggcatacaatacggagatatctactatttaatgccttggctccaatttgaccaagaggaagaacgggatcaaaaacatgcttatttatttagagaaacagcccgtcttcacgagagaaccgcgcaggaactaaaggttagacgtgatgagattgaacgttattacgggcaaacgaaaaaaagtgggaacaagataaaattttctatgagcagtttgtggatagagcggagaaggaatggtacctttctccctttgaactccaggccataacctatttttctgaaaccatttccgcggtgaactttgcgctggaacggctggaggactggtatgagtccgcaaaggaaaaggacgtttcaagggttgtaatgaaccacggcagcctgtctatacaccattttctgtataatgatgccgggaccggatattttacaaacttcgaaagagcatctgtcggtccgccgcaaaacgacctgctcggcttttatacaaaaatgttcagaggctttccgaaagcttgtccggaatgcgtcgaatggttttatggatatacgaaatcattccctttgcgtgaagcggaagtcagcctttttctcagctatatggcatatccggcagccatgtacaaggtgctgaacggttatcaaactgggaaaagacagcatgaaaaagaggaatgtacacaattattaaaggcttattggcaaatgaaaaacatagagccgtttgtgatgaaaattcatcagattgaacaagagaaaaaatttcaggctgaaaacgagtccacgtcttaatggcgcggacttgtttgtttatatccattctaaatgaagggcgcaagctaaaaagattaggattgcgagcagcaaaacatcaaaggttgtcggaaagaaaatggttctgattccttgaaaaatcgtaatgggaataatcacttgtgcggatacaagccgaatttgccttacccatggcggcagcgaataagagctgaaacgtttcttcacggtgcatcctcctctacgcatttacaagcatcatatgtaaacttgggcaataggtgcctgcccatctgtatagaaagcggtgtttttggaaaagatgattgacgaatcaaaaacacttttactataataaagaacataaataatgtatacaatgagctgataaatacacctgcttagaacgggaagagtacaaaaaaggcgcatgcagagagagaagccgtttgctgaaaggcttcttatgttgtctgattggaaggtcgcccgggagcataatttcttgaaagaagagtagagaaattcgggaaacacccgttatccgttataagtgcatgaactgattgagttcatgaaaaaaggtggtaccgcgaaagagcttttcgtccttttacagggatgaagagctcttttttcgttctcagccatttttaaacatgctggagggttatgatggaaacgaatgaacaaacaatgccgacgaaatatgatccggcagcggttgaaaaagaccgatatgatttttggctaaaaggcaaattttttgaagcgggcagtgaccagacaaaagagccatactctgttgtcatcccgccgccaaacgtaacagggagacttcaccttggccacgcatgggacacaacgctgcaagacattgtaacaagaatgaaacgcatgcagggctatgatgtgctgtggcttcctggcatggaccacgccggcatcgcgacacaggctaaagtggaggcgaaacttcgtgaagaaggcaaatcccgctacgatttaggccgtgaaaaattcctcgaagaaacgtggaagtggaaggaagaatatgctgactttattcgcagccagtgggcgaaattaggtcttggcctagattattcccgtgaacgttttacgctggatgaaggcttgagcaaagcggtaagggaagtattcgttaagctttatgaaaaaggcctgatctacagaggcgaatatattattaactgggacccagcgacaaaaacagccctatccgacattgaggtgatttacaaggatgttcaaggcgcattctatcatatgagctatccgcttgctgacggttcaggctcaattgaaattgcgacgacacgtcctgaaacaatgctcggtgatacagctgttgccgttcaccctgaagacgagcgctataaacaccttatcggaaaaacggtgatcctgccgattgtaaatcgtgaaattccgattgtcggtgatgactatgttgatatggaatttggttcaggtgccgtgaaaattacgcctgctcatgatccgaacgacttcgagcttggcaaccgccacaatttagaacgcatccttgtcatgaatgaagatggcacgatgaatgaaaatgcgctccaatatcaaggtatggatcgttttgaatgccgcaaaaagctcgtgaaagatttacaggaggcgggagttctcttcaagatcgaggatcatatgcactctgtcggccatagtgaacgaagcggggctgttgtggagccttatctttctacacaatggtttgtgcgcatgcagccgcttgctgatgcagcgattgagctgcaaaaaaaagaagaaaaggtcaactttgtgcctgaccgtttcgaaaaaacgtatttacactggatggaaaatatccgcgactggtgtatctcccgtcaattgtggtggggccatcgtattcctgcctggtatcataaagaaacaggcgagctatatgtcggacttgaagcgccggaagacagcgaaaattgggaacaggatacagacgtactggatacatggttcagttctgcgctatggcctttctccacaatgggctggcctgatgtaacggctgaagactttaaacgctactatccgacagatgttctcgtgacagggtacgatatcattttcttctgggtatcacgcatgattttccaaggcattgaatttacaggcgagcgcccgttcaaagatgttttaatccacggcttaatccgtgacgagcaaggccggaaaatgagtaaatctcttggcaacggtgtcgacccgatggatgtgattgacaagtacggagccgattctctgcgttatttccttgcgactggaagctctcctggccaggatctgcgcttcagctatgaaaaagtggaatcgacctggaattttgccaataaaatttggaacgcctcccgttttgcattaatgaatatggatggcatgacgtacgatgagcttgatctgtcaggtgaaaagtcagtcgctgacaagtggattttaacgcgattaaatgaaacgatcgagcacgtgacccagcttgctgaccgatatgaatttggtgaagtaggacgccatttatataactttatttgggatgatttctgtgattggtatattgaaatggcgaagcttccgctttatggagaagacgaagcggctaagaaaactacccgttccatccttgcttacgtacttgatcaaacgatgcgtctgctccatccgtttatgccattcttaacggaggaaatttggcagcaccttcctcaccaaggggaatcgattacagtaagtcaatggcctgcagtagtgccggagcataccgatactgaagcggcagctgacatgaagcttcttgttgagctgatccgttctgtgcgcaatatccgcagtgaagtcaatacgccaatgagcaagcaggttgaactgtacattaaaacaagcacagacgaaatagcgtcccgcctcgaagcgaaccgttcatatgttgaacgctttacgaatccgagcgtgcttaaaatcggcaccgatattgaggctgttgataaggcgatgacggccgttgtctcaggagcagaggttattcttccgcttgaaggcttaatcaatattgatgaagaaattgcccgtctgcaaaaagaatttgataaactgacaaaagaagttgagcgtgtccaaaagaaacttggaaatgaaggatttatgaaaaaagcgcctgcacacgtaattgatgaagaacgtgaaaaagaaaaagattatgtggcgaagcgtgacgctgttcaaaaacgaatggctgagctgaagggttaatgaaaagccggggcggtttctagagaaaccgccttgtcttataaaagaggggattatcattgtttactgcatatcaagatgcgcgcagctggattcacgggaggctgaaattcggggtgaagcccggacttggtcgaatgaaacagctgatggcgcggttaggacatcctgaaaaaaaaatccgagcgttccacgtcgcaggaacaaacggtaaaggatcaactgtcgcttttatccgttctatgctgcaggaagccggatatacggttggaacatttacatcgccttatattattacgtttaatgaacggatcagcgtaaacgggataccgatttcagatgaggaatggacagcactcgtcaatcaaatgaaaccgcacgttgaagcccttgatcaaacggaatacggacagccgacagaatttgaaattatgacagcttgtgcatttttatattttgcagagtttcataaggtcgattttgttatttttgaaacaggtctgggcggtagattcgattctactaatgtggttgaaccgctcttaactgtgattacaagcatcggacacgatcatatgaacattttgggaaacaccattgaagaaattgcaggagaaaaggccggcattattaaagaaggtattccaatcgttacagcagttacccagccggaagctttacaggtcatccgccatgaagccgaacggcatgctgcgccgttccagtcattgcatgatgcatgtgttattttcaatgaagaggctctgcctgcaggagaacagttttcattcaaaacggaagagaaatgctatgaagatattcggacatctctgattggcacccatcaaagacaaaatgctgctttgtccattttggctgcggagtggctcaataaggagaatatcgcccatatcagtgacgaagcgttaaggagcgggcttgtgaaggctgcttggccgggacggttagagcttgttcaggaacatcctccggtatatttagacggtgcgcataacgaagaaggtgttgaaaagctggcggaaacgatgaagcagcgtttcgccaattcacgcatttctgtggtgtttagcgcgttaaaggacaaaccgtatcagaacatgattaaaagactggaaaccattgctcatgcgattcattttgcttcttttgatttcccgcgtgcttcccttgcaaaagatctctatgatgcaagtgaaatcagcaataaaagctggagtgaagatccagacgatgtaatcaaattcatagaaagtaaaaagggctcaaatgaaattgtgctgattaccggatctctttactttatttctgacattcgaaaaaggttgaaataaaagcatccggctccggcagaatcaaaaaaagattctgccgtttttttcatgtgtaaaattgaatattcccaattggagctcaggatgtccattttgctacaatccataccagaactcaatgagtaaaggtgtgttgtctatgctatccattctttttatcttcgggcttatccttggttctttttactatacggccgggtgccgtatccccttacatctatctattattgcgccccgttcatcatgcccgttttgccggcgaacattaactcctgcagaattaattcccatcctgtcattcctatttcaaaaaggtaaatgtaaaagctgcgggcataggatttcttttatgtatcccgcagcagagcttgtgacagcgtgtttatttgccgccgcaggaatacgctttggcatatcgctggaactgtttcccgctgtggtgtttatctctcttctcattattgttgcagtgacagatattcattttatgctgattccaaatcgaatattgattttctttcttccctttttggcggccgcgagattgatttctccgcttgattcctggtatgcaggcctgttaggtgcggcagccggatttttgtttctggctgtaattgccgcaatcacccatgggggagtagggggaggagatattaaattatttgcggtgattggctttgtgcttggtgtgaaaatgctggcagctgcctttttcttttcagttttgataggtgcattatatggagcggcagctgttctgactggtagactcgctaaaaggcagccgcttcccttcgcccccgctatagccgcagggagcattttagcctatttatacggtgactctatcatttctttttatatcaaaatggcattgggctgactgctgaaaaatttgacgaacgttttttggacaaggcgacaaaagtcttgttctttttttctttgcctgtgctaaagtgtgtagcatgaaaagccgacaagaacggtcaagcaaatgaagggaggaagcggaattgaaaaaaagaaagaataaaaaaaacagtaaagccgcagaaaaagccctcaaggtgacgattaatggaaaagaagagacggtttacgaacaagagacgcctgagacagaggcgaataaaagcatgacattttcaaattgggaggaaaaaagacaggcagaacaagaggttgcggcatcccaggaacaccctgatgaagatgaattcaattgggattccgaggaggacaaggtgtttaaagaggaccctaaagttgttcctccttttcaaaagaaaaaacaaagctttacgcaaaaggaaagaccggggctgccaaaccggtaaaaagagtggccgcgacgattgccttcgcggctgtcattggcactggattagggttattcgcgttaaacatatcggggaataaagaagcgtcagcaccggcctctttagaggattctttaggcagccaaacggcaaaagcaggggatacttctgctgataaacaaacctcaggcgcagaaaaacaagcggcacaaactgaaggtacatacaaaacatacgctgtgcaagccggaaaattttcaaatgaaaagggcgccgaaacgttaacagaacaattgaccgaaaaaggatattccgccgtgtcactgtcaaaggatgacgggtatacgtatgttattgcaggcttagcaagtgaaaaggaggtctcacagcagttaggacaggttttaatcgacagtgattttgaagcctggggaggcaaggagctttccttatcaatagagtcagatatgacagattcttttaaggaaacagcggagcttgcagcaaaggcgattctcgacgaagacattacaaaagcgagtgtagagaaaatagaaaagtcgcttggtgaaacaaaagcgtcagaaacaggagagaaaaaagcgattttgcaggctttaaaggaattagaggatccaagtgctgaagccgggtggaaggctcagcaggagctgttagccgtcgtaaaataagagatagtgccctgagccttcgtcctttagtgacaggctttttttattttgtcatgaaaaagttatttttctgaaattgtgacaagcctcgtgatttggtaggataaacgagtatctttttttcttaagcaaaccctgaaaggatgacgaacatgacaaaaccgctaatacttgcatcacaatctccgcgcaggaaagaactcctcgatcttctccagctgccctactccattattgtcagtgaagtagaagaaaaattaaatcgaaacttttcaccagaagaaaacgtccaatggttggcaaaacaaaaagctaaggctgtagctgatctccacccgcatgcaatcgttatcggtgctgatacaatggtatgccttgacggcgaatgtcttggcaaaccgcaggatcaagaagaagctgcttctatgctgcggaggctttcaggccgaagtcactcagtaataaccgcggtcagcattcaagctgaaaatcacagcgagactttttatgataagacagaagttgcgttttggtccctcagtgaagaagagatttggacatatattgaaacaaaagagccgatggataaagcaggtgcatacggcatccaaggaagaggcgcgctttttgtaaagaaaatagacggagattattattcagtcatgggccttcctatatcaaaaacaatgagagctcttcgccattttgatataagggcatgacggttctataaacgggaagggaaagaaaaggagtgcttggtcatacacgatctgccattaaaactcaaagatttcccaatgaaagaaaagccaagggaacggctcctgaaagtcggagccgagaacttagcgaatcatgaacttttggctatattattgcggacagggactaaacacgaatctgttttggacctgtcaaaccggctgctgcgctcatttgacgggctgcgcctgctcaaggaagcatcggttgaagagctgtcaagcatcccgggaatcggtatggtaaaagcgattcaaatactggcagcagttgagcttggaagccggattcataaattagccaacgaagaacatttcgttattcgctccccggaagacggcgctaatcttgtcatggaggatatgcgctttttaacccaggagcattttgtctgtttatacttaaatacaaaaaatcaagtcatccataaacgcaccgtatttatcggaagcctgaattcatctattgtccacccgcgagaggtgtttaaagaagcgtttaaacgatctgccgcttcctttatctgtgttcataatcatccttctggagatccgacgccgagcagggaagatattgaagtgacaagacggctgtttgaatgcggaaacctgattggcatcgagctgcttgaccatttggtgatcggggataaaaaatttgtgagtttaaaggaaaaaggatatttgtaacacttttttttcgtcgaattaagctataatagagtttatgagtttttccctttagggtatttttgctttaagaaaggaagatacatacatatgtttggaattggtgctagagaccttggtatagatcttggaactgcgaatacgcttgtttttgtaaaaggaaaaggaattgttgtgagagagccgtcagttgtcgctttgcagacggatacgaaatcgattgtcgctgtcggaaatgatgcgaaaaatatgattggacggacaccgggcaacgtggtggctcttcgcccgatgaaagacggcgttatcgctgattatgaaacaacggcgacgatgatgaaatattacatcaatcaggccataaaaaataaaggcatgtttgccagaaaaccatatgtaatggtatgtgtcccatcaggcattacagctgttgaagaacgcgctgttatcgatgcgacaagacaggcgggagcgcgtgacgcgtatccgattgaagagccttttgccgcagcaatcggagccaatctgccagtttgggaaccgactggaagcatggttgttgatatcgggggcggtacgacagaagttgcgattatttccctcggaggcatcgtaacgtctcagtcaatccgtgtagccggtgatgagatggatgacgcgattatcaactacatcagaaaaacgtacaatctgatgatcggtgaccgtacggctgaagcgattaaaatggaaatcggatctgcagaagctcctgaagaatccgacaacatggaaatccgcggccgcgatttgctcacaggtttgccgaaaacaattgaaattacaggaaaagagatttctaacgctctacgcgacactgtatctacaattgtcgaagcagtgaagagcacactcgaaaaaacaccgcctgagcttgcagcagatatcatggacagaggtatagtgttaaccggcggcggagcgcttttgcgcaatttggacaaagtcatcagcgaagaaacaaaaatgccggtccttatcgccgaagatccgcttgattgtgtagcgatcggaacagggaaagcactggagcacatccatcttttcaaagggaaaactagataatcgggagttcaatagaagaggtgtaacacgatgccgaataagcggttaatgctattacttctgtgtattatcatattggtggctatgattggattttcgctgaagggcggccgcaataccacctggcctgagaaagtgatcggcgatacgacgggagtatttcaaaatatttttcatacgcctgccgaattttttgcaggaatatttgagaacatcaatgatttaaaaaacacatacaaagaaaacgagcgtctaagagaaaaacttgacggacagacacaatatgaagccaagcttcaagagcttgaagaagaaaacaaatccttgcgtgacgagcttggccatgtcaaatcgattaaagattacaagccgattttagcaacggtcatcgccagaagccctgataattgggcgaaacaggtcaccattaacaaggggactcagcaaaacgtagcgaaagatatggccgttacaaacgaaaaaggcgcattaatcggcaagatcaaaagctccggacttaacaattttacgtctgctgttcagcttttaagcgatactgaccgcaataacagagtcgcgacaaaaatttccggaaaaaaaggcagcaaaggctacggcttgatcgaaggatatgacaaagagaaaaaacgtcttaagatgacaattattgagcgtaaggataaacaagacgtgaaaaaaggcgatcttattgaaacatcagggacaggcggtgttttcccagaagggctgacaatcggtgaagtgactgatatcgagtcagattcctatggattaacgaaggttgcttatgtaaaacctgcggctgaccttacagatttaaataatgtgatcgttgttaaccgtgacgtgccgactgtcgatacagaggaggaaggatcgtgaaacgtttccttctccctttcgttatgatgcttgttttttctgcggaaagcatttttacagatttggtgcattttcctttcgttacagatgaccaagtgctcgccccgcgttttttgatgcttgtattgatattcatgtcggcttttatcaaccaaaaacacgcgatgatttacggatttatttttggctttctatatgacatgaactatacaagtctattaggcgtttacatgtttggttttgcagggctatgctatttggcttcaaaagcgtttaaagtgttgcatacaaacgcatttgtagtgatattgatagcagttctggctgtctgtctgctcgaattttacgtattcggcattcagtctttgattcataaagacattatgacgtttaacggatttgtgcttgaccggtttataccgacaattttattaaatattgcagcagctcttattcttgttctgccatttagattgttttttatgagtctaaagaaagaattgagagatgagtaaaaaggattttatctttttttgacgaaatgagtatgttgttgaggtgaatattgtgaagaccaaaaagcagcaatatgtaacaataaaaggaacaaagaatggactaacattgcatctggatgatgcgtgttcttttgatgagcttctcgatggtcttcagaatatgctgtcaattgaacaatataccgatggaaaaggccagaaaatcagcgttcatgttaagctgggaaatcgctttttatataaggagcaagaggaacagctaaccgaattgattgcgtcaaagaaagatttgtttgttcattctattgacagtgaagtcattactaaaaaagaagcacagcagataagagaggaagccgaaattatttctgtttcaaaaattgtccgttcaggccaagtgctgcaggtaaaaggcgacttgctcctgatcggtgacgtgaatcccggcggaacagtcagggccggagggaacatttttgttctgggctcactgaaaggaattgcgcatgctggattcaatggaaataatcaagcggtcatcgccgcctctgaaatgcttccgacacaattaagaatcaatcatgtgttaaatcgctccccagaccacattcaaaaagggaacgaaatggaatgtgcttatttagatacagacggaaatatggtcattgaacgccttcaacatttggctcatttaagacctgatctaacaaggcttgagggaggaatgtgaattgggtgaggctatcgtaataacttcgggaaaaggcggagtaggtaagacaacaacatctgcgaacctcggtaccgccttagccattttagggaagcgcgtatgcttagtagatactgatataggactgcgcaaccttgatgttgtaatgggtcttgaaaatagaattatttacgatctggtagacgttgtagagggcagatgcaaaatgcatcaggcgctcgtaaaagacaaacgtttcgatgatctgctctatttaatgcccgctgctcaaacgagcgataagacagctgttgctcctgaacaaattaaaaacatggtccaagagctcaaacaggaatttgactatgtcatcatagactgtcctgccggaatcgagcaagggtacaaaaatgccgtttccggagctgataaagcgattgtggtcactacgcctgaaatctcagctgttcgtgatgctgaccgtattataggactgctggagcaagaggaaaatattgaaccgccgcggctcgttgttaacagaatcagaaatcacctgatgaaaaacggtgacacgatggatatcgacgaaatcgtacagcatctgtcgatcgatttgctcggaatcgtggctgatgatgatgaagtcattaaagcttccaatcatggcgaaccgattgcgatggaccctaaaaaccgcgcttccattgcatatcgcaatattgcccgccgcatcttaggtgaatctgttcctttacaggtgcttgaagagcaaaacaaaggaatgatggctaagattaagtcatttttcggagtaagatcttaatgtgatagaatcaaagagaagaatctgacaaagcatatgctgtgtcaggtttttttgtttttgcctgctttgttcttgactaaaccgaatatttgccatggacaagacatatgatgtacaaacccaacgaatgcaaaggatgatggcaatgagtcacagagcagatgaaatcagaaaacgattagagaaaagaagaaagcagctttccggctcaaaacgtttctctactcagacagtttctgaaaagcagaaacccccgtcctgggtgatggtaacggatcaggaaaagcatggaacacttccggtctacgaagataacatgccaacattcaacggaaaacacccattggtgaaaacagattcaattatcctgaaatgtcttctgtcggcctgccttgttctcgtttcagctatagcctataaaacaaacattggacccgtcagtcagattaaacccgccgtagccaaaacctttgaaactgaatttcaatttgcttcagcaagccattggttcgaaaccaaattcggaaatccgcttgctttcctggctcctgaacacaaaaataaggaacagcagattgaagtaggcaaagatctgatcgcgcctgcatccgggaaagtacagcaggattttcaggacaatggggaaggaattaaagtcgaaacaagcagtgataagattgatagcgtaaaagaaggctatgtggttgaagtcagcaaagacagccaaacgggactgacggttaaggtgcagcatgctgacaacacctatagtatctatggcgagctcaaagatgtggatgttgctttatatgattttgtggataaaggcaaaaagctcggttcgattaagcttgatgatcataataaaggggtctattattttgccatgaaagacggcgataaatttattgatccgattcaggtgatttcatttgaataaatggctcgaccttatcttaaagatccatgtgcatccttttctttggattattgcggcgctgggcttgctcacaggccatatgaaagcattattatgtctgctcctgattgtattgattcatgagctggggcatgctgctctggctgtgtttttttcttggagaatcaagcgtgtttttttgctgccgtttggcggaacggtcgaagtggaagagcacgggaatcggccgttaaaggaagagtttgcggtcattattgccggacctcttcagcacatctggcttcagtttgccgcctggatgcttgcagaagtctcagtgattcatcagcatacctttgaactcttcaccttttataatctttctatcttatttgtcaatttactgccgatctggccgctggatggaggaaaactgttatttttgttgttttccaaacagctgccttttcaaaaggctcaccggcttaatctaaaaacgtcgctctgcttctgcctgctgctcgggtgctgggttttattcgtgattcctctgcaaatcagcgcatgggttttgtttgtctttctggctgtttccttgtttgaggaatatcggcaaaggcactatatccatgtgagatttctcctcgaaaggtattacggaaaaaacagggagcttgagaaacttctgccgctgacagtaaaggcggaggataaagtctatcatgtgatggccgagttcaaacgtggctgtaagcatccgattattatagaaaaatcaggccaaaagctcagccagcttgacgagaatgaagtgctgcacgcttactttgccgataagcggacgaattcttccatggaggaactgcttctgccctactaaaactgattgacaaacgccttgtattttggtatattttttaatgttatggatgtagcaccattgctacaaccgctcagtacaggtgttaagagcttttacagccccctggtatctggcgagtcttagtctaataggaggtgcagagaatgtacgcaatcattaaaacaggcggtaaacaaatcaaagttgaagaaggccaaactgtttacatcgaaaaacttgctgctgaagcaggtgaaacagttacttttgaagacgttttgtttgttggcggagacaacgtgaaagtcggcaaccctacagttgaaggcgcaacagtaacggctaaagttgaaaaacaaggccgcgcgaaaaaaatcactgttttcagatacaaaccaaagaaaaacgttcataaaaaacaaggtcatcgtcagccttacactaaagtgacgatcgaaaaaatcaacgcgtaagcatgattcaggcaacaatcagaaggtctcatgataaaggcatattgtcttttgaaatgacgggccatgcgaattttgctgaacatggacaagatcttgtttgtgccggagtgacagccgttgtgtttggggccgttaacgcggtcattgtgctcgcgggcttcgagccgcttcttgatataggagaggacgggggttatttttattttgaattccctgaatctcttgatccagaggcacgccaaaaagctcagctgctgattgaaggcatgattgtttcgctggagacaatcgaacgggattacaaagacaacttgcgtgtgaccacaaacataatataggaggtgagctacatgcttagattagatcttcagtttttcgcttctaaaaaaggagtaggttctacaaagaacggacgtgactctgaggctaaacgtttaggtgctaaacgtgctgacggtcaattcgtaacaggcggttctatcctttaccgtcaacgcggaacaaaaatttacccaggtgaaaacgtgggccgcggcggagatgacactctatttgcgaaaatcgacggaactgttaaattcgaacgtttcggccgtgaccgcaaaaaagtgagcgtatatcctgtagctcaataatgattcaaaaaactccggtcgatgatgactggagttttttttgcaatatgcggagtaaacacctagaatgaaatgcagagtatgtgcgagcagaccccgccaagaatgagaataaacatctcaaacccactggatatgttccccaagcagtaatacataaaatgttctgcctggctgcaaatcaaccaaagccagaaaaaaggaacatgatatttctgggaaaaacaattgtttttctaacaaagccttctctgttataattcataatacacacttatacagactcctaaataagaaattaaatgattgggagtgcgaaaatgaaggatgtttcaaaaaatcaagaagaaaatataagcgacacggcattaacaaacgaactgattcatctgcttggccattcccggcatgattggatgaataagctgcagctgattaaaggaaacttaagcttacagaagtatgaccgtgtctttgaaatgattgaagaaatggttatagacgcaaagcacgaatcaaagctctcaaacctgaaaacaccgcatttggcgtttgattttcttacgtttaattggaaaacccattatatgacgcttgaatatgaagttctcggagaaattaaggatttgtcggcttatgatcaaaagctggcgaaactgatgagaaagctgtttcatctgtttgatcaagcagtcagcagagagagtgaaaatcatttaacggtttcgcttcaaacggatcatcctgacagacagctgattctgtaccttgattttcacggcgcctttgccgatccatctgcttttgatgatattcggcagaatggatatgaggacgttgatatcatgcgttttgaaatcacgagtcacgaatgtctgattgaaattgggttggactagcggagtttttaacggtttagaacggaggacattatgtttgtagatcaggtcaaagtatatgtaaaaggcggcgacggcggcaacggtatggttgcgtttcgccgtgaaaaatatgtgccgaaaggcggccctgccggcggtgacggaggaaagggaggagacgtcgtttttgaagtagatgaaggtctccgcaccctgatggattttagatacaaaaaacactttaaagcgattcgcggcgagcatggcatgtccaaaaaccagcacgggcgaaatgctgatgatatggtcattaaagttccgccgggcaccgttgtgacagacgatgatacaaaacaggtcatcgctgatttaacagagcacggacagcgggctgtcattgcaagaggcggaagaggcggaagaggaaatagccgctttgctacaccggctaatcccgcgcctcagctttcagaaaacggcgagccgggaaaagaacgctacattgttcttgaattaaaagtgcttgcagatgtcggacttgtcgggttcccgagtgtgggaaaatctactttgctgtctgttgtctcatctgcaaaaccgaaaattgcggactatcactttacaacgcttgtcccgaatctcggcatggttgaaacggatgacggacgcagctttgtcatggctgatttgccagggctgattgaaggcgcacaccaaggcgtcggactgggccaccagtttttgcgccatattgaacggacgagggttattgttcatgtcattgacatgtcaggcttagaaggccgtgatccatatgatgattatcttacgattaaccaggagctgagcgagtacaatctgcgtctcactgagcgtccgcaaattatcgttgcaaataaaatggacatgccggaggctgcggaaaatctcgaagcctttaaagaaaagctgacggatgattatccggtattcccgatcagtgcggtgacaagagaaggtctgcgtgagcttctgtttgaggttgccaatcagcttgagaacacaccggaattcccgctgtatgacgaggaagagcttacacaaaaccgtgtcatgtacacgatggaaaatgaagaagtgccatttaacattacacgcgatccagacggtgtatttgtgctttcaggagacagccttgagcggttattcaagatgactgatttctcacgtgatgaatcggttaaacggtttgcaagacagatgcgcggaatgggtgttgatgaagcactcagagaacgcggagccaaggatggagatataatcaggcttctggaatttgaatttgaatttattgattaatcaatgttggctgaaaagagagcctggtgccaggctctctattttaaaggggggatgcaaatgaaagaggagacattttatcttgtccgtgaagatgtattgcccgatgcaatgagaaaaacattagaagtcaaaaagctgcttgatcgaaaaaaagcagattcagtagcagatgccgttcaaaaggtcgatttaagtagaagtgcgttttataaatacagggatgctgtttttccattctacaccatggtaaaagaacaaattatcacacttttctttcatttggaggataggtcaggtgcgttatctcagcttcttcaggcggtagctgattctggaagcaacgttctttccattcaccagaccattccgcttcaaggcagagcaaatgtgacactgtctatcagtacgtcggcaatggaagaagacattcatacattaatgaataagctcaggaagtttgattttgtagaaaaggttgaaatattaggttcaggtgcataagggagagaaaatcgtcatgaaagtcggttatttaggtccagcagctacatttacacatctagcagtcagttcttgttttcaaaacggcgccgaacatgttgcttaccgcaccattccggagtgtatagatgcagccgttgcaggcgaagttgattttgcttttgttcctttggaaaatgctttagaaggatctgttaatctaacaatagactatttaatacatgaacagcctttgccaatcgtgggtgaaatgacgttgccgattcaccagcacttgctcgtccatccctcaagagagaatgcatggaaagagctcgacaaaatttactcacattcacacgcgattgcgcaatgccataaatttcttcatcgacattttccttccgttccatatgaatacgccaattctaccggggcggcagcaaagtttgtcagtgaccatcccgagctgaatatcggggtcattgccaatgatatggcagcttctacatacgaattaaaaatcgtgaaacgggatatacaggattatagggacaatcatacaagatttgttatcctgtctcccgatgaaaacatatcttttgaagtgaattcaaaattgagctctaggcccaaaacgaccttaatggtcatgctgccgcaggatgatcagtccggggcgctgcatagagtgctgtctgcattttcttggagaaatttaaacctgtcaaaaattgagtcacgtccgactaaaaccggattaggccattatttctttattattgatattgagaaagcgtttgatgatgtattgattccaggggccatgcaggagcttgaagcactcggctgcaaagtgaggcttctgggtgcataccagtcttaccaattataaaaaaacgcccactagagggctttttttagtctttaattaaaatgccggcttcttcgagggcttggcaggcttgatcgatgcgatgttcatcaggtgctgtcagtgtatgcaggtgcacgccgtcggtcagctgtgataagtaggcagcattcgtagaattgatttttttgatgaaatggctaacttctttccgggtgcctacttggatggctgcagttaaatctccgtatacgggatgctcgatttttacgtcttttactgtaacgccttcgtcgacgatgagctgcagttcctcttctgtccgttcaggaccgtgcagacatgctatgattctttctgcctgctggtgctgctgagcggctgcatccatgtatacatatccttggcttgtggcgataatcggtacatttttcgctttcaagagcgatatatcctgtacaataacctgtcttgagacgttcgctttttttgcgagttctcctcctgtcagcggtgatttagattccttcagccacagaagaagctggtcacgcctgttggcgcccattagctttaattcttcggtcaatatcaaattctcctttcttttgttcccaaagcactgtaaacgtatgtaataactgttccagctgttcagctgttgtatgcctgccaaaagagatgcggataaattgcagagcttcttgttcggtttttcttaatgctttcattgtttcagacggaccgtggtaacctgcagaacaagcgctgccggttgaaatgcaaatattactccgattacattctaacataacatattgtccttcaaatgagtgaaaaaaacaccctataatatgcggaagacattctgctttcgaagtgtctgctgcaagggttacagggagagaccgaatacggatttggtctagaaagtatgttcttaatgcctcattgcgggatatctgtttttccatttcgcttacgatcaattctgcagcggcagtgaaggcaccgatcccgggaacatttacggtgccggctctgaatccgtattcgtgagtagtcagaggataaacgggtttccaagggacatccggccggatatagaccgcccctactcctttaggaccgtggattttatggctggacattgagagtgcatctactcccagattttttgtattgatcgggatctttccaaacgtttgaacagcgtcgcaatgaagaagaatccccttattgtgcaggtatgaagacaggtgttgaatgggctgaatgatcccggtttcagaatttgcatgctgaatagatacaaggcctgtttccggccggatatgggttagtaatatttcctcggtaataagcccgtattcattcggttcaatgactgttacatcatatccctgctgttccaaaaaagcagcgcaattatgaatggactgatgctccatggcagtcgtaataaaatgtcttttcgtttttggcaggccgtttaacaatgattgaatggccagaaaattggattcagtgccgccgcttgtaaaatagatgccgcttgcttctccgccaatgatgttggcgattttttcacggcagtactccagtatgtgctttgcttttcctcctgcatcatgcaggctgctggcatttccgtacatatccatactaagcttctgatatacagtaagggcttcctcacaaataggcgttgtcgctgcataatctaaataaatcatccggtcttcctccatccgttctccataaaaaactcttgagtttattttatccttgtgtaaatataggtgtcaagacaggtgtaaacaacaggaggatggcatatgtctaaaaagacgattgcagtcatcggttcaggggcggcggcactttccttagctgcagctttcccgccctcatacgaagtgactgttatcacaaaaaaaacgcgtcaaaaacagcaattctgtctatgcacaaggcgggattgctgcggcctatgcaaaagatgactcgattgaagcccatctggaggatacgttatacgcagggtgcggccataataatctagctattgtagcagacgtattacatgatggaaaaatgatggttcaaagcctattggagcgtggatttccattcgaccgcaatgaacgaggcggtgtttgtcttggaagagaaggggcccactcatacaaccgcatatttcatgcaggcggagacgcaacaggcaggctgcttatcgattatttgctcaaacggatcaacagcaaaatcaagttaatcgagaatgaaacggcagcagatttgcttatagaggacggacgatgtatcggcgtcatgacaaaagacagcaaagggcggctcaaggtaaggcacgcagacgaagttgtgctggctgccggcggctgtggaaacctgtttcttcaccatacgaatgatctcactgtcacaggtgacggtctttctctggcttaccgggccggggcggaattaacggatttggagtttactcagtttcacccgacactgcttgtgaaaaatggtgtttcctacgggcttgtttcagaagctgtcagaggggaaggcggatgtttagtagacgaaaacggccgcaggattatggctgaacggcatcctttaggtgacctggctccaagagatattgtctcacgggttattcacgaagaaatggcaaaaggaaatcgcgtttatatagacttcagtgcgatttctgattttgaaacgcgtttccctaccatcaccgctatttgtgaaaaagcagggattgatatccacagcggaaaaattcctgttgctccgggaatgcatttcttaatgggaggtgtttcagttaatcgctggggagaaacgacagtgccggggctttatgcgattggcgagacagcatgctccggtttacatggagcaaaccggcttgcaagcaattctttattggaagcgctggtatttggaaaaagggcagcagagcatattatccaaaaaccggtttataacaggcaatatcaatcagggctagaaaccagtgtcttctacgaggtgccggatatagaggggcatgaactgcaaagcaaaatgacaagccacatgtctattctgcgggaacaaagcagtttgattgagcttagcatctggcttcatacgctgccttttcaggaagtaaatgtgaaggatatcacaattcggcagatggaactttctcatctatggcaaactgcaaagctgatgacgttttctgcgcttttgcgggaggaaagcagaggggctcacttccgcaccgattttcctcatgctgaggtgagctggcaaggaagacaaattgtccatacaaaaaaggaacgaagatcagaaaaaacgaggggatttggaacaatgaatcatttacagctgaaaaaattactgaatcacttttttcttgaggatattgggacaggggatcttacatcgcagtctatttttggagaacagagctgtgaagcggagattgttgcaaagtcagagggtatttttgcaggagcagcgatcataaaagaaggcttttcgttattggacgaaaatgttcaaagcattttacacaaaaaagatggggacatgttgcataaaggtgaagtgattgccgagttacacggtcccgcagctgcgctcctttcaggagagcgggtcgtattaaatcttattcagaggctgtcaggaattgcgacaatgacaagagaggctgttcggtgtctggatgatgaacagattaaaatttgtgacacgagaaaaacaacaccggggctcagaatgctggagaaatatgctgtcagagccggcggcgggtataatcatcgattcggtttgtatgacggcatcatgattaaagataatcatatcgcagcatgcggctctattttagaggcgtgcaaaaaagcccgtcaggccgcagggcacatggtaaatatcgaggtggaaattgaaacggaggaacagctgcgggaagcaattgcagctggagcggatgttattatgtttgacaactgtccgcctgatacggtccgtcattttgcaaagctcacaccggctaatataaaaactgaagcctctggcgggattacgttagaatctttgcctgcttttaaagggacgggtgtgaattatatttcattaggatttctgactcattccgtcaaaagtttagatatcagcatggatgttacgttatcaaatgaatctgtggaggaatgctgttatgtcaattcttgatgtgatcaaacaatcgaatgatatgatgcccgaaagttataaagaactatcgagaaaggatatggaaacgcgcgttgccgccattaagaaaaagttcggcagcaggctctttataccaggccatcattatcaaaaggatgaagtgatacaatttgctgaccaaacaggcgactccctgcaattggcccaagtagcggaaaaaaacaaagaagcggattatatcgtattttgcggcgttcactttatggcagaaaccgccgatatgctgacaagcgagcagcaaacggtcgtcctgccagatatgagagctggatgttctatggctgacatggctgacatgcagcagaccaatagggcatggaagaagcttcagcatatatttggagatacgatcatacctttaacttatgtgaactccactgcggagatcaaggcattcgtcggaaagcatggcggagcaactgtaacttcttcgaatgcgaaaaaagtgcttgaatgggcgtttacacagaaaaaagaattttatttttgcctgatcagcatttagggagaaatacggcttatgatctgggcattgcgcttgaagatatggctgtgtgggatccgatgaaagatgaattagtagctgaatccgggcatacgaatgtgaaagtgattttgtggaaagggcattgctctgttcacgagaaattcaccactaaaaatatccatgatatgagagagcgagaccccgacattcagatcattgtgcacccggaatgttcacacgaagtcgtgacactaagcgatgataacggatcaacgaaatatattatcgacacaatcaaccaggctccggcgggaagcaagtgggcaatcgggacagaaatgaatcttgttcagcggatcattcacgagcatccagataaacaaatcgaatcactcaaccctgacatgtgcccttgcctgacaatgaaccgaattgatttgccgcatttgttgtggtcgctggaacaaattgaaaaaggagaaccttcaggcgtcatcaaggtgccaaaagccattcaggaagatgcactccttgccctgaatcgaatgctttcgatcacgtagatcagaaatattttcccttcctttactcataacttcttttgttcaggcatatgttgtgaagaaacatattgtaatcacagctgaactgttcacgttttgcataggaggggaaaacgttgaaaatccatatcgttcaaaaaggcgattcgctctggaaaatagctgaaaagtacggagtcgatgttgaggaagtgaaaaaactcaatacacagcttagcaatccagacttaatcatgcctggaatgaaaataaaagtgccgtcagaaggagtcccggtcagaaaagagccaaaagcgggcaaaagtcctgcggccgggagtgtgaagcaagaacatccatatgcgaaagagaagcctaaatccgttgtcgatgtagaagacacaaagccgaaagaaaagaagtccatgccgtatgtcccgccgatgcctaatttgcaggaaaatgtgtaccctgaagctgatgtgaacgattattatgatatgaaacagcttttccagccttggtcgcctcctaaaccggaggagccgaaaaaacatcatgacggaaatatggatcatatgtatcatatgcaagaccaatttccacaacaggaggctatgagtaatatggaaaatgcaaattatccgaatatgcctaatatgccaaaggcgccagaggtaggcggtatagaagaggaaaacgttcatcacacagttccgaatatgccgatgccggctgttcagccttattatcattatccggctcatttcgtaccgtgtccggtgcctgtttcgccaattcttccaggatcaggattatgctatccgtactatccggcacaagcttatccaatgcatccgatgcatggataccagccaggctttgtatcgcctcagtatgacccgggttatgaaaaccagcatcatgaaaacagccatcacggacattacggttcatacggtgcgccgcaatacgcatctccggcttatggatctccgtatggacatatgccgtatggcccttattacggcactccccaagtaatgggagcataccagcctgctgcggctcatggttacatgccatacaaagatcatgacgactgcggctgtgacggtgatcatcagccatatttctctgcacctggccattcgggaatgggagcttatggaagccctaatatgccatatggcacagctaacccaaatccaaacccatattcggcaggagtttctatgccaatgacgaaccagccttctgtaaaccaaatgtttggccgtccggaagaagaaaatgagtgatcgttcggaacgatgtaaatcgttcctttttttgttttcaagcagatcactgccaaatggagagaactgacacgcttaacatgccccccatacgcacatgataaaagcgagcaaacatgctcaattcgtccacggggggtttttccattgggtaaaaaaatgacgatcgctagcctgattctaatgacagccggcttaacagcatgcggagcaaacgataatgctatgaatgatacgcgcaataacggcaatacccgtccaatcggatattatacaaatgaaaatgacgccgatagacagggagacggaatcgaccacgatggtcctgtttctgaattaatggaggatcagaacgacggtaaccgaaacaccacgaatgtaaataaccgtgaccgtgttactgctgacgatcgtgttcctttggcaactgacggaacatataacaacacgaataaccgaaacatgaatcggaatgcagcgaacaacgggtatgacaaccaagaaaacagaagactggctgcaaaaattgccaaccgtgtgaaacaagtgaaaaacgtcaatgacacacaagttatggtatcggatgaccgagtagttatcgcagtcaaaagccacagagagttcacaaagtctgacagagataatgttgtaaaagcagcgcgcaactatgcaaatggccgtgacgtccaagtatcaacagataaagggctgttcagaaaacttcataaaatgaacaaccgctaggaaggaagggctgccggaagtgatattcggcagcctttttctttgcatcagcgaacatttcccattaaagtgtacatagaaaatgtaaaagaaggtgaaaacatggcaggccattccaagtggaaaaacattcaaaaaagaaaaaatgcacaggatgcaaagcgcgggaaaatatttatgaagctggcaaaagaaatctatgtggcagcgaaagaaggcggagcggatccagaagcaaattcagcattgcgtcttgtcatcgaaaaagcaaaaggcgccaatatgccgaatgaaaatatagatcgggccattaaaaaagctgcgggaggccaagacggaagcagctatgaagaaatcacctatgaaggctacggcccttcagggattgccgtcatggttgaatgcgtaacagataataaaaaccgaacggcgtcaaatgtgcggacagcctttaataaaaatggcggaagtctgggagaaagcggatgtgtagcctttttatttgaacgaaaggggttcattacgatagaccgtactgaacggcaaatagaagaagatgagctcatgcttgatgtgcttgaagcaggaggagaagagctgcgaattgaagaagacctatatgaggttttcacagagcctgagcattttgaagaggtgaaaacagccctcgaatcgaaatatctaatttcttcggcggaggtgaccatgcttcccaatacctatgcagaagccgatgatcaggctgttgagaagctggaaacattaatagacgtccttgaagatgacgatgatgttcaagaagtgtatacaaactatcgttcataaaaaaccggcacgaggtcatatcgggccggttttagtatgttcaggagacacgttcactttcatgagtgtattctttctcccagaaatcagcgtttttgatacccagcgcttttggatcaaagatcgggtctaagccctgcttcttttggcgctcataatcctttaaagcaaggagcgccggcttggcaagcagcacaatggcaatgacgttcagccataccataatgccaagccctgcatcccctaatgcccaagcaagtgaagctgttttcacagtaccatagaacgtggcggctaaaataatcagttttaagccaagcatcgcccatttgctttctctgcctcgtgctaaataggcgatatttgtttctgcgatgtagtaatacgccataattgttgtaaaagcgaagaagaataaagcgatggcaacaaagcctgcaccgaatccgggaagaacactgtcaattgccgcttgtgtgaaaccaggtcctgcttctacgcctttaagctggtgaacgataaaggaaccatctgcagcctgggtattgtacatgccggtaaacaagatcatgaaagctgtagcggaacatacaaacaaggtgtcaatataaacagaaaatgcctgaaccagtccctgcttgaccggatgagaaacctctgcagcagctgccggatgcgggcctgttccctggccggcttcgtttgagtaaatgccacgtttaacgccccaggaaatcgccataccgatcaagccgccaaaagcggaatccaatgcgaaggcgcttttgaatattaatgagatcacagcaggcaattcagacacattcatgacaataataatcaaagacagcaggatatatccaatggccataaatggaacaatcatttgcgccgcattggcaattcgtttgacgccgccaaaaataatgaaccctaataataaaaccagaccgcaccctgtgacgaaaggagagatgccgaatgcattttggatcccagccgcaatggagttggactgtacgcccggcattagaaaggccattgcaataagggcagcagcggcaaataagacggcaaaccacttaatgcctaagcctttttctatataataagcagggccgccccgatattgaccgtcttgtttcactttgtaaatttgagcaagcgttgattctacaaaggcactcgccgccccgataaaggcaatcgcccacatccagaacactgcaccgggtccgccgaatgcaattgctgtcgccactcccgcgatgtttcctgtgcccacacggccggacagcgcaatcgataacgcttggaaagatgaaacgccggcttcagagctcttgcctttgaacatctgaacaatcatttcttttaaatgtcggacttgtaaaaaacgggtcataattgaaaaggcgaatccaattcccaataaaatataaatgacgggcgtactccataagaccgcattcaaactagcaacaaaatctgccatcaagcttccccctcacttcaaattcgaatacatgtataaaaaggattttggtctaatcgaactatttctacaatcgatttgtcacattatatgacctgtaattatcaataagaagaggaagggaaaaagaaaaaacgcggcgtatcgactacgctgcgtttttctacagaggcaaacttatggcaattgttataaaatccttcagcaacaaatagcctagttcagtcaaaccgtatataaaggataaagcaatcacaaaatgattgaaatgcttttcatcatttgttccgttcatcttattcatgtttcatcacctcactgacgcctgcggcggttcttcacggatccaatgatcatcttttcgccaatcatacgtttcatcagtatcaagatgtaaagtctgattgccgattttcactgtattgtgattgatccacgtcactgctgggcggctgtccgggtaattccagtagattgttctcttgacaagtgttttttcatttacaagttcacctctggctgcatctaagctcaaggtgttttcggtcttaatgtgactctctccctttttttctctcattttactatatatcggattcatataatctttacatttctttaaaattacctcaataaagcaatgataagatgaaataaagccaataaagggtgaggggagacagaaatggaaaaaacgtattgtcattccggcgagaaggacccagaagcggtctacttaactgtgagaggctatcgaattaagctgtcgcctgaacaaatgaaactgatttctgccgtcagaaagtaaaaaatacatgataaaggcagccgcttgtgcggctgcctttttgatttaagaatattttcttttccgctgtgcgaaatgcttttgaaaccaatctttcttatataaaaatgcgatgatctccagccaaaaacccggaatctttttggggaatatcggttttttgtagagtgcatgatatgcggattttaagtcgtcccactgcgtgcatgtttttgtctgctcaaatctcgcaacatcaatcacccgcaccgccccggtttctgtcaatatcagattccgcaaatgaatatctgacgggttcagtccggctgcccgggcgtcagaaagcgcttcttcaacctgctgaatcatgtcatcactgattgcaatgcctttcttcagacagttataaaaggtttcacctttaatatattccatgagaataaatgaatcgccagtttcgtaaatgtcaggatagaatgcggacccggctaatttttcatagatcgctgcttctttgactgctgtcgcttgatattccggaaaaaatactttcagcgccatttttcgaccgccttctgttaaggcaaacacataggcgcttcttcccttgccgattagtgttaattcctcggatttctctttgactttatcaaatctgctgttcttgcggtatatgacggtatgggccagtgcctctgcttttgtcagcatttcattcaccttctttgctctattttatgcagctgtttataggaaaatcataaactgttcaggaaaaagagcctaattctagtgtatctggtcttgaagaagaaggctacttataagcatgaattgtgataaaagagacatagaacgtttaatttccattcttgaaaagcgcttacaaatgggatagtattaattttaaataaagcgctttcgtgaatgatcaagggggaagaagccatgacaaaacagattgtgacagggattatcggtgcaggccgcatcggcaaacttcatgttcaaaatataagccggattcctcacatgaaaataaaagcaatctctgacattcaggcgagccgtataaaaagctgggccgacagtcatcagattgaatacataacctctgattatcgtgatttattacatgatcctgatattgatgctatttttatttgctctcctacagccgtacatgcacagatgatcaaagaagcagccgaggcgaaaaagcatatattttgtgagaagcccgttagtttctctctggacgaaacgagtgaagcgcttgcggctgtccggaaacacggggtaacacttcaagtcggatttaaccgccgctttgatcctcattttaagaaaatcaaaacgattgttgaaaatggtgaaatcggtacacctcatttattaaaaatcacgtcccgggacccagaacccccgaatatagattatgtccgtacgtcaggcggattgtttatggatatgtcgatccatgattttgatatggccagatatattatgggaagcgaagtgacggaagtgtatgccaaaggggcggctttggtgaatccttcttttgcggagctgggtgatattgatacagctgttattacactgacttttgaaaacggtgccatggctgtgattgataacagccgccaagctgtgtacggatatgaccagcgggttgaggttttcgggacgaaaggctctgcagcggctgacaatagcaggccgacaacggttgaggtgtcaacagctgattttgtgatgaaggataaaccgcatttctttttccttgaacgctataaggattcatatgaggaggagattctccgttttgcagaagcgatcggcacaaaccaggagactccctgcaccggcaatgacggtttacaggccgggaggatcgccagagcagcacagcaatcgcttgcttttggcatgcctgttagcattgagcacactgaaaaaatcgctttttaatctaacaggattacaattcagcaagcttgggtatatactccattgatactttaagtaggcggtggagaaaatgaatacagtacatgctaaaggaaatgttttgaacaaaatcggaattccttctcacatggtttggggttatattggcgttgtcatctttatggttggagacggcctcgaacaaggctggctgtctccttttctcgttgatcatggtctcagtatgcagcaatccgcatcgttatttaccatgtacggcattgctgtcaccatctcagcttggctttcaggaacgtttgtccaaacttgggggccgagaaaaacgatgactgtcggattgcttgcatttatcctcggttcggccgcttttatcggctgggcgattcctcatatgtattatccggctctcttgggcagctatgctcttagaggcttgggatatccgctgtttgcatactcttttctcgtatgggtgtcatacagcacctctcaaaatattcttggaaaagccgtcggctggttttggtttatgtttacgtgcggccttaacgtgctcggtccgttctattccagctatgcagttccggcctttggagaaatcaatacgctttggagcgctttactgtttgtggcggcaggcggaattcttgccttattttttaacaaagataaatttactccgatacaaaaacaagatcagccgaaatggaaagaactgtcgaaggcatttacgattatgtttgaaaaccctaaggtaggcatcggcggagtggtcaagacgattaatgcgataggacaatttggatttgccatctttcttcctacttatttagcacgatacgggtattcggtttcggaatggctgcaaatatgggggacgctgttttttgtgaatattgtgtttaatatcattttcggtgcagtcggagataaactaggctggcgcaatacggtcatgtggtttggcggtgtcggatgcggtatttttacgctggcgctgtattacacgcctcagctgatcgggcatcagtattgggtgctcatgattatcgcctgctgctacggcgcggctttagcagggtacgtcccattaagcgcgcttttgccgacgcttgcacctgataataaaggtgctgccatgtcagtgttgaatttgggatctggtttatgtgcgtttatcgcgccgggcatcgtgagtcttttcattgggccgctcggtgcaggtggcgtgatttggatctttgcggcattgtattttttcagtgcctttctgacgcgattcttgacaatttctgagcaaagcacagatgtgtatacggaggaacggtttgtcagggaaaatgtgcagacaaattttgataaaacggttaagcagtagcctctttggtcaaactaatcataaacgtgtgcaaagaggtgtagagggtgaaacgattcagcacggcgtatcttttgctgggcattctttgctcagcggcagtatttttaataggagctccttcccgcgcacttggcgcggaagtggagcactatgagccgctgcaggtgcatgtgcagcttgaaaaggtgtatttggacggcgatgtcagcattgagcataagcatgaaaaagtgttttctatggatgatttttgggcagcttatgccggatggacgctagtggaacaaaaaaagggatatgtgctcttccggaagcaaatggacgatatttctccgctcagcaaggtcaacgggtatatcggtgtatcggataatggagtgatttccacttttcatgggcggcctgagccagcttccgaaccaattcagtctttttttcaaattgatttagaaaggctggaaagccatatgcaaaaaaatctgctgaaaggcattccatttcggacaaaagcggagtttgaggatgtcatcgaacatatgaagacatacagcgggtagcgtccgctgattgaagacatgtattcatgtcttttttttcgtgaaagaatgagagagaagcgaacatatgttaacttttctataagactttggctgtttttatggtacaatgaagaacagtcaaagaggtgaatttgcgtgattgaatttgttaaagggacgattgattatgtatctccccaatatattgtcatagagaacggcggcatcggctatcagattttcacgccgaatccgtttatatataaggagagaagccaagaaacgatttttacataccatcatatcagagaggatgctttttcgctttatggtttttcaacaagagaggagaaggcgctctttacaaagctgttaaacgtgaccggaattggcccgaaaggagcacttgccatcttgggctcgggtgatcccggagcggtcatccaagcaattgaaaatgaagatgaagcttttttggtcaagtttcctggagtaggaaagaaaaccgcacgccagattattctagatttaaaaggaaagctggcagatgttgtgcctgaaatgattgaaaatctgtttaatcatgaagaaaggcttgaaaagcaaacagcggaaacggctcttgaagaagcacttgaagccctcagggttctcggatatgctgaaaaagaaatcaaaaaggtgcttcctcaccttaaagaagaaattgggctgacaacagaccaatatgtgaaaaaagcattacaaaaactattaaagtaaggtgatgttcatggatgaacggctcgtctcaagtgaagcagacaaccatgaatcagtgatagagcaaagcctgaggccgcaaaatctggcacagtatatcgggcagcataaggtaaaagaaaatttgcgcgtgtttatagatgcggcgaaaatgagacaggagacgctggatcatgttcttctgtacgggccgcccggactcggaaaaacaacgcttgcttcgattgttgctaatgaaatgggagtggaattgcggacgacatcagggcctgcgattgaaaggcctggtgatttggctgctatattaacggcgctggaaccgggagatgtattatttattgatgaaatacataggctgcacagatcgatcgaagaggtgctttatcctgcaatggaagacttttgcctggacattgtgattggcaaaggcccatctgcccgctcggttcgcctcgaccttccgccttttacgctggtgggagccacgacgagggtggggcttttgacggctcctttaagagacagattcggcgtaatgtctcgccttgagtactatacacaagaagaactggcggatattgtcacaagaaccgctgatgtattcgaggttgagattgataaaccgtcggctcttgaaattgcaagaagatcgagagggacgccccgcgtggcgaaccgcctgctgagaagggtgcgcgatttcgcccaagtgctgggtgacagcaggattacggaagacatttctcagaatgcgctggagcggcttcaggttgaccgcctcggtttggatcatattgatcataagctgctgatgggcatgatcgaaaaattcaacggcggcccagtaggccttgatacgatttcagctaccatcggcgaggaatcgcatacgattgaagacgtatatgaaccatatctgctgcaaattggatttatacaaagaacgccgcgtggaaggatcgtgacaccggccgtttatcatcatttccaaatggaggctccccgatatgactgaatttcctaagatcattatgattcttggtgctgttttgcttattatcggagcagttttgcattttgtcggcaagatgccgggagatatttttgtaaaaaaaggaaatgttacgtttttcttcccggttgtcacttgtattattataagtgtggtattatcaattttgcttaatctttttggcagaatgaaataacaaaagactagaataaaggtgaaatcatcatgaaagtcgatttatttgattttgaactaccagaacgtttaattgcacaagtaccgttggagcagcgtgatgcttcaaggctgatggtgctcgataaacatacaggagagcttactgacagctcgtttaaacacattatcagcttctttaacgaaggcgattgtctagtcctgaacaatacccgggtactgcctgcgcggttattcggcacaaaagaggataccggcgcgaaagtggaacttcttttgttgaaacaggaaaccggtgataaatgggaaacacttgccaaaccggcgaaacgggtgaaaaaaggaactgttgtcacatttggagacggaagattgaaggcaatctgcacggaagagcttgagcacggcggcagaaagatggaatttcaatatgacggtattttctacgaggtgcttgaatcccttggagagatgccgctccctccatatatcaaagaacagcttgatgacaaagagcgctaccagacagtgtattcaaaagaaattggctctgctgctgcgcctacagctggccttcacttcacggaagaaatcttacagcagctgaaagacaaaggcgtgcaaattgagttcatcacactgcacgtaggccttggaacgtttcgccctgtgagtgccgatgaagtggaagagcataatatgcatgcagagttttatcaaatgtcagaagaaacggctgcagccttaaacaaagtaagagaaaatggcggtcggatcatttctgtcggcacgacctcgacacgcacgcttgagacgattgccggagaacatgacgggcaatttaaagcatcaagcggctggacatctatttttatttatccgggctatgaatttaaagccattgacggaatgattacaaacttccatttgccgaaatcgtcattgattatgctggtcagcgcgcttgctggaagagaaaacattctgcgtgcctataaccatgcagtggaagaggaataccgtttcttcagcttcggagacgcgatgctgattatataatttgagaacaggaggcctcatcaaaagtggctgaacaaccaatacgctatgaatttataaaagaatgcaaacaaacaggagcgcggctgggcaaagtgcatacgcctcacggctccttcgaaacgccggtttttatgccggtcggcacactggcgacagtcaaaacaatgtcgcctgaagagctgaaagcaatggatgcaggcatcattttgagcaacacttatcatctatggcttcgtccgggccaagacattgtcaaagaagcgggcgggctccataaatttatgaactgggaccgcgcaattttaacagattcaggcggttttcaggtcttttctttaagcaagtttcgtaatatagaggaagagggtgtccatttccgcaatcatctaaatggagacaagctgtttttatctccggaaaaagcgatggagatccaaaacgcactcggctctgatattatgatggcgtttgacgaatgcccgccatacccggcggagtacgactacatgaagaggtcagttgaacggacaagccgctgggcggaacgctgcctgaatgcccacaatcgtcaggatgaacaagggctgtttggtattgtacaaggcggagaatatgaagatctgcggacacaaagtgcgaaggacttgatttcgcttgattttccgggatatgctataggcggattgtctgtaggtgaaccgaaggatgtcatgaaccgtgtactcgaattcacaacaccgctcttgccgaaggataaaccgagatatctgatgggagtaggttctccggacgcactgatcgacggagcgatccgcggggtcgatatgtttgactgtgtgctgcctacacggattgcaagaaacggcacagtgtttactgctgaaggacgactcaatatgaaaaatgcgaaatttgaaagagacttccgtccgattgatgaagagtgtgattgctatacatgtaaaaactacactcgcgcgtacattaggcacttgattcgctgcaatgaaacattcggccttcgattaacaacttaccataaccttcattttctgttacacttaatggagcaggtaagacaggctattcgcgaggatcgtctgggtgatttcagagaagagttctttgagcgttacggctataacaagccaaatgcgaaaagcttctaaataaacataacaggcttacagaaaggggtgaaaatgatgactggcactttaggtacattggttcctattattttaatgtttgcggtcctttacttcttgctgattcgtcctcagcaaaagcagcaaaaggctgtacgccaaatgcaagaggaactgaaaaaaggcgattcagtagtgacaatcgggggattgcacggtactgttgactctatcgacgaaagcaaagtcgtaattaagactggtgataacacacgtcttacgttcgaccgccgcgcgatcagagaagtttctgctgctgaataacagcaggagctatacatagcaaacaaaaaagagcgggcaagtgagcccgctcttttttatgtggaagacctgtttcccctcatgttcacgccgaaaatcccgcccagcatgcacacccctaaaaatcccagatggaagatcagctgttctgctgtaaatgtctttccgaatcctaaatactgaaacaataagataatcagagaaaaacttaaggcggtcaatgcgccaatcatccagcctctttccttgcctttcccgcctgaaatgaacccgccgataaataaagagagaaatgagatagcggtgatcagccagttaaatgatgattcttccagcgaggttgcggtcaataaaagtgaaaccgctaaacttgtcaggagcatggctgaaaatatggcgattaagccgtaaagaatgccttttccaacttgtttcgtttcctccatgattgtctcctctctgcctgtattaaaaggcttctgttctttttgttcaaaaccgtcagacatgctgatggctcgtctttgtaaaaatgtattcccttatcccatgaattagacgtaaaagctttgtgaaatgcaatcggtttttcttacataaattgatcattttgttgcaacctataatgagttggaggtgcataatggaagagcttctcactattgcgtttcgcacagtcgtattgtattttgtgatattggtcatttttcgtttcatgggcaaacgggagatcggagagcttagtattttagatctcgttgtctttatcatgatggctgaaattgccgttttagccatagaaaacgtagacgatcatctatttcataccattttgccaatgcttgtattaatgatcattcaagtgactttggcatacttttctttaaaaaaccgaaaagtccgccagcttcttgacggtaagccgaccataattatcaaatatggaaaaattgacgaagaagccatgaaatcacagcgttataattttgatgatttaatggttcagctcagagaaaatagcatcgacagagtagctgacgtatcatttgctattttagagccgtcgggcaaactgactattgttaagaaagaaaacagcggagagcatcggcagctcgaaatgccgctcattatagacggcttcattcaaacagaaaacctgtccagaatcagtaaagatagaaaatggctgcttgaaagtttgcaaaaacacggatacacaaacccttcagatatttcattttgctcgtttacagacggagaaatatatattgatgaaaaagatgggcaccgcacgtgaccattatcggatgatcaaccgtccgataatgggaatgcggcgaagctcatcttttttaattaaacggaaaacgagcaggaggatcatataaatggcggcgctcgccgcaatccatccggctagattgacagcctcagatgctccaaagcttatatattgtttgatggcggagctgatgaatccgcaaattacaataacagcgaagctgagcgcgtactccttgattttgatgctgatcggcagcactttgcttacggttgctgcgtgcaatagcgtgacgagcaccatgcctgtcacaatggctaatgccgcgcccataatgccaagagaaggccttgtggcaaggacaaaaataaggcctgttttgacaagcgctccgattaagctgttcatcatcgcagctcctgccaaattaagcgcctgcagcacagcttgaagcgggccttggaaataataaagcagaaaaaacggggccatcacttttataaatacagctgcgcctgaggaaccgtacatcactctcatcagctcatccgcaaatacaaataaaataacaactgaaatgcctccgctgagcagacagagacgcatcgcctgttctaagcggtattccaccacctgcaattttttctgctccattccttcactgatcgcaggaacaagcgcggtcgacaaagaatatgtaataaagctgggcagagtcagcagcgtcatggcaaagccggttagttccccgtattgctttgttgcggcaactgttgccacaccggcgatggcaaggctttgagcgacgacgattggctcgaaaaaccaagagaggtttccgataaagcggctcccggttgttggaagggacacgctcattaattgggtaaaggtttgttttccgtttttaattgactgtaaaaaatgctttctgattttaattgtctttttatacttaaagcaaacgaataaataaagaagtgatgccagctcccctgccactgaggatagcattgcccccgctgcagcatattcaattccgtaagggagaaaaatcgttgtgcagacagccacgagtgaaatgcggacaacctgttcaaggacttgtgacatagcaagcgggttcatattctgttttccttgaaagtatcccctcagcacactcgatatagcaataatcggcacaacaggcgtaatggccaagagcggatacagtgttcgcttatctgtcagcatcgtttcagccataacaggggcgaaaaacagaaacagcggtgtaaagatgaggctgagcactcccgtaatggtcagagacatgactaaaatatttttcgttttttgatgatctccgcgcgcactggcttcagcgactagcttgctgatcgcgaccggcagaccgaattgagttaatgtagtggccaagaagaaagtaggcgctgccatcatgtaaagcccgactccttcttcaccgataaaacgggcgataaccacccggttgacaaacccgagcattcttgtaaccattcctgctgcgataaggataagagtgccctttaaaaacgtctgtttcgccatttttaccccctgccttctcaaactacctggaatcatatacaataaagatatgcgtatatgtcgtccaagcatgacaagtcttcttgaaaaacaataaaaaaggagcgtggaattcgtggagaagcatccagccgatctatataaagaccacgtcaggccgtttctttacagcaaactggaagagtttaagattctcgggtatgatgatgttgaactcgaaagtttgtggtcatacttaacagataagaagtggaaaaagaaaacggaactgagcatttatgaactggcgagtgatattttatcagtgaaaattggcgaatttatgaactatgcaaccgttgagtcatttaaaacgtctaattggctgggcagtgaagagggccaggaagcattggaagaactgctgagatagcaggttgattcgcacaggtttaagggaggatatacataatgaaaaaaggacgcttgattgcgtttttccttttcgttctattgatcggcacgggcttgggctactttacgaagcctgccgctaacaatattacgttaggattggatttgcaaggcggatttgaggtgctgtatgatgtacagcctgtaaaaaaaggtgacaaaatcacaaaagacgttctggtcagcacagtagaggcactgaaccgccgggccaatgttctcggtgtcagcgaaccgaacatccaaattgaagggaataaccggattcgcgttcagctcgctggcgtgacaaaccaaaacagagcgcgtgaaattttggcgactgaagcgcagctttctttcagagatgcaaatgataaggaactgttaaacggtgctgatctagtcgaaaacggcgctaaacaaacttatgatagcacaacaaatgagccaattgtcacgattaagctgaaagacgctgataaatttggtgaagtgaccaagaaggtcatgaaaatggcgccaaacaaccagcttgtcatttggttggattatgataaaggtgattcctttaagaaagaagttcaaaaagagcatcctaaatttgtatccgctccaaatgtaagtcaggaactaaatacaactgatgtaaaaattgaaggtcatttcacagctcaagaagcgaaagatttagccagcattttaaacgcaggcgcacttcctgtgaaactgactgaaaagtattcgacatcagtaggcgcgcaattcggccagcaggctctccatgatacggtgtttgccggtattgtcggtatcgcaattattttcttatttatgcttttctattaccgtctgccgggattaatcgcggtgattacgctgtctgtttatatctacattacactccagatctttgactggatgaatgccgtactcacgcttccgggaattgccgctctcattttaggtgtcgggatggctgttgacgccaacattattacctatgagcggattaaagaagagctcaagctaggaaagtcagtccgctctgccttccgttcaggaaacagacggtcatttgcgacgatttttgacgcgaatattacaaccattattgcagcggttgtgctctttatctttgggacaagctctgttaaagggtttgcgacaatgctgatcctatcgattttgacaagctttatcactgccgttttcttatcgagatttctcctcgctctccttgtggaaagcagatggcttgatcggaaaaaaggctggtttggtgtcaataagaaacatatcatggatattcaggatacggatgaaaatacagagccgcatacgccattccaaaaatgggatttcacgagcaaacgcaaatacttctttattttctccagtgcggtcacggttgccgggattattatcctgcttgtgttcaggctgaatcttggcattgactttgcaagcggtgcacggattgaagtgcaaagcgaccataagctgacgacagagcaagttgagaaggattttgaatctctgggtatggaccctgatactgtagttctgtcaggcgaaaagagcaatatcggtgttgcccgttttgtcggggtgccagataaagaaaccattgcaaaagtaaaaacgtattttaaagacaaatacggatctgatccaaatgtcagcacagtttcaccgacagtcggtaaggagctggcgagaaatgcgctgtacgcagttgctatagcttctattggcatcattatttacgtttcaatccgattcgaatacaaaatggcgattgctgccatcgcctcattgctatatgacgcattctttatcgtcacgttcttcagtattacaaggcttgaggtagatgttacattcatcgcggccatcttgacgataatcgggtattccattaacgatacaatcgttacatttgacagggtccgcgagcatatgaaaaagcgtaagccgaaaacctttgccgatctgaaccatattgtaaacctgagcctgcagcaaacctttacacgttcaattaacactgtattaaccgttgtgattgttgttgtgacattgctgatctttggagcatcttctattactaacttctcaattgctttattggtcgggctgttaacaggcgtttattcttctctatacattgccgcacaaatttggcttgcatggaaaggaagagaactgaaaaaagattcggcgcaataaaaaatatcaggctgtcctctgcagggcagcctgttttttgaagtttcattgaacttaaaatagacatttgctataatgacatacgcttacatttaaacatatatatggtgttaaaagtgtttatggctggttttcagatatgtaggagggtttatatatgagggttcgcgaatcagagctgccgggcataggacaaaaagttgaaatgattactagaaaccgtgataaaatttcaattatcattcatcatgacggacggagagagctttactattttgacgaaaacgaccatgaggaatgtgttgcctccgtgcagtttgatgacgctgaagcaaggcaaatgtctgcaattcttggcggaatggcatataaaccgaaagcattagaacaggtcgagtcagcccttgatgatttgattatagagtggtgtaaagcagaggcgggagcgcctgccattcatcagacgattggtgatttgaatgtgggtcaggaatatcatgtgacggtcattgcaattgttaaaaagaatcaggataaacaactgaatccgagctctgaaacagtcattgacgaaggcgatacacttgtgatttccggtgagggaaccggactgaagaggctgatccgggaaaaattaacagcaaagggagcttaacctagtgttaagccatgtttaaaaccagtcttgattgggaaagttacctcaataagaagtttgggggaaaagagaatgaataaacaatggaccattattttcgcacttattttcaccttaattgtcgctattttcgcagtcattaatgttcgatccgtagaagttgattacctgtttggaagatcagaatggccgctcattcttgttattttgggctcagttttaatgggagcactgatcgtattttctgtcggcatttttcaggtaatgaaattgaagcgggaaataaaaaccttgcggaaagaaaatagaacagcaatacataaacaagaggatactcatcttgctgatcagactgacacacaggatgcatcagccatgattgagaaaaaagactagttttcgaatattatttgaaacccctcagcctgctctagtataatagggtggttgaggggtgaatttatgttagcgtcaaaaatgcgatgggaaatccagcgaccagatcaggataaggtcaaatcactcacagaacaattgcatataacacctcttgttgcgtccctgcttgtaaaaagaggctttgatacggcagaaagcgctaggctgtttttacatacaaaggatgccgatttttatgatccttttgaaatgaaaggcatgaaagaagcggcagatcgaataaaacaggcgatttcacaacaagaaaagattatgatatatggcgattatgacgccgatggggttacaagtacgtcagtgatgcttcacacgctgcaaaaactgtcggctcaagttgatttttatatacctgaccgttttaaagaaggatatggacctaatgaacaggcgtttcgttcgattaaagaacggggcttctctttgatcattacggttgatacaggaattgccgctgtgcatgaagcgaaggtggcaaaggaactcggactggatgtcatcattaccgatcatcatgaaccgggaccggagcttccggatgtccgtgcgatcgtccacccgaagcagcctggctgcacttacccgtttaaagagcttgccggggttggagtcgcgtttaagcttgcccacgctttattgggtgaacttcctgatgaactgcttgacctggcggctatcggcaccattgccgatctagtcccgctgcatgacgaaaacagattaatagcaacactaggacttgaaaggcttcgacggacaaatcggctcggcttaaaagagctgattaagctgtcaggcggagacatcggagaagcgaacgaagaaacagtcggatttcagctcgcaccaaggctgaatgccgtcggaagaatcgaacaggcggatcccgctgttcatttgcttatgtcagaggattcgtttgaagcggaagagcttgccgcagaaattgaccagctgaacaaagagcgccaaaaaatggtcagcaaaatgacggatgaagcgattgaaatggttgaacagcaagggctcgatcaaactgcaattgtcgtggccaaagccggatggaacccgggagtcgtcgggattgtggcttcaaagcttgtggaccgtttctaccgaccggccattgttcttggtattgatgaagaaaagggaatcgctaaaggttcggcccgaagcatcagaggatttaatttatttgagagcctttctgaatgcagagatattcttcctcatttcggcggccatccaatggctgcggggatgacgctgaaagccgaagatgtgccggatttgcgaagcaggctgaatgaaatagcggacaatacgcttacggaagaggattttattcccgtacaggaagtcgaccttgtctgcggcgtcgaagacattacagttgaaagcatcgcagaaatgaacatgctgtctccttttggcatgctgaacccgaaaccgcacgttctcgtagaaaatgcagtactggaagatgtccgcaagataggggcaaataaaactcatgtcaaaatgacgatcagaaacgagtcgtcccagcttgattgcgtcggttttaataaaggcgagcttcaagaaggcatcgtaccgggttcaagaatttccattgtcggtgagatgtcaatcaacgaatggaacaatcgaaaaaagccgcagcttatgataaaggatgccgctgtttctgaatggcagctgtttgatttaaggggaaaacggacgtgggaagacacagtttccgcccttccatctgctaaacgggccattgtctctttcaaagaagactcaacaacattacttcaaactgaagaccttcgccgagaagtgcacgtcatcagttctaaagatcaagcaaaggcgtttgacctcgatggtgcatatattgtattactggatccgccgccttcgctggacatgctcgcacgtttgctggaaggaaaggcgcccgagcggatatattttatttttctcaatcatgaggaccactttttatcaacttttcccgcaagagaccactttaaatggtattatgcgttcttgctgaaaagaggcgcttttgacgtgaaaaaacacggttcagagcttgcaaaacataaaggctggtccgttgaaacaatcaatttcatgacaaaggtgttttttgatctcggttttgttaaaatagagaatggtgtgctgtctgttgtgagcggagcaaagaaacgcgacttaacagactcacaaacatatcaggcgaaacagcagctgatggaactggatcaaaagctgaattattcttctgctgaagagctgaaggaatggctgaataagctgatgaaacaagattcagaggcttatgaaagtacgaggaggacataaaacagatggatttaaaacaatacgtaacaattgtaccggattacccgaaagagggcgtgcaatttaaagatattacgacactgatggataaaggcgatgtataccgctatgccacagatcaaattgttgaatatgcgaaagaaaagcaaattgatttggtcgttggccctgaagcgcgcggctttattatcggctgtcccgttgcttacgcgcttggcgtaggttttgcgccggtccgcaaagaaggcaagttgcctcgtgaagtaatcaaagtggattatggcttggaatacggaaaagacgtattaacgatccacaaagatgcgattaagcctggtcagcgtgtgcttattacagatgacctgcttgcgacaggcggcacaattgaagcgacaatcaaacttgttgaagaacttggcggcgttgttgctggtatcgctttcttaatcgagctttcttaccttgacggcagaaataagctcgaagattacgacatcttaacattgatgaaatactaaggataaccgcataacgaaaaagcactccatgtcagggtgcttttttcctattgttttgcatttattttatataatatttggctatttgaacttctgctctttacatctttcgtttttttcttgataataaactacaatacagtttacattttaaaaaaggtgattccatggcgaacgaacaagtattgactgccgagcaagttatagataaagcacgcagctatctatctgatgagcatatcgcatttgtcgaaaaagcatatctgtacgctgaagatgctcatcgcgagcaataccgcaaatcgggcgagccatatattattcatccgattcaggttgcggggatactcgttgatcttgaaatggacccttccacaatcgcgggcggatttttgcacgatgtcgtggaagatacagatgtgacgctcgatgacctgaaagaagcattttccgaagaagtggcaatgcttgtagacggcgtaacgaaactcggcaaaattaaatataaatctcaagaggaacagcaggcggaaaatcatcgcaaaatgtttgtcgctatggctcaagatatcagggtcatattgatcaagctggcggatcgtcttcacaatatgcggacactgaaacatctgcctcaggaaaaacagcggagaatctccaatgaaacgctggaaatttttgctcctttggcgcatcgtctcgggatttcaaaaattaagtgggaattggaagatacggcgctccgttatttgaaccctcagcaatattacagaattgtcaacctcatgaagaagaaacgtgcagaacgagagctttatgtcgatgaggttgtcaatgaagtgaagaaacgtgtcgaagaagtaaatatcaaggctgacttctcgggacgcccgaaacatatttacagcatttatcgaaaaatggtgctgcaaaataagcaattcaatgaaatttacgatttgttggctgtccgtattcttgtgaatagcataaaggactgctacgcggtgcttggcatcattcacacatgctggaaaccgatgccaggcagattcaaagattatatcgcaatgccgaagccgaatatgtatcaatcgcttcatacaacggttattgggcctaaaggcgatccgcttgaagtgcagatccgcacctttgaaatgcatgaaatagcggaatacggggttgcggctcactgggcttataaagaagggaaagcagccaatgaaggtgcaacctttgagaaaaagctttcttggttccgtgaaattttagaatttcaaaatgaatcgacagatgcagaagaatttatggaatcgctcaaaattgatttgttctctgacatggtgtatgtctttacgccaaaaggagatgtaatcgagcttccgtccggttctgttccgattgacttttcttaccggattcactctgaaatcggcaataaaacaatcggtgccaaagtaaacggaaaaatggttacgcttgaccataagcttcggacaggtgatatcgttgaaattctcacctctaagcattcctacggtccgagccaggattgggtgaagcttgcccaaacatcccaagcgaagcataaaatccgtcaattctttaagaaacagcggcgtgaagaaaatgtcgaaaaaggccgtgagctggtcgaaaaagaaattaaaaacttggattttgaattgaaggatgttttaacgccggagaatattcaaaaggttgctgacaaatttaatttctcaaatgaagaggatatgtacgcggcggtcggttacaacggcatcacagctctgcaggtggcgaaccgcctaacagaaaaagagagaaagcagcgcgaccaggaagaacaggaaaagatcgttcaggaagtcactggggaacctaagccatacccgcaaggaagaaaacgggaagctggcgttcgtgtcaagggcattgacaacctccttgtccgtttatcaaaatgctgcaatcctgtgccaggtgatgatattgtcggctttatcacaaaaggcagaggggtttcggtccatcgcgaagactgtccgaatgtcaaaacgaatgaagcccaagagcggctgatcccggtagagtgggaacatgagtcacaagttcaaaagcgcaaggaatacaatgttgagatagagattcttgggtatgaccgccgcggattgctgaacgaggtactccaggcagtgaatgaaacgaaaaccaatatttcatctgtctctggcaaatcggatcgcaataaagtggcaaccatccatatggcgatttttatccagaatatcaatcacttgcataaagtcgtcgagcgtattaaacagattagagatatctattctgtgcgccgcgtcatgaactaaaggggttagaaaatgagattagttgttcagcgagtaacagaagcaagcgttacagtggacgaagaggtcgtcggccaaattggacaaggccttatggtgctggtcggcatcactcacgatgatacagaagatgatgcagcttatttagccgataaagttgtcaatctccgtattttcgatgacagtgaagggaaaatgaatctgtctcttgtagatataggaggagagattttatccgtctcacagtttacgctttatggagatacgaaaaaagggcgccggccgaactacatgaacgcggccaaacctgataaagctttaggtctttatgaaaaatggaatgacctgcttcgtgaaaaaggaatcaaagtggagaccggaacgtttggagcaatgatggatgttcagcttacaaactccggaccggtcacgctcattatggattcaaaataaaaaaagctgccaaaaggcag

SEQ ID NO: 50 - DNA, 49563 bp, Bacillus subtilis WAUSV36
ccccccacgactgcgtttttttattggaagtatttctctaatccgctttcgatcccatctgttactttttcttggtatgaattgctatgtacaatggcttcttcctgcggatggcttacatatcccagctcgtacagcatagcgggctgtctgttttcccggagcacataataatctccgaataatacgccgcggtctggaatggaagaacgcttcaccacttctgagtggacatctgatgcgagttcctgatctttggcaggactgtagtaatatgctgtactgcctcttgtagaggtatccgcatagctgtcataatgaatgctgataaaggcgtcagcgttacggtagtgagaggtagagacccgtgactgcaggctgacaaaggtatcatcctggcgtgtcacatatacatccgctccagccgatctaagtttgctggcgagcagttttgccgttttgatcgtcaggtttttctcgaatttccccgaatacccgatcgttccgctgtcttttcctccatgtcccgggtcaacaataatcgttttattgtttagagagccgtttccagacggggaatcagagactggcggttcacctgcttcttctgcgcttttagacgtttggaccacccaattggctacataagcagtctgcccgttatcaagctttatttcataccagcttccctttgaaccggtaatggtgtatgaatctcctttggcagcgcgctcaacgatcgaagctgatgttgacgcatcacttcttagattcgttcctccgtacatgatataggcttttttagcggaggatgaactgccggcatttgctgaatcatcagctggaacagaactagtcaaaaggtaatggcttgcaacccagccttttagcccgttcacctcaatgtgagcccagccatttttctcgttgagaaccgtcagtttcgttccgcgatcaagttttgttataattgccgcgtcatgtgaggcggaggctcttacatttagcgaagaaacaccgactgtgcccgtcgttgacgcaccggaatcctcggtttggtcactctcatcagacgctgaactgctgcctcctgatgtgacatattcagatgatacccatccggtggcactgtgataggatatcttgatccagcccgaatctttatcaatgacagatgcttggctgccttgcgggaatttgccgatgacttcgtaggaagtgcccgggccgcttctcatccgcagatcggggtctgttgatgtcacagtgtcactgcttcctgaggagcttgtgctggcctggtcttcctttgtaataagccaggagactacccagcccttttctccagaaccaagctgtatctgcacccagtctccatcttcctttaaaattggatagggttctcccttttttacttccgctgtaatgccgtagctaagccctgggccgcttctgacgttcatttcatctgttgcgatgaccgcttctccttgagcagctgtaacggatgaaaaggtcgggaatagcgctgaggtgaaaataatacatacaataaggacaaagtatttcttgttcattgtgtcctcctttctgatgatcattaaaaaagcattcttgtttaatatcgtaaagtcctttctgatttttaaataaaaataaaatgatttgtttatactaagcgtaaatacaatcaaaaaggtgtgcaaatcatgaaatatcatccaaaaatgggacgtgcatttcacgacggtgaagcgaatctgcattacagcgatcacgcagatcccgatacgactggttatcttacggaaacagcatctgaatttggtcttatgtccaaagaagcagcgctgaggaaaaacaaccggaataaagcttgacagagaaccccaatcccattattataatagaaattgagtacatagcaaatgatgaaagatttgaaccaataatggagaagagtaggtcagattgcatgattagagaggaacccgccccaggctgaaagcggatcccattgcgtctttctcgaaacaacactccggaggtttcctgctgaacgcgtgaataacgccattaggcagtgaacgtgaacctgcgttaaaggatcgagcgggaatatgaacgtattccaactagggtggcaccacgggtataactctcgtccctactatcatgtatagtaggggcgggagtttttttcattttcatcattaacgatcattggatattttataaggaatacataaggaggtctacctatgggatataacattccgagaggaacacaggatattctgcctggagaatcagatcgctggcagtttgttgaacaaattatgagagacacttgccgcacttatcaatataaagaaatccgcacaccgatttttgagcatacagaactgtttgccagaggcgtcggagaatcaacggatatcgtacaaaaagaaatgtataccttcgaggaccgcaaaggcagaagcctgacgcttcgtccggagggaacagctgctgcggttcgcgcttttaatgaaaacaagctgttcgcaaatcctgtacagccgacaaagctttattatgtcgggccgatgttccgttatgaacgtcctcagacgggccgttaccgccagttttatcagtttggaattgaagcgattggttcgaaagaccctgcaatcgacgctgaagtaatggcgcttgcgatgagtatttatgaaaaagcaggtttagaaaacgttaagcttgtcataaacagtctcggcgatcaagatagccgcaaaagctacagagaagcgctcgtgaaacacttcgagcctcgcatcgaagaattttgttcagactgccagtcccggctgcacacgaacccgcttagaattttggactgcaaaaaagaccgtgatcatgagctgatgaaatcggcaccttcgattttgacatatttaaatgaagaatcagccgcttattttgaaaaagtgaaacaatacttaaatgatcttggcatttcgtatgaaatcgatccgaaccttgtgagagggctggattattacaaccacaccgcatttgaaattatgagcaatgcggagggctttggcgcgattacgacacttgccggcggcggacgctacgacgggcttgtcgaacagatcggcggacctgaagcaccgggcatcggatttgcgatgagcatcgaacgcttgcttgccgcaattgatgctgaaaaaagagagctgcctgttgataagggaatcgactgctatatcgtcacactcggcgaaaaagcaaaggattattctgtttcattggtgtacaaactgagagaagcaggcatttccagtgaaatcgattatgaaaataagaaaatgaaaggccagtttaaaacagctgatcgcttaaaggccagatttattgcgattttgggtgaagatgagcttgcccaaaacaaaatcaatgtaaaggatgcacagacgggcgaacagattgaagtggcacttgatgaatttatacatgtgatgaaggcaaaccaaaagggataaggagtgaaacgcattgtttggaagaacatattattgcggtgatataactgaaaaagcaattggcgaatctgtaacgctgaaaggctgggtccaaaaaagacgagacctcggcggattgatttttattgacttgcgtgaccgtacgggcattgttcaagtcgtttttaaccctgatgtgtcaaaagaagcgcttgctattgcggaaggcatcagaaatgaatacgtgcttgatattcaaggaaaagtggtggcgcgtgaagagggaacagttaatccgaatttgaaaacaggcgcgatcgaaatacatgctgatggagtgaacgtattaaatgctgcaaagacacctccatttgcgatttctgatcaagctgaagaagtgtcagaggacgttcgtttaaaacaccgttacttagatttgcgcagaccggctatgttccagacgatgcagctgcgccataacgtgacgaaagctgttcgcagctttttagatgaaaatgggtttcttgatattgaaacgccgattttaacaggaagcacgcctgaaggcgcacgtgactacttggtgccgagccgtgtgcacgaaggtgagttctacgcgctgccgcagtctccgcagctatttaaacagcttctgatggtatcaggcattgaacgatattatcaaattgcccgctgtttccgcgatgaagacttgcgtgcggaccgtcagcctgagtttacgcaaattgatattgaaatgtcctttatgagccaggaagacattatgtcattggctgaggagatgatggcaaaggttatgcgtgaaacaaaaggtgaggaacttcagcttcctcttcctcgaatgacgtatgacgaagcaatgaacaagtacgggtctgataaaccggatacgcgttttgacatgcttttgacggatgtgtctgacattgtaaaggatacggaatttaaagtgttctcatcagctgtagcaaacggcggcgtggtcaaagccatcaatgtaaaaggcggtgccggcgattactccagaaaagacatcgacgctcttggcgcttttgctgcaaactacggggcaaaagggcttgcctgggtgaaggttgaggcagacggagtgaaaggcccgatcgctaaattctttgatgaagaaaagcagtctaagctgattgaagcacttgatgctgctgaaggtgatttgctgctgttcggagcggatcaattcgaagttgtggccgcatcactcggcgccctgcgcttaaagcttgggaaagaacgcggactgattgacgaaaaattgttcaatttcttatgggtcatcgactggccgctattagagcatgatccggaagaaggccgtttttacgcagcgcaccatccgttcacaatgcctgtccgagaagaccttgagctgattgaaacagcgcctgaagacatgaaagcgcaagcttatgacctcgtcttaaacggctatgagcttggcggcggttcaatccgtattttcgaaaaggatattcaggaaaaaatgtttgcgcttctcggcttctcaccagaagaagcggctgaacagttcggattcctgctggaagcatttgaatacggcgctcctccgcacggcggaatcgcactcggcttagaccgtctcgttatgcttctcgctggacgtacgaacctgagagatacgattgcattcccgaaaacggcaagtgcaagctgcctgatgacagaagcgccaggcgaagtaagcgacgcccagcttgacgagcttcatctttctatcaagaaaaaagttaagaactgaatttgcagttcgattcttgaaaatcaaaatcgtctgtgatatgattttgacaagttaaataaagtcctgatgtgttagttgtacacctagttttgaccgaacatttttttgatttgggagcccgcatttttaaatggcgtacatgcctcttttcattcggtaaagaggacttacaagatttaaaagagggcacccacctgctgagagcgggttcaaaacaaaggaaagctgcaacggcactattgggactttattttttgtgcgcagaaaaaacggctgctcatggatcagccattttatagatgaaaccagaatacgaatgtggagtgaggttcttgttacaccagttttcacgcaatgaattagctatcggaaaagaaggccttgaaacgctgaaaaacagcacagttgctgtgcttggagtcgggggagtcgggtcgttcgcggcggaagctctcgcgcggtcaggcgtcggccgcattctgcttgtcgacaaagatgatgtcgacattacaaatgtaaatcgtcagcttcacgcgctgctttcaactgtcggacagccgaaagttgatttaatgaaggcgcggatcgcagacattaacccggagtgtgaagtgatcgcgttaaaaatgttctatacggaggaaacgtatgagcagttttttgactatgatcttgactatgtcattgatgcgtcagacaccatttgttataaaattcatttaatgaaagaatgtctaaaacgggatattccgctcatctccagcatgggtgctgcaaataaaacggatccgacacgcttccaaatcgctgatatctcaaaaacgcacactgatccaattgcgaaggtcgttcgtacgaaattacgcaaggagggtatcaaaaaaggcgttcaagtgattttctctgatgaaagcccgattgttattcgggaagatgtcagaaaagaagtggggaatgacgaagcgaaaatacgtaaagcaaaaatgccgccttcctctaatgcttttgtgccgtcagttgcaggtttgattatgggcggacatgttgtcatggatcttttgaaagacattgaaatcaaacgtgtgaaggataaataatgcataaaaacagccttgatgatcaaggctgttttttgttttattttcttttcattaatttatcgtacacctgctttaaggcagattcgaactttccagtctgtttcggcttatagtattgcttatttttcagaggatcagggaggtattgttgttcgacccaaccgttgtcgtaattgtgcgggtatttatagtcgattcctcttcctaattcctgagctcctttataatgcgcgtcttttaaatgcttcgggacatccccaatttttccggctctgatatctgccagggcctcatcgattgccagaatggcagagtttgatttcggtgagaggcaaagctcaataactgcgttggccagcgggattcgcgcttcaggaaacccgactcgctcagcggtctgaatagcgttcagcactctagggccggcttgcgggcttgctaaaccgatatcctcataggcgataacaagcaatcgtcttgcgatgctctccagatcaccggcttcaattaatctagccaaatagtgaagagcagcgttggcatcagagccgcggattgatttttgaaaagcggacagtacatcataatgcgcgtcaccatctttatcgtgagaaaagctttttttctgcaagcattcttccgcggtttctaatgtaatgtgaatttcaccgtctgctgactccttcgttgacaacacggcaagctcaagcgcatttaaagcggagcggacatctcctccgcatccgtgggcaaaatgctccatcgcctgatcatcaatggatacagaataggtgccaaggccccgatgctcatcatggagcgcacgttccagtgcctgtttaatcagttcaggtgttaacggttcaagctcaaaaatctgggtccggcttctgatcgccggattaatggcatgatacgggttagccgtcgttgctccgatcaaaatgatcattccgttttctaaatagggtaatagaaaatcctgttttcctttatccagcctgtggacttcatccagaatcaaaatcacttggccggacatcttggcttcctgagctacgatttccatatcttttttattgttaatgacagcattcagctttcgaaaagcaatacttgttgaaccggcgattgctgttgcgattgatgtttttccaattccgggcggcccgtacaaaatcatggatgacaaatgttttgcctggaccattctgccaataattttatcttcagccaccagatgctgctggccgataatatcctctatttttgtcggacgcatccgatatgccaatggcttcatctatcatctctccttacttaattacagggtaacggaaaaccgtacattagaaaagggtaaaggcccctttccttctgcctcaatgaaaattcgctgaaggtatgttataataacagttggtctataagataataaacggacgaaacatatagaaattaccattataaatgtggaaaatcatgaaataacagaggtgttcatgttgaaaatatcaactaagggaagatacgggctcaccattatgatcgagcttgcaaaaaagcacggtgaaggcccgacttcattaaaaagcatcgcacagacgaataatttgtccgagcattatttggagcagctggtatcgccgctcagaaatgccggtttagtgaaaagcatcagaggcgcatatggcggatatgtattaggcagtgagccggatgccattactgcgggagatattatccgtgtgcttgaggggccgatcagccctgttgaagtgctggaagatgaggagcctgccaagcgtgagctctggattcgcatccgggatgctgtaaaagaggttttagacagtacaacattagaggatcttgccagctatacagacggagagcaagaagcttatatgttctatatttagatcagaggtgtaaacataatggaacggatttatttagatcatgccgcaacgtctccgatggatgagcgcgtgctggaacaaatgataccgcacttctccggcagtttcggtaatccctccagtattcattcatttggcagagaatctcgaaaatgggtggatgaagcaagagcgcagatcgcagcagaaatcggagcggcagagcaggagatcatttttacaagcgggggaacggaagctgataacttggcgatcatgggaaccgcacttgcaagaaaagatcttggcagacatatcatcacaacaaaaattgagcatcacgccgtgcttcacacatgtgaaaaacttgagggagacggatttgacataacgtatctggacgttgaccaaaatggaagagtcagtgcaaaacaggtgaaagaagcactgcgtgatgatacaatccttgtgacagtgatgtatggaaataatgaagtcggaacagtgcagccgatcgaagaaatcggtgagctgttaaaggaacacaaagcttattttcataccgatgctgttcaggcattcgggttgctgccaattgatgtgaaaaacagccatattgaccttctgtctgtttccgggcacaagctcaacgggccaaaagggacaggctttttatatgctagtaaagatgtgaagctttcaccccttttattcggaggagagcaagaaagaaaacgccgtgccggaacggaaaatgttccaggcattgtcgggctgaaagaagcgatcaagctgtcaagtgaagaacgtgacgaaaaaaacgagaagtatcaatcgtttaaagcaatctttgccgacacgcttagagatgcaggtgtggcattcgaggtcaacggggacaaagagcatagtctgccgcatgttctgaatctttatttccccggtgtgtcagtggaagcgctgctggttaatcttgatatggctggtgtcgctgtctccagcggttcagcgtgcacggccggttcagtcctgccgtcacatgttctgactgctatgttcggcgaagagagtgaccggctgacgtcctctattcgaatcagcttcggcctcggcaatacggctgagcaagtgaaaactgctgccaaacatgtggccgacgttgtcaaacggctgacataataaggcggcgtagtaattggagtgaatgaaatggaaaaacggccggaggatacaagagtcgtcgtcggcatgtccggcggagtagactcatctgtggcggccctgctgttaaaagaacagggctatgatgtaatcggaatctttatgaaaaactgggatgatacggacgaaaacggtttttgcacggcgacagaggattatgaagatgtgatccgcgtctgcaaccaaatcggaattccgtattatgccgtaaactttgaaaagcaatattatgagaaggtatttcaatacttccttgatgaatataaagcaggcagaacaccaaacccggatgtattgtgcaacaaagaaattaaattcaaggcctttttggagcatgcattgtcacttggcgccgactatttagcgactggccactatgcaagagtagacagaagcggcggaaaagtcagaatgctgcgcggcattgatgaaaacaaggatcaaacgtacttcctgaatcagctgacagaagatacgctgagcaaagtcatgttcccgatcggcgaacttcaaaaaagccgtgtgcgtgaaattgccaaagaagcagaacttgcaacagcgacgaaaaaagacagtacaggcatctgctttatcggcgaacgcaacttcaaaacgtttctcagccaatatctccctgcacagccgggcgatatgatgacgatggacggcgaagtaaaaggccgccacgacgggttgatgtactatacgatcggacagcgtcacggccttggcatcggcggaagcggcgagccgtggtttgcggtaggcaaagatcttgaaaagaacatcctctacgtagatcaagggttccataacccgcttttatattccgacaaaatcacagcaacaaatatcagctgggtacgttcggatatcatgaagggcgaagagatttcctgcacggctaaattccgttaccgccaagaggatcataaagtaacagtgcgcatgactggcgaaggtgaagcggaagtcatctttgatgaacaagtccgcgctgtaacgccgggacaagccgttgtcttctatgacggcgaagaatgccttggcggcgggacaattgatgatgtgtacaaagacggaacaaaattgtggtacgtataaaagatgaaaaacctcaacactgagttggggttttttaatgaaaggaagatgatcggtggattataatcaactcggtatagaggcgatgcaggaaggcgattacgagaaagcggcagaggcatttacaaaagcgattgaagaaaataaagaagacgcgattccgtatatcaattttgccaaccttctttcatccgtaaacgagctggaacgtgcgcttgcgttttatgataaagcgcttgaattagacagtagcgcagccactgcttattatggagcaggaaatgtctatgttgtaaaagaaatgtacaaagaagcgaaagacatgtttgaaaaagcgctacgtgcggggatggaaaacggcgacctgttttacatgctcggaacggtacttgtcaagctcgaacagcctaagcttgcactgccatatttacaaagagcagtcgaactgaatgaaaacgatacggaagcgcgttttcaattcgggatgtgcttagccaacgagggcatgctggacgaagcgctcagccaattcgcagctgtgacagagcaagacccggggcatgcagatgcattttataatgccggtgtcacttatgcttataaagaaaaccgagaaaaagcgctggaaatgctggacaaggcaatcgatatccagccagatcatatgcttgcgcttcatgctaaaaaactgattgatccatcataacaggcacaggaggagggacagctcgtgcagcagcatccggatcagcttaaactggaggaagagccctatttaaaagggacagtcaacacagtcatctatcataatgacaccaatttatatacggttctgaaagtgaaagtcacagagacctccgaagccattgaagataaagccgtatccgtgacgggctacttccctgcgcttcaagaagaagagacctacacgttttacggaaagatcgtaacccatccaaaattcgggctccaatttcaggcggagcatttcaaaaaggagattccaacgactaaggaaggcatcattcaatatttatcgagtgatttattcgaggggatcggcaaaaaaacagctgaagaaattgtgaaaaagctgggcgacagcgccattaataaaatattggctgatgcttcagtgctttatgatgttcccagactctcaaaaaagaaagcagacacgctggctggcgcattgcagcggcatcagggactggagcaaatcatgatttccttgaatcagtttggctttggcccgcagctgtctatgaaaatctatcaagcctatgaatccgagacgcttgaaaagattcaggaaaatccttatcagcttgtgaaggatgtagaaggcatcgggtttggaaaagcggatgagctgggcagcagaatgggtctttcgggtaatcatcctgagcgggtaaaagctgctattttgtacacgcttgaaacgacttgtctgtcagaggggcacacgtacatagaaacggaacagctgatcatcgacactcaatcactgttaaaccagtcagcaagggaagggcagcgcattacagaaatggatgccgctaacgcaattattgcccttggagaaaataaagacattgtcatagaagatggccgctgttattttccttcgctgttttacgcagaacaaaacgttgcaaagcgtgtgaaacatatcgctagccaaaccgaatatgagaaccagtttcccgaatcagagtttttgctcgcgttgggagaactggaagaacggatggacgttcagtatgcccccagccagaaggaagcgattcaaaaagccctttcctcgccgatgcttcttttaacaggcggcccgggaacaggaaaaacgacggtaatcagagggattgtcgagctctacggagagcttcacggtgtgtcactagacccgtcagcttataaaaaggatgaagcttttccgattgttttggccgctccgacagggagagcagcaaaacggatgagtgaatcaacgggactccctgcagttacgatacacaggctgcttggctggaacggcgctgaaggctttactcatacagaggatcagccgatcgaagggaagctgttaattatcgatgaagccagtatgcttgatatatggctggcgaatcatttgttcaaggcgatccctgatcatatacaaatcatcattgtcggagacgaagaccagctgccttccgtcggtccgggacaagtgctcagagacctgctggcatcccaggtgattccgactgtgagactgacagacatctatcgccaggcagaagggtcatcaatcgtcgagcttgcccaccagatgaaaaatggattgctgccgaacaatttgactgccccgacaaaggaccgttcctttattcgctgcggcgggtcgcaaatcaaagaagtagttgagaaggttgtcgccaatgcattgaaaaaaggctatacagcaaaggacattcaggtcctcgctccgatgtacagaggaaaagccggcattaatgaattgaatgtgatgctgcaggacattttaaatcctcctaaagaaaaacggagagaattgaagttcggggatgttgtctacagaaccggagataaaattttgcagcttgtcaatcagccggaaaacaatgtgttcaacggagatattggcgaaatcacgtcgatattttatgcaaaggaaaatacagaaaaagaagacatggccgtcgtttcttttgacggcaatgaaatgacatttacgaaaaaagattttaatcaatttacccatgcgtattgctgttctattcataaatcgcagggaagtgaatttccgattgtggttttgcctgttgtgaaaggctattatagaatgctcagaagaaaccttctttataccgcgattacaagagcgaagaaatttctcattttatgcggggaagaggaggcgctggagtggggcgtgaaaaataatgatgcaactgtcagacagacctccttgaaaaacaggctgtccgtacaggttgaggaaatggatgccgagcttgaagctttgcaaaaagagctcccgttcagcgtacacgacgccaacattggcatggaaggcattacaccattcgattttatgaaagaagaacagcaataaaatgctcccgtgcaagcgggagttttttttcatttgcagtggaattgatttcatcgtatgagtctaaggcgcaaagcaaaacctaagcctgttcaacaaaaggtggttgatcacactttgagaacatgccatgaagtagaaggattcccagtatactcagaacgaacttctagttatctcgggacaatttccgatatttgtttttctctgaaaggagattgtcttgggtttattcttgcacaaaaacgctttttgcatcatcatcatgcgctattacgggcgtgtgatatctcttccatttttgatgaccgcatattggcttcggtcagttcagaacagcttttgcctcttccgaaatcatgcttcacatacgagcagatgaagatgaagcttgtgaaatcgcaagagggggatatattggggatgctggaagatgtatacttttgtttggacaggggcataatcgtagcatatgaactctcggacggtttcttttctgacctggcgggaagcaagcgccagatccaaagagcggattcgcttgtcgaggtgcggaaagacgagatcgttctgaacggatagaggtgtgaggtatgcttatatgcccgaattgcaaaagtaaggatatcggcaaaatcggcgtgaaccaatattattgctggggctgttttattgaactgacagtggcgaaagggaagattgcaactcatcaggtggaagaagacggaacgttaagcagcttggatgatttgttttctgaggatgaacgcagcatcaatttttaatcatgaaaggagatgcgcaggatgaatcggacgatgacttctcttttggcaatgggagccggagctctcgtgtaccgaatggcgactcaatctgacatgctgaataatcgaagcatgaagcggatgagaagaagaattacgaaaatgttttaatgcaaaaaggatactctccaaagagtatccttttctatgtttgccggacctcgaggcgtcttgctgcgagtgaaaggctgtagttgactgcgaaatacataagggccgcaagtaaaaagatcgggaaaaaataactgccgtcagcgctttggccgttaataatttgcgcgttgtgaatcagttcaggcagggcgatcacaacagcgagcgatgtatcttttaataaagaaataaactggcttacgatgggcggaaccatgcggcgaagcgcttgcggcataacgataaagaacagggtctgtgtatagctcagcccggaggagcgcgccgcttcaatttgtcctttgtcaattgatttcagtccgcttcggataatttcagatagcatagcggattcaaaaatcgttagtgctgtaattgcagcagctgtaatttcaagcttaatcccaatttccggaagggcaaaaaacgtaaagaaaataattaacagcaaggggaggtttctgatcgtttcaacgagaactgcaatcaattgagaaagaacgggaactttcgcataacgcagggtgcctgcgattaaaccgaagaaaaagctcagaatgatggagatgaaagcaacgtacaaggtgacgagaaagccatcccataaaaacgctaaatgctcctgtgaataagcaccgatgaaatccaatgtaactcactccttatcaatagcttttttccagccgtttttccagatagttaacaccgatgctaagcggaatcgtcagcactaagtaaaaaagcgccacaaaaatataaacatcaaatacaacgagtgtgctcgacgaaactaaatcggcttggtacataagatccaatccggccacaaccccaagaatcgaagagtttttgactaagtttaaaaattgattgcctaaaggcggaatgacgattttgattgcctgcggcaaaatgatatggagcatggcttggctgtaggtaaagcctgacgagcgtgccgcttccatctgcccttttgaaacagactggatgcctgctctgatggcttcagcgataaacgcagaggtataaatggtgagagcaaccgttcccgcttgaaaaccgtcaagcctcaggcctgcgtttggaagtccgaaatagaaaacaaaggtaattaaaagaagagggatgttgcggatgaattctacatatgcggtcccgagccattgcagcggcttaaagactgttattctcataaccgctacagcaacgccgaggacaaaactgccggccagcgcgataacacttgcgagcaaggtatggtaaaaaccgtccatatacatgctgaagttatcgaaaagaattgacacattcatctgcctattcactccttatcaaattgggatgagcatcgcctgctcatcccgggatggttgttattcagctgggtcttctttgatccattttttataaatttcatcgtatctgccatccgacttcatctttttaagtgaagcgttgatttctttcgcgagagcagattgcccttttttcacggcgatcccgtaaggctcatctgtaaaaggctttcctgttaattgataatttttattttcatcagccattccatataaaattgcattatctgtggtgagggcatcgccttgccccgatttaagggctgtaaaggcttctgcgtagttttcaaattctaaaacagatgcttcaggcgccttttcacgaatgttttgagaggaggtggagccttttactgcaagaacttttgagcctttgccaagattctcgacactcttgattttgctgccttttttcacgagaagcgattgcccggcctcgaaatagacatcagaaaagtcaacttccttttttcgttcttcagtgatcgtcattgtggcgacaatggcgtcgatatccccgttttgcagcataggaatccttgtttttgaggtgacctctttaaattgagcttttttctcatcacctaaaatgtctttagcgatttgtttagcaatatcaatatcaaaaccctcaatctcacctgagcttggatttttaagaccgaacagtcgagtgtccgtttttacgccgaagacaattttgtcattgtctttaatggcggctagcgtatcttttttgctctcctttgaggcttctccgtttgatcccttgctgccgcaagcggcaagcaagatgacagcgaataaagaaatcaatgctaaagaaaaaatctttttcatacaagctcccccatttctgttttaatgatttaaaatacggcttaagaataagcgggcccgttcttccttcgggttcgcgtaaaattcagccggcactgcttcttctaaaatttttccttcgtcaatgaagacaatccggtcggcaacttctttggcaaaccccatttcgtgtgtcacgacaaccattgtcatgccttctttggcgagtgttttcatgacatctagcacctcaccgatcatttcaggatcaagtgctgatgtcggctcgtcaaacagcatgacctccggcttcatcgccagtcctcttgcgatggcaacacgctgctgctgcccgccggaaagctgggaaggataggcgtcagccttgtctgggatgccgactttttcaagatagtaccgcgccgtttcctttgcttgttcaggtgattgtctaagcacttttaccggagccagcatgatgttctgcagcactgttttatgcggatataaatgaaagtgctgaaacaccatcccgatattttgccgcacttgattgatatcagtttttctgtcgttaatggcggtgccgtttactgtaagcactccctcattgatcgactcaagtctgttgatgcatctgagcaatgtgcttttaccggaaccggatgggccgatgataacaacgacttcacctttttcgatttgaagattaatttgttttaacacgtgaaaatctccgtaatgcttgtttacattttgaaatgtgatcatcgcaatcctcctatcagaaaatttgaccaaaaagtaaatgatcaaacttttctgaaaattaaaagtgaaaaaatgtccatgacttctgactgactaaagaaacataaagaataattccttgtaaacctcaaaagatataggtgaggtgaaagcagatgctccaaaaaccggtgcagcttttgttgtgggtggctatttgtttgctggttctgttaacagtctatgtcttttttatgcttgatatgttatggtcacccttttggctcgtcataaaaacgatctttattcccttgatcatttctatttttatatcttatttattgcttccggtcacagaatggctgcatggcaaaggattgcctaggactttgagcatcttggtcatttatgttcttttttttggcgggattggctgggcgttgtataaaggggtgcctgttttaatcgtgcagctgacggatttgtcagaaaatatacccatgtttgccgaaacgtataacgggcttcttcttcatgtgcataaccatacggatgactggcctgatggtatgcatcaccgtatagataaaatgatccgccagacggaggcgttttttgcgggaacgatcgagggtgcgatcagcgggatccgcaatgtgcttgattacttcttaattgctgcaacaatcccttttctcgtgttttatatggtgaaggacattgagttaatgaaaaagacagtatggtacttgactccgaagtcgtggagaaagcggggcagcgcctttttgcgggatgtggatgattcgcttggcgattatatccgcggccagcttttggtctgcttgattcttggcgtgattgcaggcatttcgttctgggtatttgggcttccgtatccgctgatacttggccttatctctggggtaacgaatgtcatcccgtattttggccctttcatcggagctgttcctgcgttgttaattgcgatgacgatctcagtcaaggcggttcttgttgtggtgattacggtgtttattctgcagtttatggaaggaaatatcctcagtccgttcattgtcggcagaagccttaaaatgcatccggtcgttatcatgcttgcactccttgccggaggggagcttgcgggtatcgtcgggatgattctggctgttcctgcgacggctgttttaaaagtaatgatgatccattttttgcggatgaggacggagcattgacatcggcgtgccgcttgtctataatttctcgtagaatacatacgaatctcgagtgacggatctgagtacgccgaagccctgttaaagagagaagctccataagctgaaaggagctttatcagaagatcggaggaagctaatcctgagtgcagttaatcactgccgcttatcctgcgttacagggttaaaggtgacgggcgcatgaatgcccgtaatcagggtggtaccgcgagacagctctcgtccctgtgtaaacgttggtttgcatagggggagggcttttttgctgtcactgaagagaatttcgatttttatagaggaggaaatacaatgaaacacttaacttctgcggaagtgcgtcaaatgtttttggatttctttaaagaaaaaggacatgcggtagagccaagcgcgtcattagtgcctcatgaggatccttcactgctttggatcaacagcggtgttgcgacgctgaaaaaatattttgacggccgtgtcgtgccggaaaatccaagaatcgtaaacgctcaaaaagcgatcagaacaaacgatatagaaaatgtaggtaaaactgcgcgccatcacactttctttgaaatgctcggaaacttttccatcggcgattatttcaaagaagaagccattacatgggcttgggagtttttaacgagcgacaagtggattggcttcgacaaagagcttctctctgttacggttcatcctgaagatgaagaggcatatgagttttgggcgaaaaaaatcggtattcctgaagaaagaattatccgtctggaagggaacttctgggatatcggtgaagggccgagcggaccgaatacggaaatcttttacgaccgcggtgaagcatacggtaatgatccagaagatccggagctttacccaggcggggaaaacgaccgttacctggaagtatggaaccttgtgttctcagagttcaaccataaccctgacggcacgtacacaccgcttccaaagaaaaatattgatacaggcatgggtcttgaaagaatggtgtctgtcatccagaatgttccgacaaactttgacaccgatttgtttgttccgatcattaaagcaacagaatcgatttctggtgaaacatatggcaaagacaatgtgaaagacactgcgtttaaagtgattgctgaccatatcagaacggttgcctttgctgtcagtgacggtgcgctgccgtcaaatgaaggccgcggctatgtattaagacgcttattacgccgtgccgtgcgttatgccaaaacgatcaacatccatcgtccgttcatgtttgatttagtgccggttgtcgcagaaatcatggctgatttctatcctgaagtgaaagagaaagcggatttcatcgcaaaagtcattaaaaccgaggaagaacgcttccatgagacccttaatgaagggcttgcgatcctgtcagaaatgatcaaaaaagaaaaagacaagggcagcagcgttatctcaggtgctgatgtgtttaaactgtatgatacgtatggattcccggttgaattgactgaagaatacgcagaagacgagaacatgacggttgaccatgagggctttgaggaggaaatgaaccagcagcgtgaacgggcaagaaacgcccgccaggatgtcggcagcatgcaggtgcagggcggcgcactgcgcgacgtgacagttgaaagcacatttgtcggctactctcaaaccaaagctgatgccaatatcattgtgcttcttcaggacggccaattaatcgaagaggctcatgaaggagaaagcgttcaaatcattcttgatgaaacaccgttctatgcagaaagcggcggccaaatcggcgacaaaggctatctccgaagcgagcaggcagttgtaagaattaaagatgttcaaaaagcgccgaacggccagcatgtgcatgaaggtgttgtggagagcggtactgttcaaaaaggcctgcatgttacggctgaagttgaagaccatatgagaagcggcgtcattaaaaaccacacggcaacgcatttattgcatcaggctctaaaagatgttcttggaactcatgtcaatcaggcgggctctcttgtaacggaaaaccgccttcgttttgacttctcgcactttggccaagtgacaaaagaagagctcgaacaaattgaaagaatcgtaaacgaaaagatctgggcgagcatcccggtcagcattgatttgaaaccgatcgctgaagcaaaagaaatgggtgcgatggcactgttcggcgaaaaatatggcgatattgtccgtgtcgttcaagttggagattacagcttagagctgtgcggcggctgccacgtcagaaatacagcagaaatcggcttgtttaaaatcgtttctgaatccggaatcggagcaggcacaagacggattgaagctgtaacgggacaaggcgcttacgtcgaaatgaacagccagatttctgtattgaagcagaccgctgacgagctgaaaacaaatatcaaagaagtgccgaaacgggtcgcggctctgcaggctgaactgaaggatgcacaaagagaaaatgaatctcttcttgcaaaactaggcaacgtggaagcaggagcaatcctgtcgaaagtaaaagaagttgacggcgtaaacgtgcttgcggcaaaagtaaatgcaaaagacatgaatcatctccgcactatggtcgatgaactcaaagcaaagcttggctctgcggtgatcgtgcttggtgcggtacaaaacgataaagttaatatctctgccggagtcacaaaggacctcattgagaaaggacttcacgccggcaagctggttaaacaagctgcggaagtttgcggcggaggcggcggaggccgtccggacatggcgcaggcaggcggtaaacagccggaaaaattagaagaagctttggcttctgtagaagattgggtgaaatccgttttataattcgcccatgtagtgtagaatgatggtaagattaggaccccaggctgaactttgcctgcgaatttgggaaagaggtgcaaaacggtgagctcgtttgataaaacgatgaaatttaatttctccgatgattctgctgagactaacgtaaatgaggtgctgattacagtgtatgacgcgcttcaggaaaagggctacaatccaatcaaccagattgtcggatacttgctgtcaggtgatcccgcttatattcctaggcatcgtgacgctcgcaatttaattcgcaaacttgaaagagacgaattaatcgaggaattggtaaagtcttatttagaacagcataaagaggcgtaaataaagaatgagaatattaggactcgatttaggaaccaaaacactcggtgtagctctgagcgatgaaatgggctggactgctcaaggcattgagaccataaagataaatgaagcagaaggcgattatggtttatcccgtttatctgaactgataaaggactatactatagataaaatcgtgctcggctttcctaagaacatgaacggaacagtcggcccgagaggcgaagccagccaaacatttgcgaaagtgcttgaaacaacgtacaatgttcctgttgtgctgtgggacgagcgtcttaccacaatggcggctgaaaaaatgctgattgcagctgacgtcagcaggcaaaaacgaaaaaaagtcattgataaaatggcggctgttatgattttacaaggatatcttgacagcttaaattaaagccagaggtgaagaaaatggaacacggcgaaaaaaatattacaattgttgacgatcaaggaaatgaacagctttgtgaagtgctgtttacatttgaaaatgaagagtttggcaaatcttatgtcttgtactatccaatcgaatcaaaagatgacgaagaagtagaaattcttgcttccagcttcacgccaaacgaagacggtgaaaacggtgagctattcccgattgaaactgacgaagaatgggatatgatcgaagaaacactaaacacattcttagcggacgaagacgaagagtaaaacatcgcgccaaaccaaagccggagctatactgctccggcttttttctgctttatgcaggcctctttttgtaataaattgccgaaatacaatgaatcatgtagtataagagctgatgggaggagacctaatgtatatcaatcagcaaaaaaaatcgttttttaataaaaaaagaatcatactgtcttccattgttgtgctgtttctcatcattggcggggcatttttatatgggaaatcattgcttgaacctgttgaaaaagacagtaaaacgacagttaatattaacattccgagcggttcgtctgtttcagccatcgcatcgatattaaagaaaaatgatgtcataaaaagcgagaaggcgtttcagtactatgtgaaatataaaggtgcttccgggtttcaggccggattctaccatctgaataaaggtatggatttagatgccattattcagaagctgacaagcggggctacaggttacgcttttcaaatcacagtgactgagggagcacagctgacccaaatcgcggctgctattgctgatgaaacaaaatactctaaaaaacaagtcatagcgaagctggacgatgaaacatttatcaatcagctgaagaaagaattcccggacactgtgacaaatgatgttttcaataaaaacattaagcacccgcttgaagggtacctattcccggctacatacccttttaacgatccggacacatcacttgaagacattatcaaggcaatgattaagcagacaaattcttatgtggaaacatataaatcagaaatgaagaaaaacaaagtttctgtgcataagctgctgacaatggcttctttgatagaagaagaagcgactgaaaaagccgaccgccataaaattgcgagcgtcttttataaccgcctgaaaaagaaaatgccgctccaaacagatccgaccgtcctgtacgcggcaggcaagcataaagatcgggttctttataaggatctggaaatcgattcaccatacaatacgtataaaaacacagggctgacgccagggccgattgccaatgccggcatgtcatcatgggaagcagcgctgcatccggataaaacggactatctgtatttcttggccaaatcaaatggtgaggtcgtatttacaaaaacgctaaaagagcataataaagcaaaagaaaaatacatttcctcaaaaaatgagaaataaaaggagagcaaaaagctctccttttgttcgctttccgcaaggttttatgataaaatatatcgggttgtttaccgatgtatcatgatgtattcagagagtgtcctgcgcataagactggggcactcctttttagaacgggaggctgtttgtagtgactgaccggtatgaacaaataaatgactatatagaagcattattaaagcctcggccggataacgtgaagagacttgaagcatatgcagaagaacatcatgtcccgattatggaaaaagcgggcatggaggtgctgcttcaaattttgtctgtgaaacagccgaaaaaaatactagaaatcggaacggccattggttattcagccattcgaatggctctggaactgccgtctgctgaaatatatacaattgaacgcaatgagaaacggcatgaagaagcggtaaacaatatcaaggaatttcagcttgatgaccggattcatgttttttacggagatgcgcttgaattagccgacgccgttcatgtaaccgcgccttacgatgtcatttttattgacgctgcaaaaggtcagtatcaaaacttttttcatttatatgaaccgatgctttcaccggacggggtgattataacagacaacgtgctgtttaaaggtctggtggcagaggattacagcaaaatagaaccgaagagaaggcgcaggcttgtagccaaaattgatgaatataatcattggctgatgaatcatccggattatcaaactgcgattattcctgtcggggacggacttgcgattagtaaaaagaagaggtgaacgtcatgaaaaaaccagagctcttagtgacgccgacgagtacagcggacattttgccgctcatacaggctggggcaactgcgtttttagttggggaacagagatacggcttgagattagccggagaattttctcgtgaagatgtaacaaaagccgtagagattgctcacaaagaaggggcaaaagtatacgttgctgtaaatgcaattttccataatgataaagtgggtgagcttggcgaatatctggctttcttagcagaagccggtgtcgatgcagcggtattcggcgatcctgccgtgctgatggctgcccgtgaatctgcgcctgatctgaagcttcattggagcacagaaacgacaggcaccaactattatacatgcaactactggggacgcaagggtgcggcgcgttctgtgcttgccagagaattaaacatggacagcattgttgagattaaagaaaatgctgaagtcgaaattgaaatccaggtgcatggaatgacgtgcatgttccaatcgaagcgttctttgattggaaactattttgaatatcagggcaaagtcatggacattgaaagaaagaaaaaagaatcaggcatgtttttacacgataaagaacgcgataataaatatccgattttcgaagatgaaaacggcactcacatcatgagcccgaacgatgtgtgcatcattgatgagctcgaggaattgatagatgccggaattgattctttcaaaatcgatggtgttttgaaaatgcctgaatacctaatagaagtcaccaaaatgtacagagaagcaattgatttgtgcgtggaaaaccgtgacgaatacgaagcgaaaaaagaagactggatcgaacgcattgaaagcatccagccagtaaacagaaaaattgataccggattcttcttcaaggaaacggtttattaatcaaaaggaggttaagctatgactgccgtaaatgataaaatatccacaatcgttaatggaaagcgtgtgattacgaaaaagccggagcttctcgcacctgcgggtaatcttgaaaagctgaaaatcgctgttcattacggagcggacgcggtctttatcgggggacaggaatacgggcttcgctcgaatgccgataactttacgatcgaagaaattgcagaaggcgttgaattcgcaaagaaatatggcgcgaagatctacgtaacaacgaatattttcgctcataatgaaaacatggacgggcttgaagactatttaaaagcgcttggagacgccaacgttgccggtattattgtggcagatccgcttattattgaaacatgccgcagagtggcgccgaatgttgaggttcacttgagcacacagcagtctctttcaaactggaaggctgtccagttctggaaggaagaaggtctcgaccgcgtcgtgctggcacgtgaaactagcgctcttgaaatcagagaaatgaaagaaaaggtagatatcgaaatcgaatccttcattcatggcgcaatgtgtattgcatattccggccgctgcgtgctgagcaatcacatgacagcgcgggattccaaccgcggaggctgctgccagtcatgccgctgggattatgatctctaccaaacagacggtgccaacgccgttgctttgtatggtgaagaagatgcaccatttgcgatgagcccgaaagatttgaagctgattgaatccattccaaaaatgattgaaatggggatcgacagcttaaagattgaaggccgcatgaaatccattcactatgtagcaactgttgtcagcgtataccgcaaagtaatcgatgcttattgcgctgatccagaaaactttgtgattcaaaaagaatggcttgaagagcttgataagtgcgccaacagggacactgcgacagctttctttgaaggaacgccaggctatgaagagcaaatgttcggcgaacacgccaagaaaacgacatatgattttgtcggcttagtgctgaattatgatgaagatacacaaatggtcacgcttcagcagcgcaatttcttcaaaaaaggcgacgaagtggaatttttcggtccagaaatcgaaaactttacacatacgattgaaaccatttgggacgaagacggaaatgagctagatgctgcccgccatcccctgcaaattgtcaaattcaaactagacaaaaagatttatccgagcaacatgatgagaaaggggaagtaacagcccatgggtaagaatccagtagtcattggaatcgcaggaggttccggttcaggaaaaacgagtgtcacacggtccatttatgaacagtttaaaggacactcaattttaatgatccagcaggacctttattataaagaccaaagccatcttccgtttgaagaaaggctgaacacaaactatgatcatccgcttgcgtttgataatgactatttaatcgagcatattcaagatctattgaattaccgcccgattgaaaagccgatttatgactataagcttcacacacgttcagaagaaacggttcacgtagagccaaaggatgttattatccttgaaggcattcttgttcttgaagacaaaaggcttcgtgatctgatggatatcaagctttatgttgatacggacgctgacttgcgtatcatcagacggattatgagagatattaatgagcgcggacgctctattgattctgtcattgaacaatatgtgtcagtggtccgtccgatgcataaccaattcgtcgagccgacgaaacgatacgctgatattattatcccggaaggcggtcagaatcacgtcgcaattgatctgatggtcacaaaaattcaaaccattcttgaacaaaacgcgattttgtaataccatagcatagacataaataactctgaccatattatgtataggcaggaagggaatgtgcgaattcccttctttccctgtttataaacgcgaaatatttgcagaacgacacgattcagtttaagataaacagtacctatatgggagagaagaacgaggactgccctgtgttctcattcttgtattttttagtttatgctctcatacataatcgaagatgttgagggacaaccagaaggagtgaagggacatggcacaagagaaagtttttcctatgactgcagaaggaaaacaaaaacttgaacaagaattagaatatttgaaaacggttaaacgaaaagaagtagtagagcgaatcaaaattgcgagaagcttcggagacctttccgagaactctgaatacgattcagcgaaagaagagcaggcatttgtagagggccgcgtgacgactcttgaaaatatgattcgcaatgcgaaaatcattgaagatgacggcggctctaacgttgtcggtttgggtaaaaccgtcactttcgtcgaactgcctgacggtgatgaagaatcatatacgatcgtcggaagcgcggaagctgacccgtttgaagggaaaatctcaaacgattcaccgatcgcaaaaagcctcttgggcaaaaaagtagatgaagaagtcacagtacaaacaccgggcggagaaatgctcgtgaaaattgtgaaaatttcataatatctgtttagcagcgaaacacctcgtccacaatgtgggtgaggtgtttttttatgaagatatcgaaacgaatgaagctggcagtcatcgcttttttgattgtattttttctgcttctgctgagacttgcagaaatccagctgtttttcacagaatcattttctaaaaagaaattaatttgattcaagaaagtgtgaaacagcggacggaggaagtgctcatttcagatggaagaggctcttttttagatcgaaacgggcgggcgctgacaggacaaagcgagcctgcggttgttttgttcccttttctgctgacgcaggattggccgatcaaaaaagttgcggacatcctcggcatgtctgaagatgatttgcgccagacactaggtcaggcaaaaaaaccggtcattttgcagcaaaagaaaatcaaaacactttcaaaacaatctatcacaaaaatcaattctttgaaatatcccggcatttacggcgtatatatggagaatgaagacaagcccagccttgcttcacatacgatagggagcacgaaccaagatccggcgctgcttcgcaagaaatatcctgacaaggagagccttccgattacaacagaaatcggaacaaccggtttagaacggacatttgacgagtttttgcttccggaacaagacacaaagcttttatatcatgtggacggaaaaggaaaccctttgtttggcatggacgtcaaatatacagctgaagccaatacattttatccgctccagatcaaaacaacgatcgatcaaagcattcaaaaagcgatggaggaggtattggatgaacaggggctgaaaaagggaggagctgtgctgctggacatcgaaaatagcagtgttctgggaattgtaagcaaaccagatgcagacgtgtcccggcaaaacacacttcaaaattatatgctgacgccaatctatcccggatcagtttttaaaacagtcattgccgcagctgcaatcgaaaataatatggtgaagcctagtcaaacctttaattgcaatttaaacctgtacggggaaccgggggacgacaaaggcaccttgtcttttgatgaaagttttgcccaaagctgtaattacacatttacgagtcttgcagaacaattaatgaaaaaagacagctcggttattgaagatatgtccgagaagctggctctcactgatcgggcaggctgggagggaaaactgtaccacgaaaccgatttccgccagctgtataacgaaaaaagcggcgtgatttggggggatgaaaaagacaaatcagtcaaaaaagccattgcgcaaacagcaatcgggcagaaaaatgtaaaggtaacgccgctggaggtagccaatatgatggcgacaatcgcccgcggcggagaaaaacggcaggtgaaaattgccgaacaaattgagtataagaacggcacaacgctcgttacgtttaaagatcagaagctcaaaggggaaacgatagacaaatatacgtcacagcagcttcaaaaaatactgcggcgggtagtagaatctccttccggaacgggcagaaggtttcaagatcttccgtatactgtagcagggaagtcgggcacagcccagacaggcaagctttcaaaagagaaggaaacgctctacgaaaaatggtttgccggatattttcccgcggataagccgaaatacgctctagttgttttacacatggatacaccgggagataaggctctgacaaattcggtgttttatgatattgttaaaaaagtacacgaaattgaaatcaatcagaaatagaacaacttctcagcacatgttaaaatatatgctgagccaagagggataaaggagtgcagaattattgagcaataatcaatctcgttatgaaaatcgtgataaacgcagaaaagccaatttagtgcttaacattttaatcgcaatcgtatccatactaattgtcgtagtagcagcgaatctcttcattaacagtccttctagcaaagatgtcagcaaggattctgaaacggcgcaaaaacaggaatctccggcttcaggaaagacggaaaagaaatcggatgaggatataaaagacagcaagaaagatacatctgacagcgaaaaggattctgagaagtcttctgactctgattccaaaaaagatgattcttcttctaaaaaagatgactctgattcagattcaagctcagattcagccggtgacgggcttaaagatgcaaaagtaacagaaggcggctcatcgagcgatgtggaaaaaacgtatgaaaatcctgactggaaagcagtcggaactgagcagactggcgagcatgccgctacttatgattcaagctcacaagactgggctgagatgctgaaagccatttcgtacgcaactggtgtctcaacagataacatgacggtgctctggcttggaaataacggcagccctcaggatgccaaaggcaagattttggacaaggcgactgggaataaatatcaagtcacgattacatgggtcgatgaaaaaggctggaagccgacaaaagtagaaaagctaaaataaacaaaagcagccgggttaaaaccggctgcttttgttttaggcttcagctgagaaatgaaccaccgcgctgtacaatattcttccttctgccacagcagtttggtgtgaaacagatttcacccggagcatgatggctttattgttttcaatttgtgtattgattttcttttcaagctcctgcaatgaagccgcttcaaaaaattccactttgtctttaatcagatctaattgaaaattcatgtcttgaccctccagctttcacaagtcatatgaagtataagcttttttgcggtcaatgcgcaatatgagatggcataaaatacacaaagtgttttagtacctgcttttcagaagatgtggtattataggaactgttccatcattaatccatagtatacttataggaattattaaatatggagtgtgacaaatatgggccgtgaatttatccctctctttgaagattgggcagcaacttatgatcaaacagtacaaggtttagatattcagtataaagaagcgttcagaggctacgatcatatccttgatgccatcgtcagaaaatctggaacgcatgtgttagaatttggcccggggaccgggaatttgacagctaagctgctcgatgcaggcaaaactgtatttggaatcgaaccttctccagcaatgcgtaaactggcttctgacaagctctcaggcaggacggaaatcgttgatggagacttcctgacattccctgagccgccatttcaggctgatacgattgtcagttcatatgcttttcatcatttgactgacgaagaaaagcgggctgccataaagcaatatggcaaataccttcacttgcatgataaaatagtgtttgccgataccgtctttgaaaatgcgcaagcgtatcaacaggctatcgataaagcccgttctcaaggcttttatcagcttgcaaatgatttagagacagagcattatcctacattggatgcgttgaaagaaatgtttacagctgaaggttttgcagtccgattcactcagcaaaacgacttcgtgtggataatggaggcgatcaaacggtaaagtgaagggaatgtgaatagatgagactagcagtcatcggagcaatggaagaggaagttaccatcttaagaaacaaacttgaaaatgcaaaaacagaaacgatcgcacactgtgaatttacaacaggcgaatatgaaggaactgaagtgattcttttaaaatcaggaattggaaaagtaaatgctgctatcagcacgacgcttctgcttgaccgttacaagcctgattatgtcattaacacaggctcagccggcggatttcatcatacattgaatgtaggggatgtcgtcatttccactgacgttcgccaccatgatgtagacgtaacggcttttgactatgaatacggccaagtgccgggtcttccggctgcttatgcggcggatgaaaagctgatcagcatcactgaagaagcggtatctgaactcgacggcattcaggttgcaaaaggaacgattgcaacaggcgattctttcatgaacgatccgaagcgggttgaagaggtgcgtgcgagattttctgatctgtacgcggttgaaatggaggctgcggcagtggctcaagtatgccatcaatttaaaacgccgtttgtcgtcatcagagcgttatcagatatcgcaggcaaagaatcacatgtttcatttgaccaatttttagagcaggcggctgttcattcaacagagcttgtgttaaaggtgatcaaacgaattcattaaaacggggagaacgttctcctccgtttttctctaaaaacaacctctattaaggaggaggacatatatgacagtgattacggacattaccgagctgattgggaatacaccgcttctccgcttgaagaactttgatgttccagaaggagtcgcggtgtatgccaagcttgaaatgatgaatccagggggaagcatcaaagacagactgggagatatgctgattcgtgacgcgctcgattcaggcaaagtgaaacccggcggagtgattatagaagctacggcaggcaatacagggatcggccttgcgttaagtgccagaaaatatgggctgaaagcgattttctgtgtccctgaacatttcagcagagagaaacagcaaattatgcaagcgcttggcgcatcaatcattcatacaccgcgtcaagacggaatgcagggagccattcaaaaagccattcagctggagactgaaattgaaaattcttattgcgttttgcaatttaaaaaccgagtaaatccatcgacttactataagacgcttggacctgaaatgtgggaagcgcttgacgggaatattcatacatttgtcgcaggggcaggatcaggaggcacattcgcagggacagcttccttcttaaaagaaaaaaatccagcagtcaaaacggtgattgttgaaccggtgggctcgattttaaacggaggagagccccacgctcataaaacagagggcatcggcatggagtttatccccgattatatggataagagccattttgacgagatctacaccgtaacagatgagaatgcgtttagacttgtgaaagaagcggcagaaaaagaaggcctgctgatcggaagctcttcaggtgcagcgctttatgcggcattggaggaagcgaaaaaagcatccgctggaactaacattgtcacagtatttcctgacagcagcgatcgatatatcagcaaacaaatatacgaaggaggcatctgatatgaagaaaaaaacattgatgatacatggcggaatcacaggtgatgagaaaacaggcgcagtttccgtgccgatttatcaagtaagcacgtacaagcagccgaaagcagggcagcatacaggctacgagtattcaagaacggccaatccgactcgaaccgctctcgaagcacttgtgacagaactggaaagcggggaagcaggctatgcgttcagctcaggaatggctgccattacagcggttatgatgctgtttaacagcggagatcatgtcgtgttgactgatgatgtgtacggcggaacatatcgcgtgatgacaaaggtgcttaaccgtcttggcattgaatcaacatttgttgatacgagcagcagggaagaagttgaaaaagcgattcgccctaatacaaaagcaatttatattgaaacaccgacaaacccgttgctcaaaatcaccgacctgacgctcatggctgatatcgcaaaaaaagcgggtgttctgcttatcgtagacaatacctttaatactccttattttcaacagccgcttactttaggcgctgatatcgtactgcacagtgcgacaaaatatcttggcggacacagtgatgtcgtcggaggtttagttgtgacagcttcgaaagagcttggagaagagctgcattttgtgcaaaactccacaggcggcgtgctcggccctcaagattcctggctgttaatgagaggaatcaaaacgttgggactcagaatggaagcgatcgatcaaaatgcgcggaaaatcgcaagctttcttgagaatcaccctgctgtccaaacgttatattaccctggttcttcaaatcatcccggacatgagcttgcaaaaacgcaaggagcgggcttcggcggcatgatctcctttgatattggcagtgaagaacgggttgatgcgtttttaggaaatctgaaactgtttaccattgctgaaagcctgggggcggttgaaagcttaatttctgttcctgcaagaatgacacatgcctctattccgagagaacgccggcttgagctcggcattacggacggcttgatcagaatttctgtaggaattgaagatgcggaagacttgttggaagatatcggccaagcgcttgaaaatatataacaaatggatagaattactttctctgtaagccgccggattatattataatagtcgtatactatgaatctggcaggtgattcttttgaacaaaaatagaatgaaatctttaaaagaagactacaagcattttgcttttacattgcttgcagtcagcacttttttatatataggcgcagttctccctgatcaaggcttaacattaggccagaaatcgacgatgtttttagcggattgcgtatttttagccggtgccttcttttgcgctgaccgttcacttatttacaagaagcgtctggaagaagccgacgaataaaaaaacagccatcatcagagatggctgtttttctgttattgttctcgaagttcttttcccatgccttttaaaaactgaaggccgaacccgacggctctgttgatgtcaggatcgttcattgcttttaacaggtcgagaatcccgactttcttgtcttcttttaaaaagctttgtgcctgttcagtcccagccattacgctttctaaaagctttgctgtaaactcaggatcggcttttgtcaatgcgcctccggcggccatcatcgtgttgatgaggttggtgacaggctcgcgggaaacttggccaagcgcaatcttggcaatgtcttccttcgctctgagcatgcttgttgccgcatcaaaaattccaagatcattgagttcattcattaacgtcatcgttttagagacggcgtcctcattttccgccagcagctctttcagttcttctattttttcaagcttaatttgctcagctgtttttgtttcttttttgatcgtcgtaatcggagtggccattcgttttcctcctatcgtttaatcagtcagatgtacatagccagggcggttccattttctttctgcttcgactccgttttgcggatgccgttttttgttgcgcggatttgtttttggaagcggcgctgtttcacagccgccaagcacttccatgcggacctttgtctgtttataagcaggcgtgttcgtccgtttatcagctgcagggcccgtcaagaagttaatcgctgactccttgtctgtcgagttcattggcaaatagagttcatttttccgtacccggtctgtgatcagcgcgttcaatttgactgctccgaacggagaaacgagccgtacaagcgaaccgtcacaaacacctcgctcttgtgcaagctcaggtgagatctcaacgaatacattcggcactttcgcttggatgcctttcgatttatttgtcatgtttccttcgtggaaatgctccagcatccggccgttattgatatgaaggtcatattcctccggaaatgccgctggctcggtccaatcagaaagggcaaagcgggcttttttgtcagggaaattaaatccgtcttcatacagaagcggtgtgctttcacctgtgaagctgccccataggaagctgttccagccttcaagcacctcatagcttgctttggcaaacagaggagaaagactcgccatttcagagaaaatgtcacttggatggctgtaattccaattcgctcctaaacggtttgccacctcttgaataatccaccagtccggttttgcgtcaccaagcgtcggaagcgcctgatacaatcgctggacacggcgttctgtgttggtaaatgttccgtctttttcaagtgaaggagtggccggcaagacgacatcagcatattgagctgttcttgacaggaagatgtcctgtaccacgaagaaatcaaggcttgataaaatatcatgcacatggttcgcgtttgaatcgaccagtgccatatcctcaccgacaagatacatagctttcatttttccttcttcaatggcatgaagcatttgaatattatctaaaccaggctttccatcaatctcgacaccatatgcctcttcaaatttagcgcgtgctttgtcatctgtaatatgctgatatcccggcagccagccaggcaatgttcccatatcacatgcgccttgcacgttattgtgtccgcgcagaggataagcgccggcacctggacggcgatagttgcccgtagcgagaagcaggtttgaaatggctgctgatgtatcagaaccgcctgtattttgtgtgacacccattccccaaaggacacaagtgccgtcagcatcacgaatcatttcagcaatttgaatgatgttttcttttgaaaggcctgtgatgcgttctgcataatcaagcgtatacgttttaagggtttctttataatcttcaaagtaattgacgttctcatcaataaacgcctgatcgtgccagccttggtcgatcatatatttcgtaacagccatcagccaaacttggtctgtgccttgtttagggctgatgaacagatcagatcgctcagccatctcatttttacgcaggtcagcaacaatcagtttttgaccgtggagcttgtgtgcccgtttgacgcgtgttgcgagcactgggtgtccttccgccggattggcaccgacaatgatgaccaggcctgctttggcaatatctttaatcgtgccggcgtcaccgcccatgccgacagtgcggaacaatccgtctgtagcaggagactggcagtagcgtgagcagttatcgacgttgtttgtttcaaatacctgacgcgctagtttttgaatgacgtagttttcttcattcgtaattttagaagaagaaataaaccctacagagcctttaccgtactgctctttaattgatcctaatctgcttgcgacaagatcgagggcttcttcccaagaagattccacaaaggctccgtttttacggattaaaggctttgtgatccgctcttttgaattgacaaaatcccagccgaatttccctttgacacatgtggaaattgcgttaaccggagcatcagaaacaggctggatctttaaaatatcccgtccttttgtccatacttcaaatgaacatccgacaccgcagaacgtacatacagttttcgttttttcgttctcgtttcacgcattgccgcttcgacttcagaaatggcaaaaatgctgccataccccggttcaacatttttcacgagatcaatcatcggttccatgacgtcctctttaatgcctgtcataaaaccagcctgcccgagcattgatttttccatcagtgcattacatggacatactgttacacactgaccgcagctgacacaggaagattcattgatcggaactccctcatcccaaatgacgcgagggcgttcgcgttcccagtcgattgagagtgtttcatttacctgaaggttttgacagacctcaacacactggccgcaggcaatacattggtttggatcatagcggtaaaaaggatgagacatatcaaccgcgcaagaaggatcttcttttggcgtgtatgggtatttttgatgctcgatccccatcatttccgctgtattatgcagcgtacagtttccattgttgttatcgcaaactgtacaatacagcaaatgattttcaagaaggcggtccatcgcttcggtttgcgcttctttcactcgatttcctgaaagatcaatagacatcccgttttctgcaaccgtcgcgcatgaacgaaccagcttgccgtttgcctctactatgcaagtatcacaagtttgaatcgggtcaacctctggtacgtggcaaatctgcgggtactcaattccgttttcatttaaaatatctaaaattgtggcccctgctcgtgcttgaatttctgttccgtctacacggacactgatcgacttaacgtccatcatattcatattcccctccatctttctttcaagaagtcaaaaaaagccatgtatagatacacctgcccttaattctaagaaggtgtaaacacacatggcggaatagttcactagcaagtcttactaacagaccaatccttgatttttataaaacgatagactcataacaagatcctattacaaatccatcaacactgcttttattataatgtgatatttattataatacaatatggcaggaaaattttaaccaagtgaaatgtcctgaggggaaccgggaaaagcctttataaggcaatatcggaaggggtaatcagcatgtctaaaaaaattcatgaattcaatgatattattcgaaaacttcgcaaagaattgttcggaaaagggcctgagagaattcatactgtatttgtagaaaacatggcagtttcaacactatacggaaatctgagtgcaagcgagcagtttattgcccgcacgcctgaaggaagagagatggtacatgcggcccggacaagcctaattcaagacctttattccaaacaaacaccggaaggaatggaggaacttatgggagctaagctagtccatttgttttctgatattaaaattgaggaaaacatcgctgtatctgtatttgtttttgaccgaaaaatagatgagcaaaaagaagctctgcaaagctagtatatttgtcattgacacaaatttgtcacatttgatatgatgttgctacagttatagaaggctaaagcaatggaatgtatgcacgaactgtatatattctctttcaatatcttatatactgcttgatattgttgtatgggtatgcatacaagttaggcagcattcaaacgcctggtttgacacaggttatttgagtgctgccttttttattgcctttcttgcataactgtgagaaaagaagaagtaatggaggcgttttattatggcttttcgaaaaccggatgaaatagcggaagcagcaattgaagcagggatgaaaaaaataaagctcccgctgccgtcactgcttgtgctggggtttttaggcggtgcatttatcgcgcttgggtatttgcttgatatcagggtaattggcgatcttccgaaagaatgggggagcctgtccagtttgattggtgcagcagtatttccagtcggcctgatccttgtcgttctcgctggcgctgaactgatcacaggcaatatgatgtcagttgcgatggcgttattttcgagaaaaatatcagtaaaagagttagcgattaactggggaatcgtcacaattatgaacttaatcggcgcattgtttgttgcttactttttcgggcatttggttggattgactgaaacaggtccttatttagaaaaaacgattgccgttgcccaaggaaagcttgatatgagctttggcaaggttctcatttccgccatcggctgtaactggcttgtatgtcttgcagtgtggctttctttcggcgcccaagacgcagcaggaaaaatccttggcatctggttcccaatcatggcttttgtggctatcggatttcagcacgttgtcgccaacatgtttgtgattcctgctgccatttttgcaggctcattcacgtgggggcagttcatcggaaacatcattccggcttttatcggtaatgtcatcggcggagctgtatttgtcggtctcatttattttattgcatatcataagaaagaccgctccagaaaagaaatgaagcaggtgtcatgaccaacgggcaaatccattcgatgatttgcacaatttccgtccatttttagaaaaagatgtttacaaaatggaatttggtggatatacttacaaagtaagaaaaaagcaaaggaggctgaaccaaaatgacaatgagacaacgacgtcaacctgtacgtgatacacatgtaaaagttcatggtttattcagcctgtggaagagttcgtgtccttccttaaccgatgcttatcgcacgcattaaattcggaatagtcggacatacgcaactccccgcaggcagtagaggcattggtgtcttcttttgtctgcggtttttatttgcccgcggcagaagggttgtgccgcgggttatttcgcttgatgcggactttgaaagggggtgagcgatatgacgattaacctattctttttaacgttaacgattaaaaaacggtttaaaagcctggaagaattcgaacgagaacagcagattgaacaaatttatgatgaaatgaaagagtctcagttaaagcatctttatttaacaaactggcgctaaaagcaacgaaaaaaactgaagggggaatggcatatgcttagaatggaactattgatgcattatacaatggagaaggaccaagtttagcgaaatagctgtcaagaaaatgcgcgcctgcatatagtaaatcaacgttattgtgaggcaggtgatggcatgatgaacgattatcaaaaaagactgccgtcgattggccatggttatgcgtccatgccgcattccttcaaacatggttatggaaatccattccgacagcagaggctgatggcaatgcagcagcaaaggctgtatgtattcccttatcattggcattagaaagagggcagaaaacattatgttttctgctttttttcggaaaaaaatgaaaaagtttagttctattgaaacatttttcaatacattgccgtctagttggtaccttccttcacttttagaaatgaagatgatgtttatttttttaagataataaataaacataggaaaccaaaagcaggtgtttaaaatgctagaaaatagactctataaacgatcggatttttggaaattattttctcggaaatataagctaaccaaaacaattgagcatatgatgattgactctatagatatacaagaaaatgacagaattttagaaattggaattggaaacggcactgtctttaaaagcataaccaagaaactaaaaaagggtagcctaaaaagcattgatccttcaaaacgaaaggtaagacagatatcacgtgcgaatcgaaagaacatggggaacggggaggtttttcatggctatccagaggacattccctttgatgaccgtacctttaataaagtcttttctttacatacggttcaaagctgcaccgatattaggcttgcattaagagaaatttacagggtgcttcaaattgacggccggttttatatcagtattgacacaaataccggtgaaaaagagaaaacgtatattcaactgctgaaagaccagcatttcagggatctttctgttatcaggcgtgcttcctgtctatgtattgtggctgttaaataaaaaatttctcgggaaatatatccaagatcctcgtattaggatttgggtatattttcttaatttttattttttgcatatactttatattaaaaaaagtttttttcatataaacttataacagaagaaagaacaaagaggtgatatcagacagggcagacattctttgtgaacaaaaggaatgaatattcattccgtaaacgaatcggaggttgtcagattacatgatatccgcatccagcagtaaatacgacatgattatgaaagcgtcagtctcactttttacggaaaggggtttttgacgctaccactattcctatgatagctgaacgtgctcatgtagggacaggaacgatctatcgttattttgacagcaaagaaacactcgttaacgtactgtttcaagaaagcatccagcgatttacggaaaaactgaagcaagacgtttcagaattgcctgtcagagaaggctttcaccacgtattttgctgtctcgttcagtttacgaaagagagcgactatgcgctttttttcttgaaaccaaaaaagacgctcattacttaaatcatacaagcaaaaaaatgatagaaaatctgactcaaatgcttgatgactattttaataagggaaaagcggaaggcgtgattcgcagcctgccctctaatgtgttaattgcgattgtattaggggcgtttctcaagatatatcagctcgttcaaacaggtgatatagagatggacactgatttaattactgaattggaacaatgctgctgggacgccattaagcttcattcatcacaaaaataggaaagggagatgttaatgaaacaggcaagcgcaatacctcagcccaaaacatacggacctttaaaaaatcttccgcatctggaaaaagaacagctttctcaatccttatggcggatagctgatgaattgggaccgattttccgttttgattttccgggagtatccagtgtttttgtgtccggccacaatcttgtggctgaagtgtgtgatgaaaaacgctttgacaagaaccttggcaaaggcttgcaaaaggtgcgtgagttcgggggagatggcttatttacaagctggacgcacgaaccgaactggcaaaaagcccaccgcattttgctgccgagttttagtcaaaaagcgatgaaaggctatcattctatgatgctggatatcgcaacccagctgattcaaaagtggagccggttaaaccctaatgaagaaattgatgtagcggacgatatgacacgtctgacgcttgatacgattgggttatgcgggtttaactatcgattcaacagcttttaccgtgattcacagcatccgtttatcaccagtatgctccgtgccttaaaagaggcgatgaatcaatcgaaaagactgggcctgcaagataaaatgatggtgaaaacgaagctgcagttccaaaaggatatagaagtcatgaactccctggttgatagaatgatagcggagcgaaaggcgaatccggatgaaaacattaaggatctcttgtctctcatgctttatgccaaagatccagtaacgggtgaaacgctggatgacgaaaacattcgataccaaatcatcacatttttaattgctggacatgagacaacaagcgggttgctatcctttgcgatttattgtctgcttacacatccggaaaaactgaaaaaagctcaggaggaagcggatcgcgtgttaacggatgacacgcctgaatataaacaaatccagcagctcaaatacattcggatggttttaaatgaaaccctcagactgtatccaacagctccggctttttctctatatgcgaaggaggatactgttctaggcggggaatatccgatcagcaaagggcagccagtcactgttttaattccaaaactgcaccgggatcaaaacgcttggggaccggatgcggaagatttccgtccggaacggtttgaggatccttcaagtatccctcaccatgcgtataagccgtttggaaacggacagcgcgcttgtattggcatgcagtttgctcttcaagaagcgacaatggttctcggtcttgtattaaagcattttgaattgataaaccatactggctacgaactaaaaatcaaagaagcattaacgatcaagccggatgattttaaaattactgtgaaaccgcgaaaaacagcggcaatcaatgtacagagaaaagaacaggcagacatcaaagcagaaacaaagccaaaagaaaccaaacctaaacacggcacacctttacttgttctttttggttcaaatcttgggacagctgagggaatagccggtgaactggctgctcaaggccgccagatgggctttacagctgaaacggctccgcttgatgattatatcggcaagctccctgaagaaggggcagtcgtcattgtaacggcttcttataatggggcgccgcctgataatgctgccggatttgtagagtggctgaaagagcttgaggaaggccaattgaaaggtgtttcctatgcggtattcggctgcggaaaccggagctgggccagcacgtatcagcggattccccgcctgattgatgacatgatgaaagcaaagggggcatcgcgtttaacagcgattggggaaggtgacgccgccgatgattttgaaagccaccgcgagtcttgggaaaaccgcttctggaaggaaacgatggacgcatttgatattaacgaaatagcccagaaagaagacaggccttcattatcgattacttttctcagtgaagcgacggaaacgccggttgctaaagcatatggcgcgtttgaagggattgtgttagagaatcgagaactccagacagctgccagcacgcgttcaacccgccatattgaattggaaattccggctggtaaaacatataaagaaggcgatcatatcggaatcctgccaaagaacagcagggagcttgttcagcgggttctcagccgattcggtttgcagtccaatcatgtgataaaagtaagcggaagcgctcatatggctcatctgccgatggatcggccaatcaaagtagtggatttattgtcgtcctatgtagagctgcaggaaccggcatcaaggcttcagcttcgggagctggcctcttatacagtttgtccgccgcatcaaaaagagctggaacagctcgtttcagatgatggcatttacaaagagcaggtacttgcaaaacgtcttaccatgcttgattttttagaggattatcctgcttgcgaaatgccgtttgaacggtttttagcacttttgccatcactaaaaccgagatactattccatttcaagctcaccgaaagttcatgcaaatatcgtgagcatgacggtaggagttgtgaaagcctcagcatggagcggccgaggtgaataccggggtgtcgcctctaattatttagcagaattgaatacaggtgatgcagcagcttgcttcattcgtacgccgcagtccggatttcagatgccgaatgatcctgaaacgcctatgattatggtcgggccgggcacaggaattgcgccattcagaggctttattcaggcaagatcggttttgaagaaggaaggaagcacccttggtgaagcacttttatacttcggctgccgccgcccggaccatgacgacctttacagagaagagctggatcaagcggaacaggacggtttggtcacaatccgccgatgctactcgcgcgtcgaaaacgaaccaaaaggatatgtccagcacttgctcaagcaagatacgcagaaattgatgacactcattgaaaaaggggctcatatttacgtatgcggtgatggatcgcaaatggctcctgatgtagagagaactttgcgattggcatatgaagctgaaaaagcagcaagtcaggaagaatcagctgtatggctgcaaaagctgcaagatcaaagacgttatgtgaaagacgtttggacaggaatgtaaaatataaaatcccgccaatctgattggcgggattgctttgcatatgagaaaaccggcacgataatgaaatctactgaaaaggatgttatagggagtatcgcgccggccttattattcatatcggcatgcagaggcaaaagtttagttctttttaccttgtttttaaaaataaatagtctgaaagtcttgtttttgattttcgactcaggcttttggcattttgttctttcttattccttaagatcagtcatctgttgaagattgatgcttgaattgctgttccacatgcttacggtaatgaaagtcatgaatcagccgaatggtcggcctgattaacagcagcaaacttccgatcgcaaacagccatatccctgccgacattaaccggtcataaaaaagaaaaaacttccaacgagaaacatagcaccgatgataaaatcgtttactgtataaagaaccttatatcgttttttgaaaaaaagctcatatcgtttcaactctttttggatgtcatgttcttcatttcctttcattatcatccctccattcaattttggcttacccttacgtaaacggcatgtaaacataagggctgccttgctgaaagaagacataatcaacgatcagaaactaaagtaaaaaagtgatctgtataggatctcttttttacgatttcatcgcctgaacaataagagcagtcaaagtttttgcccctttaggaaccaagtgaacaccatcaggggtaaaatattccggatgctgaagagcttctgtatgccagtcaactaacgtaacattttgatgtgcgtgggcctgttgctgcaaagattcatttaccttgctttcccattggcggggaacccgtgtattgacaagataaatatgagcttttgagaaagattgaagcagttgttcgatttggctgtttgtaaaatagccattggttccaagctcaatgatgacagccttgttcggctgattaaaagacttgtattcccttgcgagttccaaagcttgagacatttgtctccctacctttccatcaatcgtcacatttgaaaatgactgacgcaggtgtgaagaaatatcaagcatgacggaatctcctatagctaaaacttctttcgcagtgtctgctggttttttcaactgttgggattgcgtgtctttctttttatgagtctcttgcccactatctttgttttccttttgaccctgattggaatctgttgtcttttgttcaggattgtgttttttatctgctgcagcgttctttttatccccagaagcctggctggtgtcagcatttgtttcttgtgagctataggtccatttggtagggtgcttttgctcgccggctagccctgacagcccgcctgcaaaaataagtatagcgaaaataatgaaaccaattgacattttgctgatgacagatgtcgttttccattccttgattctatgtataaaaacacggcgggaaaatgacctaaatccctgtgtccgtatcggcttctcaataaaatggtaggagagctcggcaagtatacatgtcacaatgacctttagcacgatatgccaaaaaacagggtttccgatttcttgaactggcgtgcttaacacaataacagggtagtgccaaagataaattccgtaagacctcgttccaagccaccgaagcggcctccatgaaagcagattgcctaaaaagctgctcggatggcaaacacatgcaataaggattgcggcagtcacgctaatgaatagcattccgcctctgtaaagaaaaggctcgtattcatctgtgaaatagacacacaacactaaaatacaaaatgccaaaaattcagtggcgtgcaaagtgtgcttcagtttgcttggcagcctgttggaagacagccttttcatcggccataccaaagccaaggcacatccgatgagaagttcaaacgaacgagtgtctgtgccatagtaaacgcggctcggatctccgccaggttcatacagtacgctcatcatcacggctgaacaaagcacaagcaatgatatcaccgcagccaatctggcgcggcttttcattatgtacattccaacaactaaaaacatcggccatatgatataaaattgttcttcaatcgccagcgaccaaaggttttttagaggtgatggggaaccgaaactatcaaaatatgatagcttgtgaaaaataaaccaccaattgctcatataaaagagagaagagatcgcatctccacgtacagtgtgcaatagttctcgatcaaacaatacgacccacacaacagtggaaaagatcataaggtacgctgccgggagaagccgccgaatgcggcgcacccaaaaatcccgaaaatcaagattgatatcatttccatatgccggtaatagaatagatgtaatcaaatatccggataaaacaaaaaagatatcaaccccgataaaaccaccgttagcccaattgaaatttaggtgataagtgataactgacaggacggcgaaagcccgaaggccatcaagtccaggaatgtatcgatgatgctgtgtcttgtgatacatgggtattcctccaatagtatgcaaatattctcgttgtttttgatagcggggttacgacctcgaatagagaagagagaaaacatccataatcttagatggatgtttttattttatcgaatataacgttctcccacgagcaagtttgaaatgacgccggttggaattgtaaactctgtaacgcccatatagccgggggcgacttcatattcgtcaaatgagatcacaagtttatggtcttcagtaatgtaaaacgtctgatcaggaagaatcgttttgaacggttctgcatcttcgtcagtgagccaatatattttatttggatcttccttcatttgctgtttcatttgttctttgatgttttgactgatgactttgatatagcgctcatctttgaataagctttttaatgtaagtaaaatatcattctttttgtcaattgtaatataacggctttgtgtgtaggaagatgcttgtgttgtttcaatattgcgccggatagagagtaaatctggcgtgtctgtgaccgtctcgtaatcactgtagatgctgagatgcccttttttgtttttggatgtggactgtataaactctttatacagctgctggctttctttcaagtatttctcgttaatgctgttttcaagctctttattagaaagcccggacaaagcaggtgttttgacatcaatgcttgattggtctttttcctctttgatttcaataaaggtgatcgctttgacgattttgccgatgacagggatctttgacatagcctgagcggtcgtccgggttgatattaacaagcgcagtgaataa
